(12) United States Patent
Keith et al.

(10) Patent No.: US 8,105,826 B2
(45) Date of Patent: Jan. 31, 2012

(54) NUCLEOTIDE AND AMINO ACID SEQUENCES RELATING TO RESPIRATORY DISEASES AND OBESITY

(75) Inventors: Tim Keith, Bedford, MA (US); Randall D. Little, Newtonville, MA (US); Paul Van Eerdewegh, Weston, MA (US); Josée Dupuis, Newton, MA (US); Richard G. Del Mastro, Norfolk, MA (US); Jason Simon, Westfield, NJ (US); Kristina Allen, Hopkinton, MA (US); Sunil D. Pandit, Gaithersburg, MD (US)

(73) Assignee: Oscient Pharmaceuticals Corporation, Waltham, MA (US)

( * ) Notice: Subject to any disclaimer, the term of this patent is extended or adjusted under 35 U.S.C. 154(b) by 912 days.

(21) Appl. No.: 11/690,650

(22) Filed: Mar. 23, 2007

(65) Prior Publication Data

US 2009/0292002 A1 Nov. 26, 2009

Related U.S. Application Data

(60) Division of application No. 10/021,698, filed on Oct. 22, 2001, now Pat. No. 7,205,146, which is a continuation of application No. 09/881,797, filed on Jun. 14, 2001, now abandoned.

(60) Provisional application No. 60/211,749, filed on Jun. 14, 2000.

(51) Int. Cl.
*C12N 5/10* (2006.01)
(52) U.S. Cl. .............. 435/325; 435/320.1; 435/419; 435/252.1; 435/254.11

(58) Field of Classification Search .................. None
See application file for complete search history.

(56) References Cited

U.S. PATENT DOCUMENTS

| | | | | |
|---|---|---|---|---|
| 4,724,202 A | * | 2/1988 | Dattagupta et al. | 435/6 |
| 6,262,333 B1 | * | 7/2001 | Endege et al. | 800/8 |

OTHER PUBLICATIONS

Galiegue et al., The Journal of Biological Chemistry vol. 274, No. 5, pp. 2938-2952, 1999.*
Branch, TIBS, vol. 23, pp. 45-50, 1998.*
GenEmbl AB002316 (2006).*
Nagase et al., DNA Research 4, pp. 141-150 (1997).*

* cited by examiner

*Primary Examiner* — Jim Ketter
(74) *Attorney, Agent, or Firm* — Locke Lord LLP

(57) ABSTRACT

This invention relates to genes identified from human chromosome 12q23-qter, which are associated with various diseases, including asthma. The invention also relates to the nucleotide sequences of these genes, isolated nucleic acids comprising these nucleotide sequences, and isolated polypeptides or peptides encoded thereby. The invention further relates to vectors and host cells comprising the disclosed nucleotide sequences, or fragments thereof, as well as antibodies that bind to the encoded polypeptides or peptides. Also related are ligands that modulate the activity of the disclosed genes or gene products. In addition, the invention relates to methods and compositions employing the disclosed nucleic acids, polypeptides or peptides, antibodies, and/or ligands for use in diagnostics and therapeutics for asthma and other diseases.

19 Claims, 104 Drawing Sheets

↑ Next interval up

| | | | | |
|---|---|---|---|---|
| 126.1 ◆ | 451.62 F | | AFM067yc5 | D12S79 | Microsatellite anchor marker AFM067yc5 |
| | 454.24 P0.10 | | A009F32 | KIAA0331 | KIAA0331 gene product |
| | 455.39 P0.37 | | sts-N33343 | | ESTs |
| | 455.39 P1.15 | | SGC38179 | | ESTs |
| | 455.70 P0.06 | | stSG54526 | | ESTs |
| | 455.81 P1.35 | | stSG1522 | | ESTs |
| | 455.86 P2.06 | | sts-T56610 | | Homo sapiens mRNA for KIAA0875 protein, p.. |
| | 456.02 P2.38 | | sts-R33659 | | EST |
| | 456.34 P0.23 | | sts-D29101 | | EST |
| | 456.34 P0.04 | ✻ | SGC44506 | | ESTs |
| | 456.86 P2.34 | | NIB1804 | | ESTs |
| | 456.86 P>3.00 | | stSG44263 | | ESTs, Weakly similar to calcium-binding pr.. |
| | 456.86 " | | stSG62560 | | Homo sapiens clone 24852 mRNA sequence |
| | 456.96 P1.66 | ✻ | sts-AA001615 | | ESTs |
| | 456.96 P0.04 | | sts-T94297 | | ESTs, Weakly similar to TBX2 gene [H.sapi.. |
| | 457.17 P1.31 | | stSG54365 | | ESTs |
| | 457.17 P0.13 | | WI-21497 | | Homo sapiens mRNA for KIAA0875 protein, p.. |
| | 457.17 P0.30 | | WI-20357 | | Homo sapiens mRNA for KIAA0875 protein, p.. |
| | 457.17 P0.38 | | SGC31491 | NOS1 | nitric oxide synthase 1 (neuronal) |
| | 457.17 P0.31 | | RK903_904 | NOS1 | nitric oxide synthase 1 (neuronal) |
| | 457.17 P0.18 | | sts-AA007571 | | ESTs |
| | 457.17 P1.35 | | stSG46223 | | ESTs |
| | 457.17 " | | stSG58387 | | ESTs |
| ◆ | 457.27 P>3.00 | ✻ | Cda1ce05 | | Homo sapiens clone 23714 mRNA sequence |
| | 457.27 P0.10 | ✻ | sts-W79390 | NME2 | non-metastatic cells 2, protein (NM23B) exp.. |
| | 457.48 P0.20 | | sts-Z40829 | | ESTs |
| | 460.94 P0.00 | ✻ | A005Q47 | | ESTs |
| 133.8 ◆ | 460.94 F | | AFM351tb9 | D12S366 | Microsatellite anchor marker AFM351tb9 |

↓ Next interval down

FIG. 2 B

Chromosome 12: D12S366-D12S340
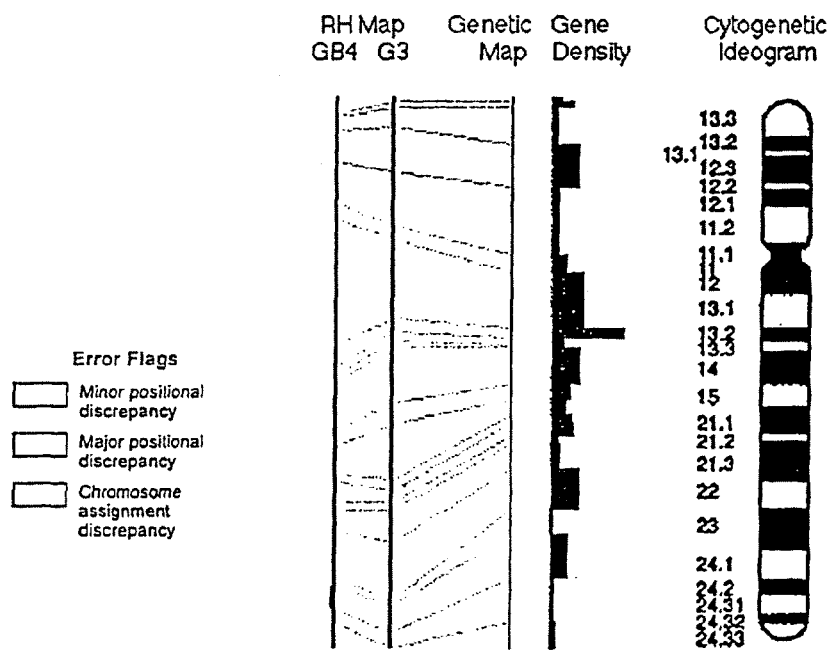
Error Flags
- ☐ Minor positional discrepancy
- ☐ Major positional discrepancy
- ☐ Chromosome assignment discrepancy
The interval shown is on the GB4 map
See also: equivalent interval on G3 map
About This Interval
| | |
|---|---|
| Top of interval: | D12S366 (133.8 cM) |
| Bottom of interval: | D12S340 (147.5 cM) |
| Genetic size of bin: | 14 cM |
| Physical size of bin: | 21 cR3000 |
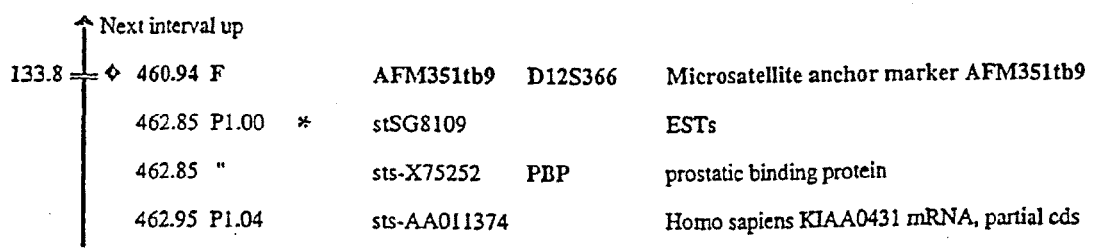
FIG. 2 C

| | | | |
|---|---|---|---|
| 463.77 | P0.19 | WI-16745 | | Human clone 37, 5cM region surrounding hepa.. |
| ❖ 463.77 | P0.20 | SGC33949 | KIAA0262 | KIAA0262 gene product |
| 463.98 | P0.02 | A008B04 | | ESTs |
| 463.98 | " | stSG50309 | | ESTs |
| 463.98 | " | stSG49970 | | Homo sapiens mRNA for KIAA0875 protein, p.. |
| 463.98 | P0.04 | stSG27318 | | Human clone 23932 mRNA sequence |
| 463.98 | P0.08 | R06295 | | EST |
| 463.98 | P1.33 | sts-W56792 | | ESTs |
| 464.08 | P2.32 | A007E48 | | ESTs |
| 464.19 | P1.28 | A009U43 | | ESTs |
| 464.29 | P1.33 | stSG3138 | | Homo sapiens mRNA for KIAA0949 protein, p.. |
| 464.39 | P1.09 | sts-F21636 | | Human DNA sequence from BAC 15E1 on chrom.. |
| 464.39 | P1.13 | stSG15685 | KIAA0262 | KIAA0262 gene product |
| 464.39 | " | RP_P0_1 | RPLP0 | Ribosomal protein large, P0 |
| 464.39 | P1.09 | stSG29626 | | ESTs |
| 464.39 | P1.14 | stSG31407 | | Human DNA sequence from BAC 15E1 on chrom.. |
| 464.39 | " | A001T32 | PXN | paxillin |
| 464.39 | " | A001W18 | | H.sapiens mRNA for AMP-activated protein .. |
| 464.39 | " | WIAF-40 | | Human mRNA for KIAA0219 gene, partial cds |
| 464.39 | " | sts-T95105 | | ESTs |
| 464.39 | " | Cda0id01 | | ESTs |
| 464.39 | P1.13 | stSG31431 | | ESTs, Moderately similar to (defline not a.. |
| ❖ 464.39 | " * | WI-13177 | | Homo sapiens clone 23714 mRNA sequence |
| 464.39 | " | IB1092 | | Homo sapiens clone 23714 mRNA sequence |
| 464.39 | " | T79466 | | ESTs |
| 464.39 | P1.18 | stSG48379 | | ESTs |
| 464.45 | P1.05 | KIAA0219 | | Human mRNA for KIAA0219 gene, partial cds |
| 464.45 | " | stSG40392 | | ESTs |
| 464.45 | " | stSG31586 | | H.sapiens mRNA for AMP-activated protein .. |
| ❖ 464.49 | P0.21 | A006F12 | KIAA0152 | KIAA0152 gene product |
| 464.49 | P0.25 | sts-AA002185 | PXN | paxillin |
| 464.49 | P0.10 | stSG48442 | | ESTs |
| 464.49 | " | sts-T16456 | | ESTs |
| 464.49 | " | stSG62260 | | ESTs |

FIG. 2D

| | | | | | |
|---|---|---|---|---|---|
| | 464.49 | " | | NIB1331 | | ESTs |
| | 464.49 | " | | WI-15518 | | ESTs, Weakly similar to fos39554 1 [H.sapi.. |
| | 464.49 | " | | WIAF-1058 | | ESTs, Moderately similar to unknown [H.sap.. |
| | 464.49 | " | | SGC34758 | | ESTs |
| | 464.49 | " | | WI-19738 | | Homo sapiens mRNA for KIAA0787 protein, p.. |
| | 464.49 | " | | IB383 | | ESTs, Weakly similar to fos39554 1 [H.sapi.. |
| | 464.49 | " | | SGC32343 | | ESTs |
| | 464.79 | P0.96 | | SGC33521 | | ESTs |
| | 464.79 | P0.96 | * | X58965 | NME2 | non-metastatic cells 2, protein (NM23B) exp.. |
| | 465.20 | P0.20 | | sts-H10302 | | ESTs |
| ❖ | 465.38 | P0.85 | | A007E11 | KIAA0262 | KIAA0262 gene product |
| | 465.41 | P0.81 | | A007I44 | RPLP0 | ribosomal protein, large, P0 |
| | 465.41 | " | | stSG22726 | | EST |
| | 465.41 | " | | WI-17776 | | ESTs |
| | 465.41 | " | | stSG31753 | | Human mRNA for KIAA0219 gene, partial cds |
| | 465.41 | " | | stSG31753 | | Human mRNA for KIAA0219 gene, partial cds |
| | 465.41 | P0.77 | | stSG4775 | SFRS9 | splicing factor, arginine/serine-rich 9 |
| | 465.41 | " | | A002J47 | | ESTs, Weakly similar to heat shock protein.. |
| | 465.41 | P0.80 | | stSG46660 | | EST |
| | 465.51 | P0.75 | | stSG41086 | PXN | paxillin |
| | 465.51 | P0.83 | | stSG52121 | | ESTs |
| | 465.91 | P0.01 | | WI-16071 | | ESTs |
| | 465.91 | P0.00 | | WI-13962 | | H.sapiens mRNA for AMP-activated protein .. |
| | 466.62 | P0.00 | | sts-AA011220 | SFRS9 | splicing factor, arginine/serine-rich 9 |
| | 466.71 | P0.00 | | stSG4712 | | ESTs, Weakly similar to homology with o251.. |
| | 466.91 | P0.01 | | WI-15135 | | Homo sapiens mRNA for KIAA0787 protein, p.. |
| | 466.91 | P0.01 | | D12S2088 | TCF1 | transcription factor 1, hepatic; LF-B1, hep.. |
| | 467.01 | P0.01 | | stSG52567 | | ESTs |
| 135.1 | 467.11 | F | | AFM123xh2 | D12S86 | Microsatellite marker AFM123xh2 |
| 135.1 | 467.11 | P0.01 | | AFM299zd5 | D12S349 | Microsatellite marker AFM299zd5 |
| | 467.11 | P0.01 | | AFM123xh2 | | Unknown |
| 137.5 | ❖ 467.21 | P0.02 | | AFM220zf4 | D12S321 | Microsatellite marker AFM220zf4 |
| | 467.21 | P0.02 | | sts-W73277 | SFRS9 | splicing factor, arginine/serine-rich 9 |
| | 467.21 | P0.02 | | stSG8721 | | EST |

FIG. 2 E

| | | | |
|---|---|---|---|
| 467.21 " | stSG44224 | | ESTs |
| 467.21 " | stSG49978 | | H.sapiens mRNA for AMP-activated protein .. |
| ♦ 467.21 " | stSG31862 | | Homo sapiens HSPC004 mRNA, complete cds |
| 467.21 " | stSG47820 | | ESTs |
| 467.21 " | Bdac4h06 | KIAA0262 | KIAA0262 gene product |
| 467.21 " | stSG15021 | | ESTs |
| 467.21 " | A002B13 | SFRS9 | splicing factor, arginine/serine-rich 9 |
| ♦ 467.21 " | H50549 | KIAA0262 | KIAA0262 gene product |
| 467.21 P0.03 | SGC35167 | | EST |
| 467.21 P0.03 | WI-19637 | | H.sapiens mRNA for AMP-activated protein .. |
| 467.21 P0.02 | WIAF-607 | | Unknown |
| 467.31 P0.02 | WI-16997 | RPLP0 | ribosomal protein, large, P0 |
| 468.93 P0.85 | SGC31344 | | EST |
| 469.13 P0.90 | A007C39 | ACADS | acyl-Coenzyme A dehydrogenase, C-2 to C-3 .. |
| 469.13 P0.14 | stSG35104 | | ESTs |
| 469.13 " | A006Q41 | | Unknown |
| 469.23 P0.18 | sts-Y07684 | P2RX4 | purinergic receptor P2X, ligand-gated ion c.. |
| 469.33 P0.93 | stSG8506 | | ESTs, Moderately similar to unknown [H.sap.. |
| 469.33 " | R01708 | | EST |
| 469.33 " | stSG54819 | HCALB_BR | calbrain |
| 469.33 " | A001Z45 | | ESTs, Highly similar to (defline not avail.. |
| 469.33 " | stSG35318 | | ESTs, Weakly similar to fos39554 1 [H.sapi.. |
| 469.33 " | stSG63173 | | EST |
| 469.33 " | stSG31374 | OASL | 2'-5'oligoadenylate synthetase-like |
| 469.42 P1.01 | WI-16068 | | EST |
| 469.44 P0.23 | stSG1961 | | Homo sapiens mRNA for KIAA0787 protein, p.. |
| 469.44 " | stSG62627 | | EST |
| 469.44 " | stSG36007 | | Homo sapiens full length insert cDNA clone.. |
| 469.44 " | stSG39281 | P2RX7 | purinergic receptor P2X, ligand-gated ion c.. |
| 469.44 " | stSG2554 | | Homo sapiens mRNA for KIAA0787 protein, p.. |
| 469.44 " | stSG62591 | | ESTs |
| ♦ 469.54 P1.03 | A006N38 | KIAA0152 | KIAA0152 gene product |
| 469.62 P1.03 | sts-N34573 | | ESTs |
| 469.62 P1.03 | sts-N58045 | | ESTs |

FIG. 2 F

| | | | | |
|---|---|---|---|---|
| | 469.62 P1.04 | | WI-13224 | | EST |
| | 469.83 P1.12 | | SGC34424 | | ESTs |
| | 469.93 P1.14 | | stSG3875 | PSMD9 | proteasome (prosome, macropain) 26S subunit.. |
| | 470.14 P1.17 | | stSG52516 | | ESTs, Weakly similar to (defline not avail.. |
| | 470.24 P1.32 | | D0S1735E | | ESTs |
| | 470.24 P1.12 | | WI-6178 | | ESTs |
| | 470.32 P1.25 | | sts-U29895 | | Unknown |
| | 470.32 P1.24 | | WI-19611 | PSMD9 | proteasome (prosome, macropain) 26S subunit.. |
| | 470.43 P1.29 | | stSG52094 | | ESTs |
| | 470.63 P1.38 | | A004017 | | ESTs |
| ◆ | 470.77 P1.32 | ** | SGC33451 | | ESTs, Weakly similar to rhoHP1 [H.sapiens.. |
| ◆ | 470.84 P1.35 | ** | sts-X64838 | RSN | restin (Reed-Steinberg cell-expressed inter.. |
| | 470.84 P1.52 | | WI-13062 | | Homo sapiens mRNA, expressed in fibroblast.. |
| | 471.27 P1.60 | | sts-R99269 | | EST |
| | 471.37 P1.70 | | stSG1991 | | ESTs |
| | 471.37 " | | stSG15859 | | Homo sapiens full length insert cDNA YQ02.. |
| | 471.58 P1.78 | | stSG29729 | | ESTs, Weakly similar to (defline not avail.. |
| | 471.58 P1.37 | | WI-16979 | | ESTs |
| | 471.65 P1.39 | | WI-17693 | | EST |
| | 471.80 P1.29 | | WI-22060 | | ESTs |
| | 471.90 P>3.00 | | stSG8210 | | ESTs, Moderately similar to neuronal threa.. |
| | 471.90 " | | WI-17956 | | EST |
| | 471.90 " | | WI-20969 | | Homo sapiens mRNA for KIAA0867 protein, c.. |
| | -471.90 " | | stSG47029 | | ESTs |
| | 471.90 " | | stSG47647 | | EST |
| | 471.90 " | | sts-W45376 | | Homo sapiens mRNA for KIAA0867 protein, c.. |
| ◆ | 471.90 " | ** | WI-6021 | RSN | restin (Reed-Steinberg cell-expressed inter.. |
| | 471.90 " | | NIB962 | | ESTs |
| | 471.90 " | | A009E34 | | ESTs, Moderately similar to neuronal threa.. |
| | 471.90 " | | sts-T17477 | | ESTs |
| | 472.08 P1.49 | | sts-X89984 | | H.sapiens mRNA for BCL7A protein |
| | 472.12 P>3.00 | | SGC34693 | | EST |
| | 472.12 P>3.00 | | A009O01 | | ESTs, Weakly similar to neuronal thread pr.. |
| | 472.29 P>3.00 | | stSG47084 | | ESTs |

FIG. 2 G

| | | | |
|---|---|---|---|
| 472.40 P>3.00 | stSG58209 | EEF1D | eukaryotic translation elongation factor 1 d.. |
| 472.40 P>3.00 | AA213821 | EEF1D | eukaryotic translation elongation factor 1 d.. |
| 472.61 P>3.00 | A002R44 | | Unknown |
| 472.61 P>3.00 | SGC35850 | EEF1D | eukaryotic translation elongation factor 1 d.. |
| 472.72 P0.01 | sts-H98108 | | ESTs |
| 472.97 P>3.00 | WI-6239 | | ESTs |
| 473.04 P>3.00 | sts-H75490 | | ESTs |
| ◆ 473.58 P>3.00 ** | WI-14983 | RSN | restin (Reed-Steinberg cell-expressed inter.. |
| 474.01 P>3.00 | stSG8610 | | ESTs |
| 474.01 P>3.00 | stSG47080 | | ESTs |
| 474.38 P2.18 | stSG8686 | | ESTs, Weakly similar to similar to pre-mRN.. |
| 474.38 P2.25 | stSG26358 | | ESTs, Weakly similar to similar to pre-mRN.. |
| 474.38 " | stSG29931 | | ESTs |
| 474.38 " | WI-17926 | | ESTs |
| 474.38 " | WI-12790 | | ESTs, Weakly similar to MULTIDRUG RESI.. |
| 474.38 " | 1834 | | EST |
| 474.38 P2.26 | sts-X98258 | MPP-9 | M phase phosphoprotein 9 |
| 474.38 P2.39 | stSG40753 | | ESTs |
| 474.64 P>3.00 | A004D47 | | ESTs, Highly similar to There are three pu.. |
| 474.64 P>3.00 | sts-N23129 | MPP-9 | M phase phosphoprotein 9 |
| 474.75 P2.41 | sts-AA040696 | | ESTs |
| 474.81 P2.37 | sts-AA022496 | | ESTs |
| 474.81 P2.28 | stSG46930 | MPP-9 | M phase phosphoprotein 9 |
| 474.97 P>3.00 | WI-20552 | DRP | density-regulated protein |
| 475.02 P>3.00 | SGC30324 | | ESTs |
| 475.07 P>3.00 | D10923 | HM74 | putative chemokine receptor; GTP-binding pr.. |
| 475.07 P>3.00 | stSG2418 | DOC1 | Deleted in oral cancer-1 |
| 475.07 " | stSG21321 | | ESTs |
| 475.07 " | stSG53515 | MPP-9 | M phase phosphoprotein 9 |
| 475.07 P>3.00 | SGC31687 | DOC1 | Deleted in oral cancer-1 |
| 475.07 P>3.00 | WIAF-214 | HM74 | putative chemokine receptor; GTP-binding pr.. |
| 475.13 P0.79 | sts-W93806 | | ESTs |
| 475.13 P2.13 | stSG48145 | | ESTs |
| 475.18 P2.34 | A003B12 | | Homo sapiens full length insert cDNA clone.. |

FIG. 2 H

| | | | | |
|---|---|---|---|---|
| | 475.18 P>3.00 | | WI-22211 | Homo sapiens full length insert cDNA clone.. |
| | 475.18 P2.08 | | stSG48093 | ESTs |
| | 475.18 " | | A004P27 | ESTs, Weakly similar to MULTIDRUG RESI.. |
| | 475.35 P2.10 | | stSG9904 | ESTs |
| | 475.40 P0.45 | | sts-AA024696 | ESTs |
| | 475.51 P>3.00 | | stSG53793 | ESTs |
| | 476.10 P>3.00 | | Bda98d05 | Homo sapiens full length insert cDNA clone.. |
| | 476.21 P>3.00 | | sts-H24468 | ESTs |
| | 476.21 P>3.00 | | sts-N94741 | ESTs |
| | 476.64 P0.28 | | stSG22488 | ESTs |
| | 476.85 P0.36 | | stSG44909 | ESTs |
| | 477.06 P0.10 | | stSG54797 | ESTs |
| | 477.27 P1.33 | | stSG48099 | ESTs |
| | 477.37 P0.09 * | | sts-AA028894 | Homo sapiens silencing mediator of retinoic.. |
| | 477.80 P1.44 | | stSG52727 | EST |
| | 477.80 " | | U44799 | Human U1-snRNP binding protein homolog mR.. |
| | 477.80 " | | WI-15963 | ESTs |
| | 477.80 " | | stSG53886 | ESTs, Weakly similar to neuronal thread pr.. |
| | 478.74 P0.01 | | WIAF-364 | ESTs |
| | 479.01 P0.21 | | WI-21080 | ESTs |
| | 479.13 P0.19 | | A009B29 | ESTs |
| | 479.33 P0.22 | | A006F32 | EIF2B1 | eukaryotic translation initiation factor 2B.. |
| | 479.33 P0.19 | | WIAF-449 | EIF2B1 | eukaryotic translation initiation factor 2B.. |
| | 479.33 P0.19 * | | WI-15890 | H.sapiens mRNA for transmembrane protein r.. |
| | 479.55 P0.20 * | | stSG349 | H.sapiens mRNA for transmembrane protein r.. |
| | 479.55 " * | | A004O46 | BDKRB2 | bradykinin receptor B2 |
| | 479.55 " | | stSG42540 | ESTs |
| | 479.55 " | | sts-N26791 | ESTs |
| | 479.55 " | | stSG53943 | ESTs |
| | 479.55 " | | stSG49468 | EST |
| 145.7 | 479.74 P0.16 | | AFM294ze9 | D12S342 | Microsatellite marker AFM294ze9 |
| | 481.46 P0.00 | | sts-AA007694 | EST |
| 147.5 ◆ | 481.56 F | | AFM294xg1 | D12S340 | Microsatellite anchor marker AFM294xg1 |

↓ Next interval down

FIG. 2I

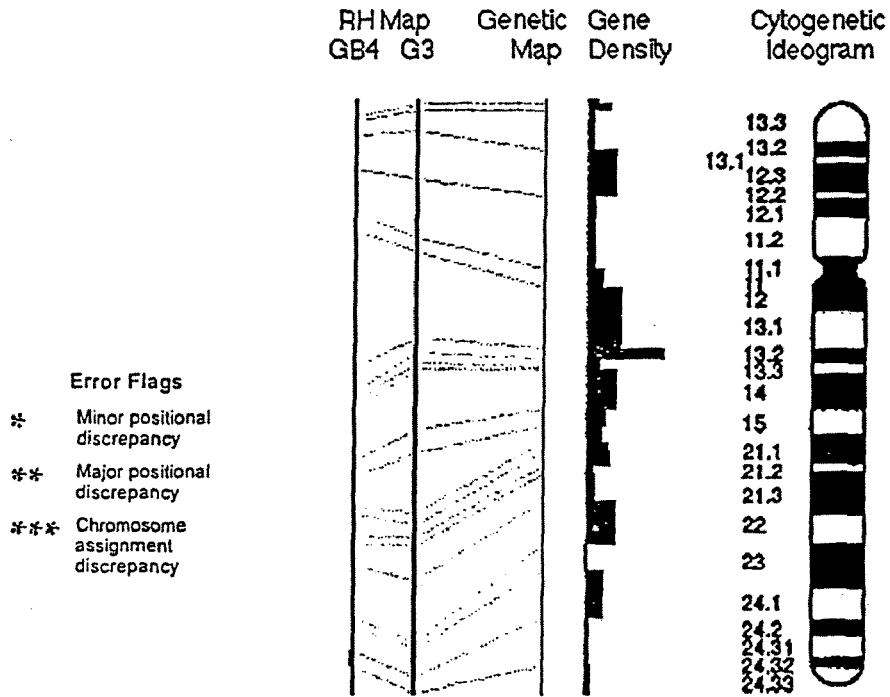
The interval shown is on the GB4 map
See also: equivalent interval on G3 map
About This Interval
Top of interval: D12S340 (147.5 cM)
Bottom of interval: D12S97 (160.9 cM)
Genetic size of bin: 13 cM
Physical size of bin: 13 cR3000
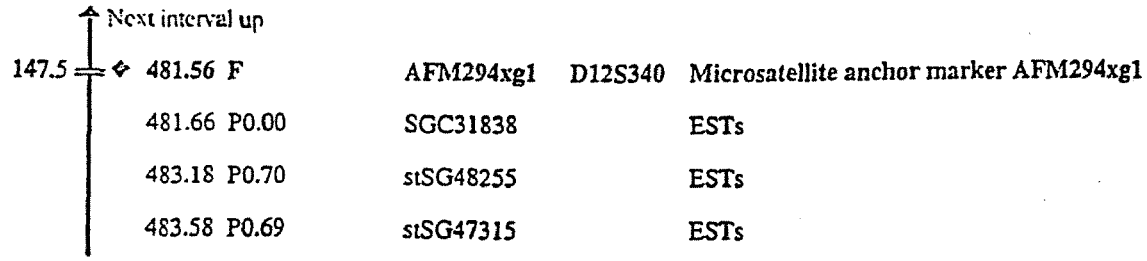
FIG. 2 J

| | | | | |
|---|---|---|---|---|
| 483.87 | P0.83 | | stSG47707 | | ESTs |
| 484.70 | P0.93 | | stSG4060 | | ESTs |
| 484.70 | " | | stSG62390 | GTF2H3 | general transcription factor IIH, polypepti.. |
| 484.70 | " | | stSG42994 | | ESTs |
| 484.73 | P0.74 | | stSG46906 | | ESTs |
| 484.80 | P0.91 | | A004X33 | | ESTs |
| 484.91 | P1.11 | | stSG3211 | | ESTs, Weakly similar to B-cell growth fact.. |
| 484.91 | " | * | sts-Z41302 | BDKRB2 | bradykinin receptor B2 |
| 484.91 | " | * | sts-Z41302 | BDKRB2 | bradykinin receptor B2 |
| 484.91 | " | | sts-T58259 | | ESTs, Weakly similar to B-cell growth fact.. |
| 484.91 | " | | stSG52737 | | ESTs |
| 484.91 | " | | Bda03b10 | UBC | ubiquitin C |
| 484.91 | " | | stSG1936 | CD36L1 | CD36 antigen (collagen type I receptor, thr.. |
| 484.91 | " | | sts-AA017225 | | ESTs |
| 484.91 | P1.15 | | WI-12212 | | ESTs |
| 485.12 | P1.18 | | A004F14 | | ESTs |
| 485.12 | P1.18 | | SGC31333 | | ESTs |
| 485.23 | P1.21 | * | WI-12482 | BDKRB2 | bradykinin receptor B2 |
| 485.23 | P1.07 | | sts-AA017698 | | ESTs |
| 485.33 | P1.22 | | WI-12422 | | ESTs |
| 485.51 | P1.18 | | stSG42398 | | EST |
| 485.64 | P1.04 | | sts-AA009669 | | ESTs |
| 486.07 | P2.50 | | stSG21539 | | EST |
| 486.13 | P1.44 | | WI-12439 | | EST |
| 486.34 | P1.26 | | sts-W31616 | UBC | ubiquitin C |
| 486.38 | P>3.00 | | stSG54715 | | ESTs |
| 486.76 | P1.64 | * | WI-6921 | | H.sapiens mRNA for transmembrane protein r.. |
| 487.08 | P>3.00 | | WI-13120 | | Human mRNA for KIAA0318 gene, partial cds |
| 487.23 | P>3.00 | | stSG54353 | | ESTs |
| 487.23 | P>3.00 | | stSG22703 | | EST |
| 487.28 | P>3.00 | | stSG62698 | | ESTs |
| 487.28 | P>3.00 | * | sts-D60472 | | Homo sapiens silencing mediator of retinoic.. |
| 487.28 | P>3.00 | | stSG36097 | | ESTs |
| 487.33 | P1.36 | | sts-U37146 | | Homo sapiens silencing mediator of retinoic.. |

FIG. 2K

|       |               |         |          |                                            |
|-------|---------------|---------|----------|--------------------------------------------|
|       | 487.50 P>3.00 | stSG9807 |         | ESTs                                       |
|       | 487.50 P>3.00 | stSG15434 |        | ESTs                                       |
|       | 487.60 P>3.00 | stSG53251 |        | ESTs                                       |
|       | 487.60 P>3.00 | stSG30525 | SRRP129 | SC35-interacting protein 1                 |
|       | 487.60 P>3.00 | stSG46424 |        | ESTs                                       |
|       | 487.70 P>3.00 | A007A34 |          | ESTs                                       |
| 154.4 | 487.75 P2.00  | AFMa197zd9 | D12S1609 | Microsatellite marker AFMa197zd9       |
|       | 487.75 P2.02  | A006D44 |          | ESTs                                       |
|       | 487.80 P>3.00 | SGC30248 |         | ESTs, Weakly similar to peptide/histidine .. |
|       | 488.07 P1.68  | stSG6320 |         | Homo sapiens clone 24617 mRNA sequence     |
|       | 488.07 P1.66  | stSG6305 |         | Homo sapiens clone 24790 mRNA sequence     |
|       | 488.07 P0.02  | sts-N20163 |       | Homo sapiens full length insert cDNA clone.. |
|       | 488.12 P>3.00 | stSG60065 |        | ESTs                                       |
|       | 488.12 P>3.00 | stSG47723 |        | ESTs                                       |
|       | 488.44 P1.59  | stSG3292 |         | Homo sapiens clone 24790 mRNA sequence     |
|       | 488.44 P0.03  | WIAF-856 |         | EST, Weakly similar to reverse transcripta.. |
|       | 488.65 P1.54  | WI-12272 |         | Homo sapiens clone 24790 mRNA sequence     |
|       | 488.65 P1.82  | stSG52343 |        | ESTs                                       |
|       | 488.82 P1.80  | stSG16387 | CPN2   | carboxypeptidase N, polypeptide 2, 83kD    |
|       | 488.97 P1.80  | SGC31722 |         | ESTs                                       |
|       | 489.07 P0.06  | stSG54325 |        | ESTs                                       |
|       | 489.07 P>3.00 | stSG63473 |        | ESTs                                       |
| 160.9 | ◆ 489.07 P>3.00 | AFMa123xe1 | D12S367 | Microsatellite marker AFMa123xe1      |
|       | 489.14 P0.17  | sts-T81113 |       | ESTs                                       |
|       | 489.29 P0.05  | sts-AA025438 |     | EST                                        |
|       | 489.50 P1.37  | *** Cda1ad08 |      | ESTs                                       |
|       | 489.50 P0.05  | WI-15018 |         | ESTs                                       |
|       | 489.50 P1.50  | WI-18492 |         | ESTs                                       |
|       | 489.57 P1.48  | WI-16177 |         | Homo sapiens androgen receptor associated p.. |
|       | 489.67 P1.44  | stSG53307 |        | ESTs                                       |
|       | 489.71 P1.43  | stSG53541 |        | Homo sapiens hiwi mRNA, partial cds        |
|       | 489.71 P1.43  | stSG9546 |         | Homo sapiens clone 24617 mRNA sequence     |
|       | 489.89 P1.56  | A006O16 |          | ESTs                                       |
|       | 490.10 P1.42  | H64839 |           | EST                                        |

FIG. 2L

|  | 490.20 P0.05 | stSG43910 | SFRS8 | splicing factor, arginine/serine-rich 8 (sup.. |
| 160.9 | ◆ 494.19 F | AFM210zd6 | D12S97 | Microsatellite anchor marker AFM210zd6 |

↓ Next interval down

FIG. 2 M

Chromosome 12: D12S97-qTEL

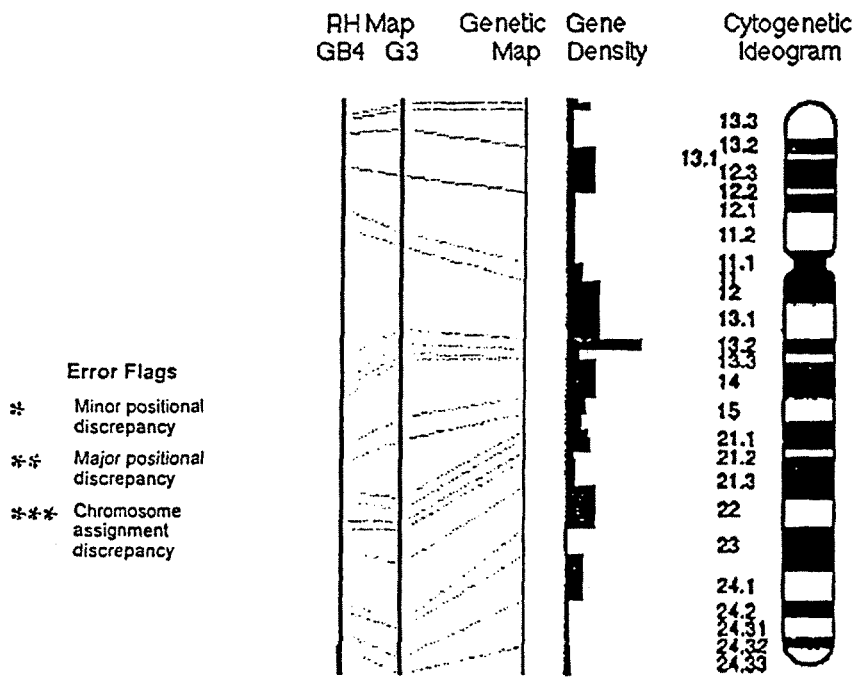

Error Flags
* Minor positional discrepancy
** Major positional discrepancy
*** Chromosome assignment discrepancy The interval shown is on the GB4 map See also: equivalent interval on G3 map

About This Interval

Top of interval: D12S97 (160.9 cM)
Bottom of interval: chr12_qTEL (169.1 cM)
Genetic size of bin: 8 cM
Physical size of bin: 172 cR$_{3000}$

| | | | | |
|---|---|---|---|---|
| ↑ Next interval up | | | | |
| 160.9 — ✦ 494.19 F | AFM210zd6 | D12S97 | Microsatellite anchor marker AFM210zd6 |
| 498.06 P0.02 | stSG53600 | | ESTs, Weakly similar to peptide/histidine .. |
| 499.71 P1.73 | stSG3357 | | ESTs |
| 165.7   499.71 " | AFM295ye9 | D12S343 | Microsatellite marker AFM295ye9 |

FIG. 2 N

| | | | |
|---|---|---|---|
| 499.71 P1.72 | stSG30906 | | ESTs |
| 499.71 " | stSG43796 | MMP17 | matrix metalloproteinase 17 (membrane-insert.. |
| 499.71 P1.71 | sts-X89576 | MMP17 | matrix metalloproteinase 17 (membrane-insert.. |
| 499.92 P>3.00 | stSG43769 | | ESTs |
| 500.50 P1.88 | stSG26056 | | ESTs |
| 500.50 P2.33 | SGC30786 | KIAA0331 | KIAA0331 gene product |
| 500.61 P>3.00 | stSG1702 | | Homo sapiens CAGH32 mRNA, partial cds |
| 500.61 " | sts-N59820 | | ESTs |
| 500.61 " | stSG42115 | KIAA0331 | KIAA0331 gene product |
| 500.61 " | IB2452 | ULK1 | unc-51 (C. elegans)-like kinase 1 |
| 500.61 " | stSG52521 | | ESTs |
| 500.61 " | FB9F8 | | ESTs, Weakly similar to PUTATIVE ATP-D.. |
| 500.61 " | AA252357 | | ESTs |
| 500.61 " | stSG4720 | | Homo sapiens pseudouridine synthase 1 (PUS.. |
| 500.61 " | sts-AA001424 | KIAA0331 | KIAA0331 gene product |
| 500.61 P>3.00 | stSG31443 | | ESTs |
| 500.61 P>3.00 | stSG49622 | ULK1 | unc-51 (C. elegans)-like kinase 1 |
| 500.61 P2.49 | stSG50559 | | ESTs |
| 501.04 P1.10 | stSG54842 | | ESTs |
| 501.04 P2.03 | A008Y05 | | Unknown |
| 501.89 P2.18 | stSG39493 | | Homo sapiens CAGH32 mRNA, partial cds |
| 501.99 P>3.00 | A002A44 | | Homo sapiens CAGH32 mRNA, partial cds |
| 501.99 P>3.00 | sts-H94865 | | EST |
| 501.99 P>3.00 | R50113 | | ESTs |
| 502.10 P1.75 | stSG48386 | | ESTs |
| 502.10 " | stSG50504 | | ESTs |
| 502.63 P0.06 | A006R19 | | ESTs |
| 502.63 P1.06 | WIAF-864 | | ESTs |
| 502.94 P1.51 | stSG54813 | | ESTs, Weakly similar to peroxisome membran.. |
| 503.04 P1.42 | A004B47 | | ESTs, Highly similar to DNA polymerase ep.. |
| 503.25 P0.28 | stSG27206 | | ESTs |
| 503.25 " | stSG40199 | | Homo sapiens mRNA for KIAA0692 protein, p.. |
| 503.46 P0.23 | stSG8935 | | ESTs |
| 504.68 P0.69 | stSG4731 | | Homo sapiens mRNA for KIAA0692 protein, p.. |

FIG. 2O

| | | | | | |
|---|---|---|---|---|---|
| | 504.68 " | | A005Q05 | | ESTs |
| | 504.68 " | | stSG8142 | | ESTs, Highly similar to DNA polymerase ep.. |
| 169.1 | 506.39 F | | AFM310vd5 | D12S357 | Microsatellite marker AFM310vd5 |
| | 506.39 P0.02 | | A005X42 | | Homo sapiens mRNA for KIAA0692 protein, p.. |
| | 508.59 P0.78 | | Cda18g06 | | ESTs |
| ◆ | 508.59 P0.78 | ** | Cda1jf08 | | Homo sapiens mRNA for GCP170, complete cd.. |
| | 508.59 P0.54 | | R39599 | | ESTs |
| | 509.98 P0.10 | | stSG31494 | ZNF140 | zinc finger protein 140 (clone pHZ-39) |
| | 509.98 P0.16 | | stSG40222 | | ESTs |
| | 509.98 " | | sts-R55615 | | ESTs, Weakly similar to zinc finger protei.. |
| | 509.98 " | | sts-R02295 | | ESTs |
| | 509.98 " | | sts-R81342 | | ESTs |
| | 511.20 F | | TEL-12q82 | | Marker TEL-12q82 |
| | 512.81 P0.20 | | sts-H65839 | | ESTs, Weakly similar to transformation-rel.. |
| | 514.97 P0.36 | | stSG46141 | | ESTs, Weakly similar to zinc finger protei.. |
| | 514.97 P0.90 | | stSG52998 | | ESTs |
| | 519.10 P1.77 | | A008W21 | CYP51 | cytochrome P450, 51 (lanosterol 14-alpha-de.. |
| | 519.54 P0.81 | | stSG52716 | | ESTs |
| ● TELOMERE | | | | | |

FIG. 2 P

↑ Next interval up 126.1 — ◆ 4955 F    AFM067yc5  D12S79    Microsatellite anchor marker AFM067yc5 (SHGC-692)

129.2     4988 F    AFMa067we1 D12S1718  Microsatellite marker AFMa067we1 (SHGC-20..

◆ 5007 F *  SHGC-2657           Homo sapiens clone 23714 mRNA sequence

◆ 5014 F *  SHGC-2653           Homo sapiens clone 23714 mRNA sequence 133.8 — ◆ 5018 F    AFM351tb9  D12S366   Microsatellite anchor marker AFM351tb9 (SHGC-2155)

↓ Next interval down

FIG. 3 B

Chromosome 12: D12S340-D12S97

The interval shown is on the G3 map

See also: equivalent interval on GB4 map

About This Interval

| | |
|---|---|
| Top of interval: | D12S340 (147.5 cM) |
| Bottom of interval: | D12S97 (160.9 cM) |
| Genetic size of bin: | 13 cM |
| Physical size of bin: | 151 cR$_{10000}$ |

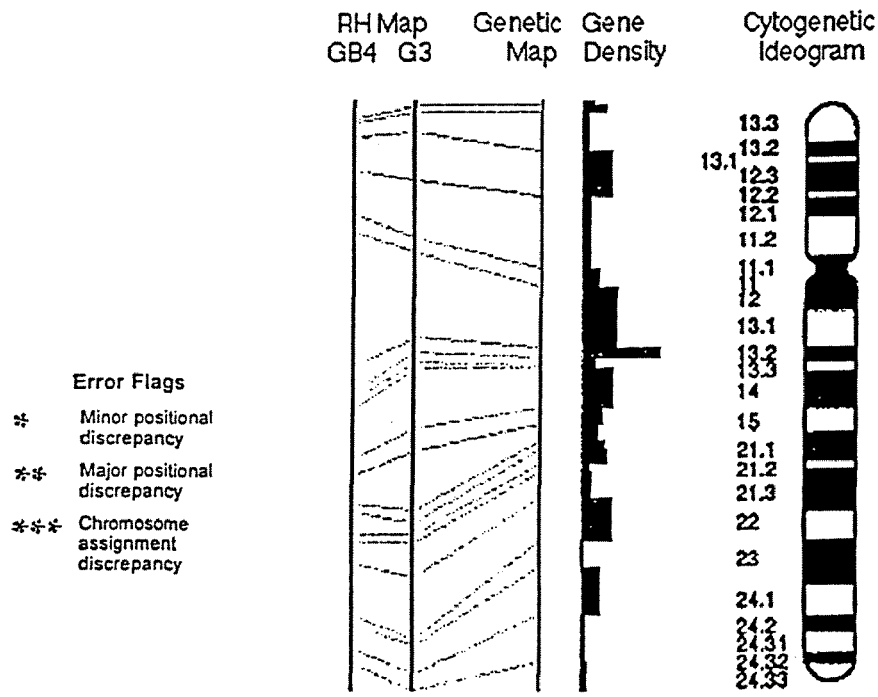
Chromosome 12: D12S97-qTEL
The interval shown is on the G3 map
See also: equivalent interval on GB4 map
About This Interval
Top of interval: D12S97 (160.9 cM)
Bottom of interval: chr12_qTEL (169.1 cM)
Genetic size of bin: 8 cM
Physical size of bin: ~4429 cR10000
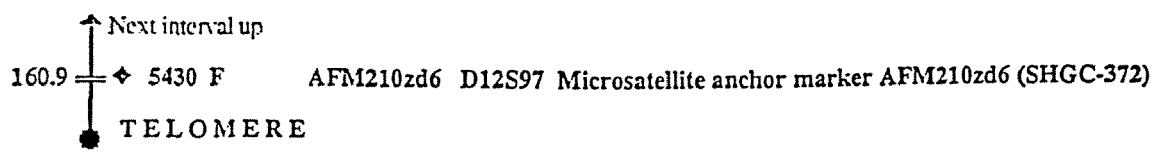
FIG. 3 G

Gene 454
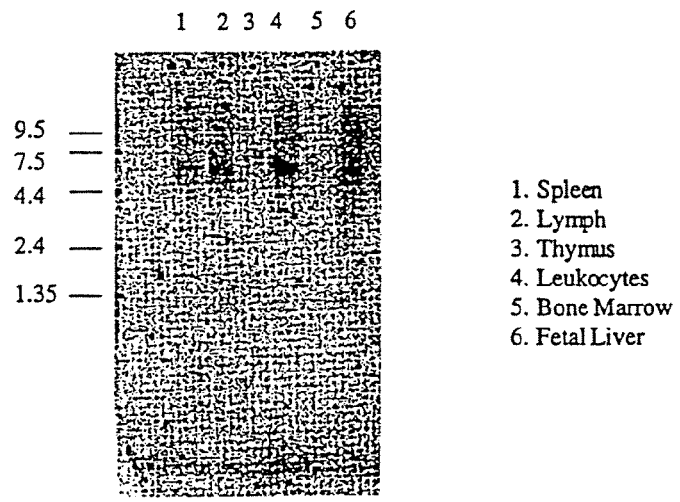
1. Spleen
2. Lymph
3. Thymus
4. Leukocytes
5. Bone Marrow
6. Fetal Liver
Gene 515
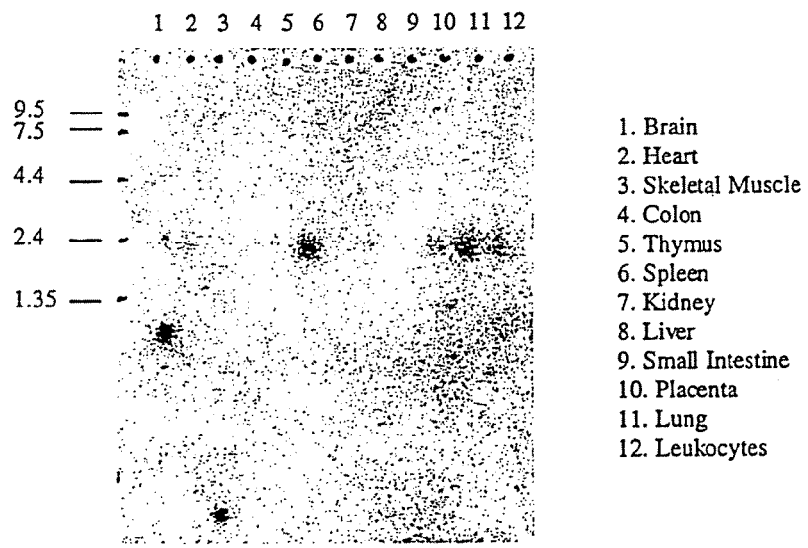
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 B

Gene 543
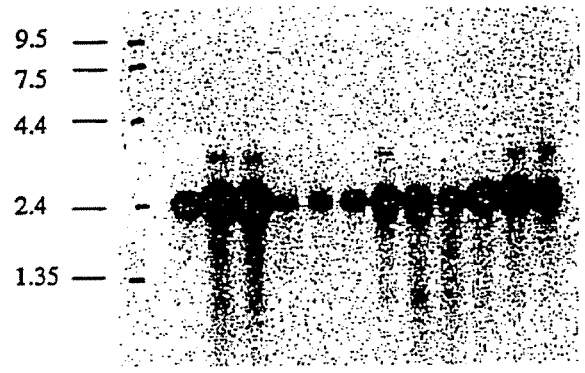
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 548
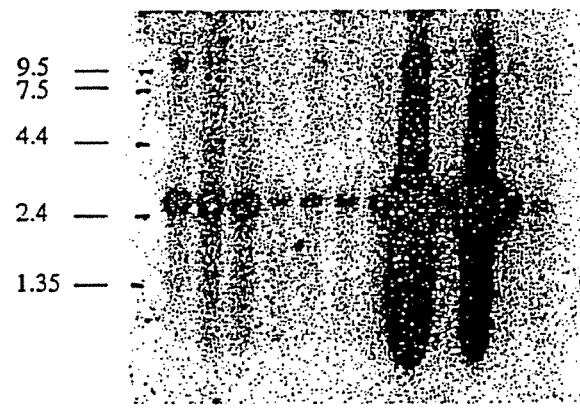
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 C Gene 550
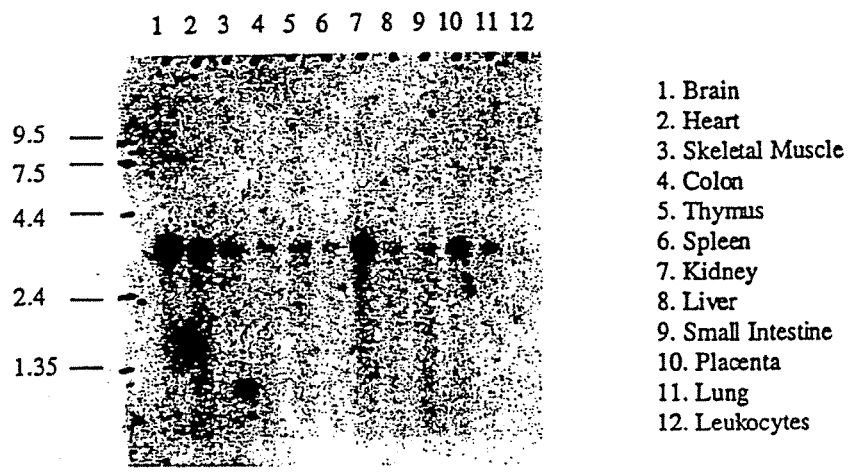
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 561
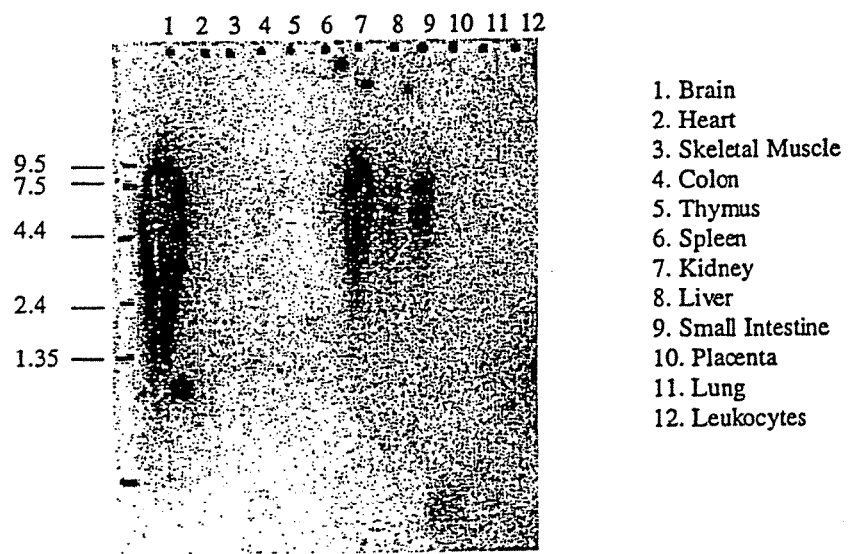
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 D

Gene 564
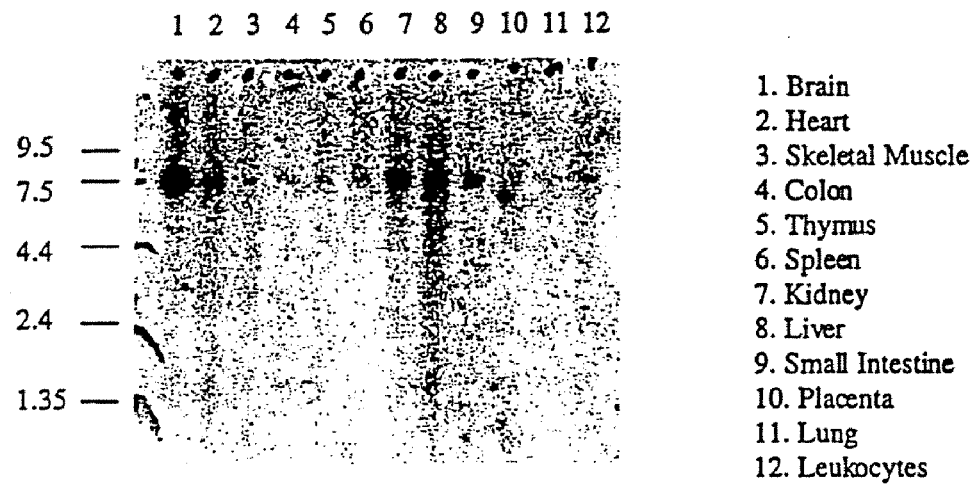
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 570
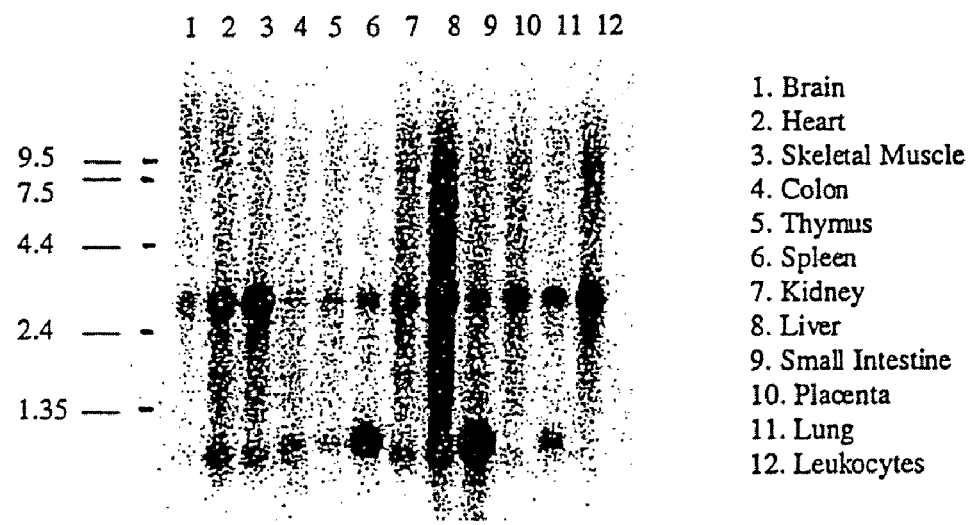
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 E

Gene 576
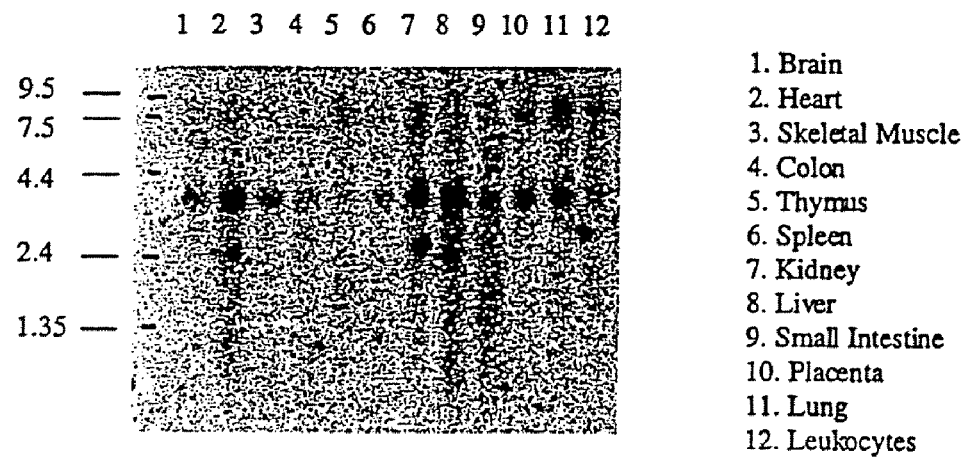
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 577
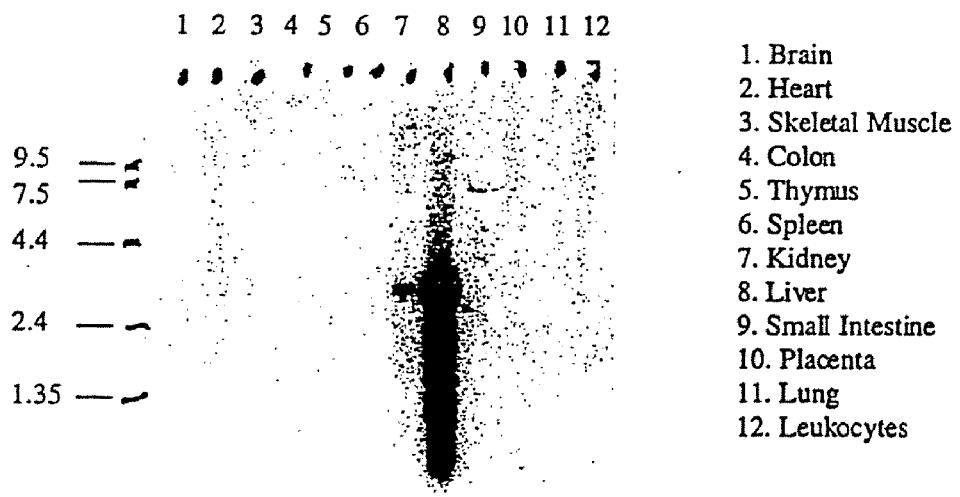
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 F Gene 578
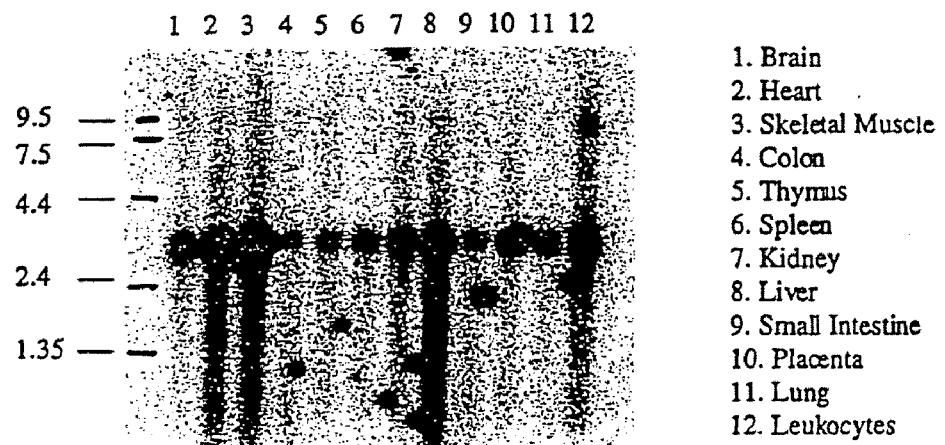
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 579
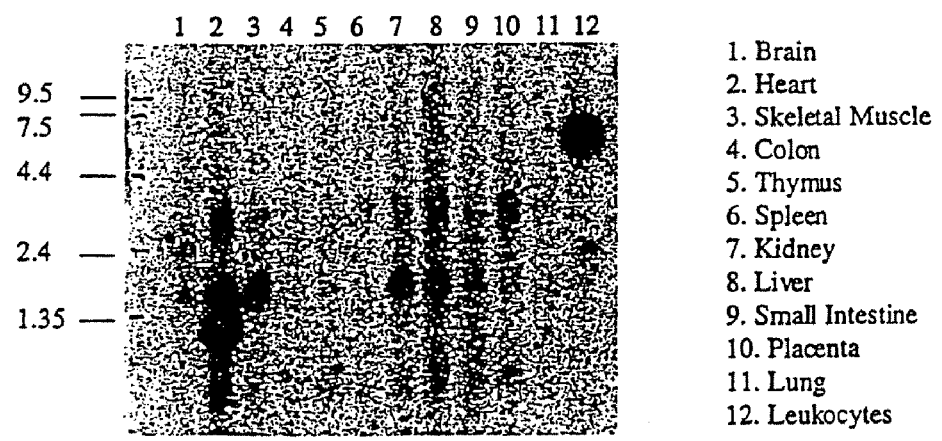
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 G Gene 580
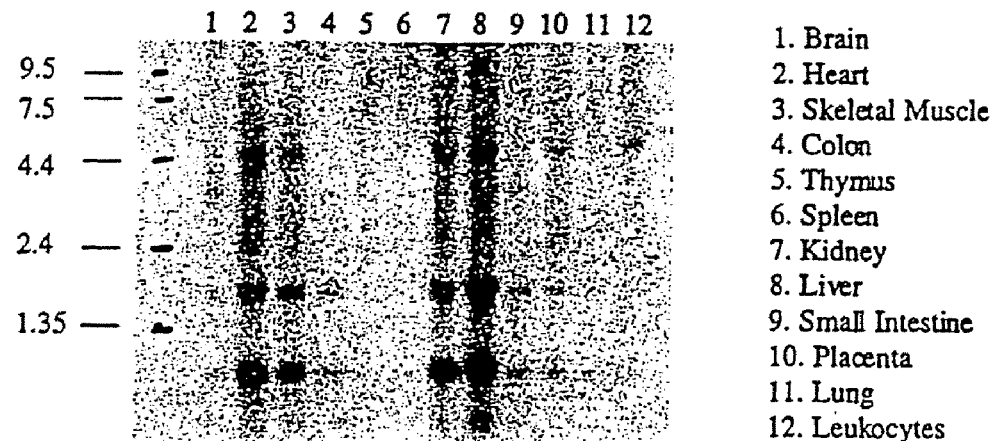
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 581
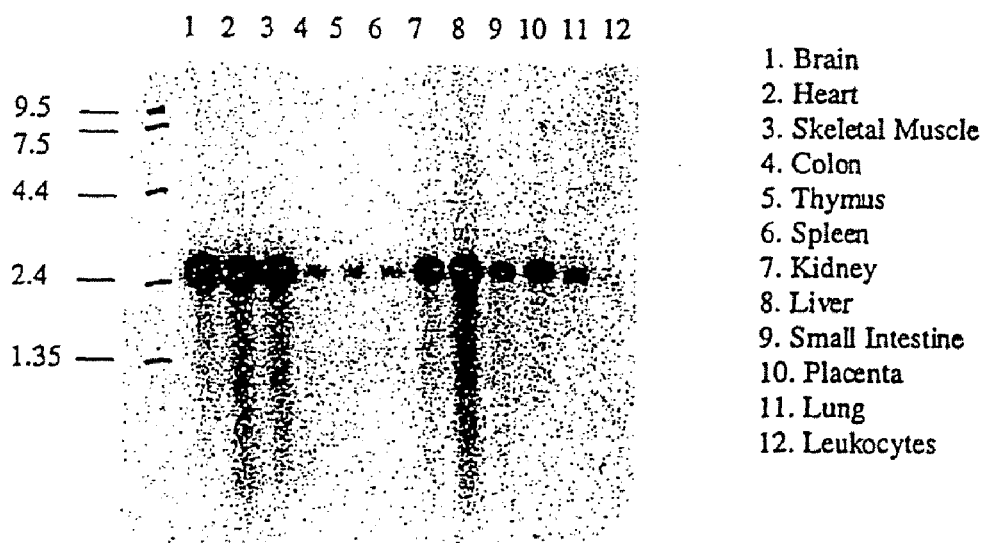
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 H

Gene 583
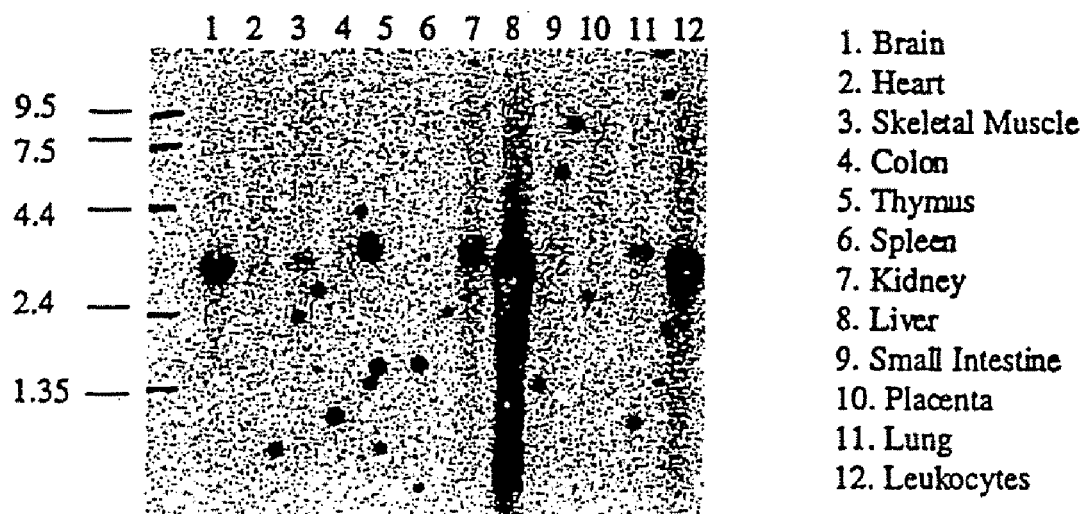
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 589
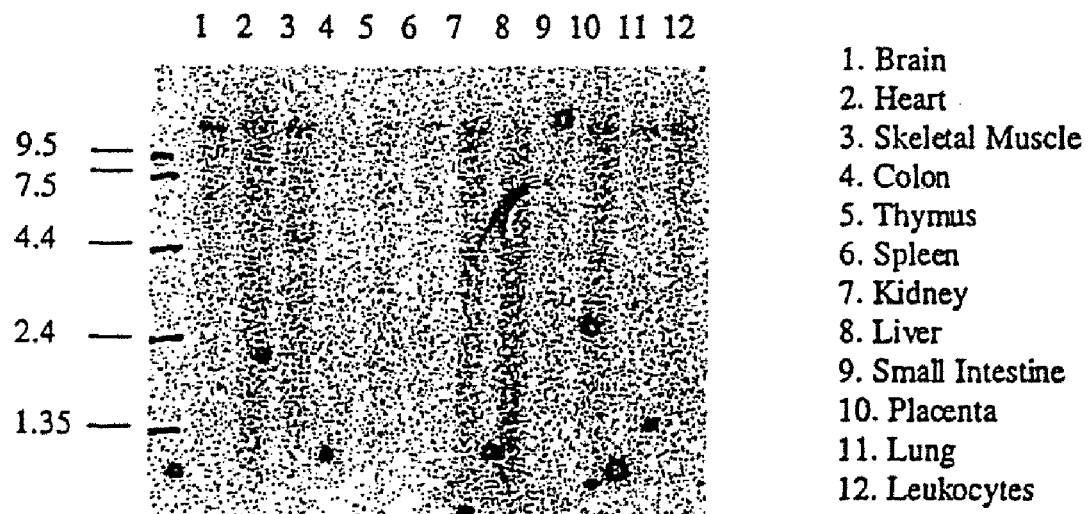
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 I

Gene 590
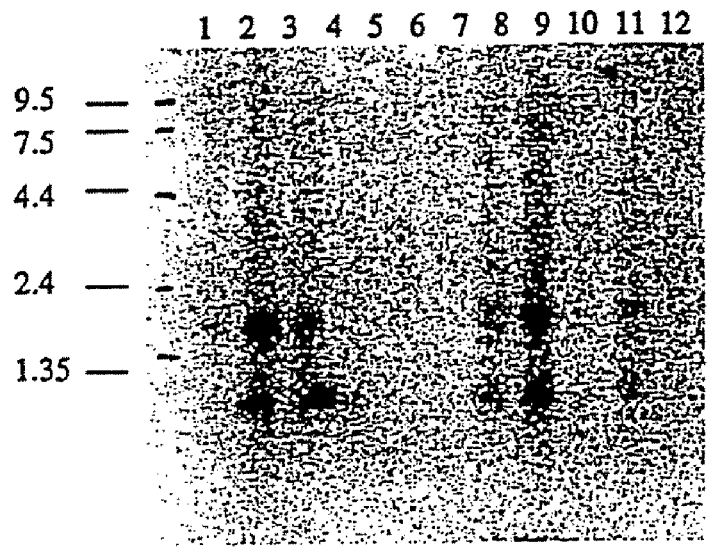
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 592
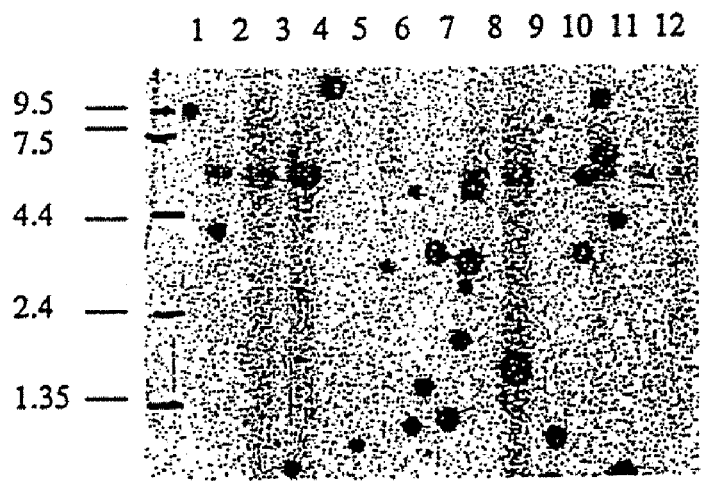
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 J

Gene 594
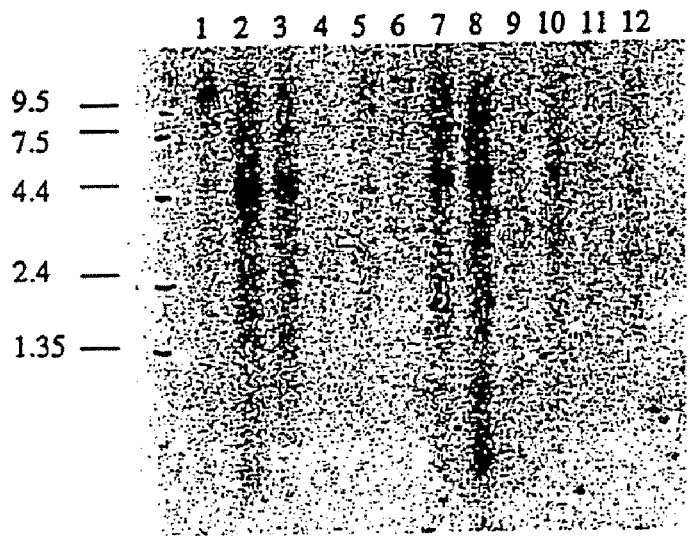
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 595
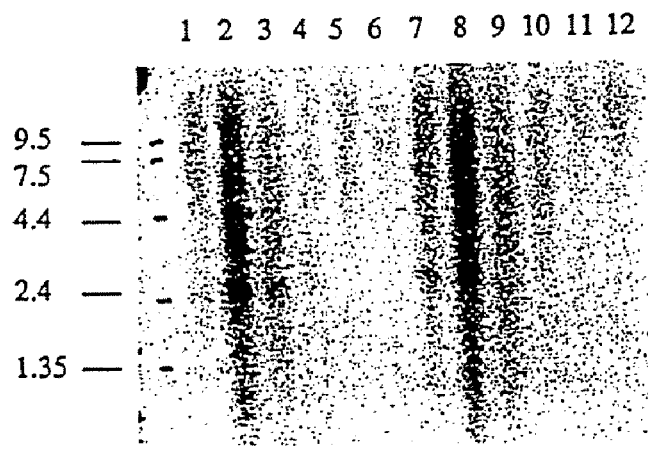
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 K

Gene 596
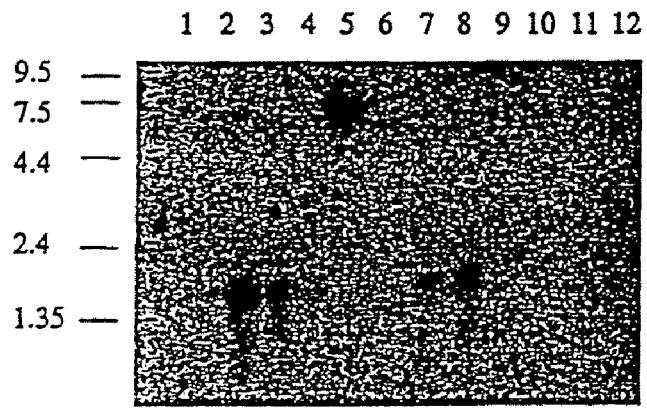
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 604
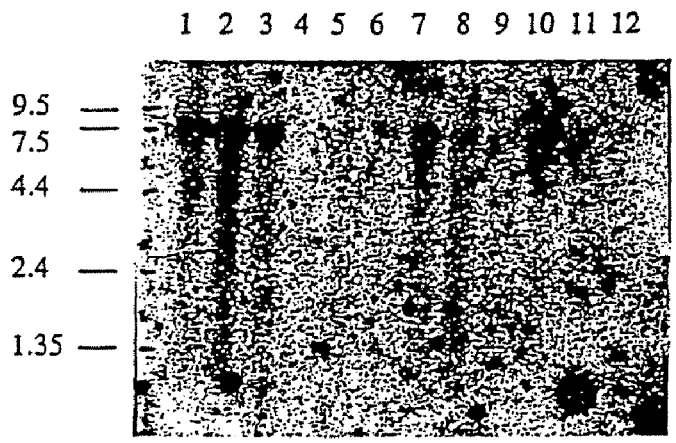
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 L

Gene 605
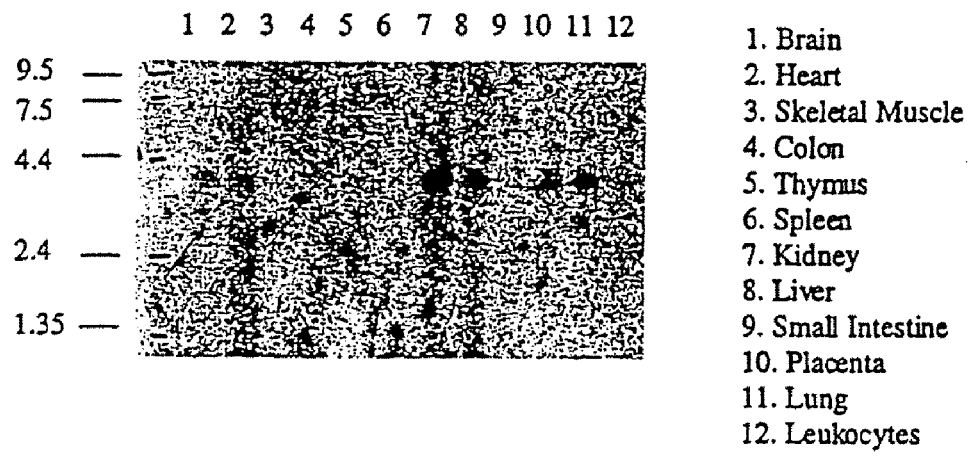
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 606
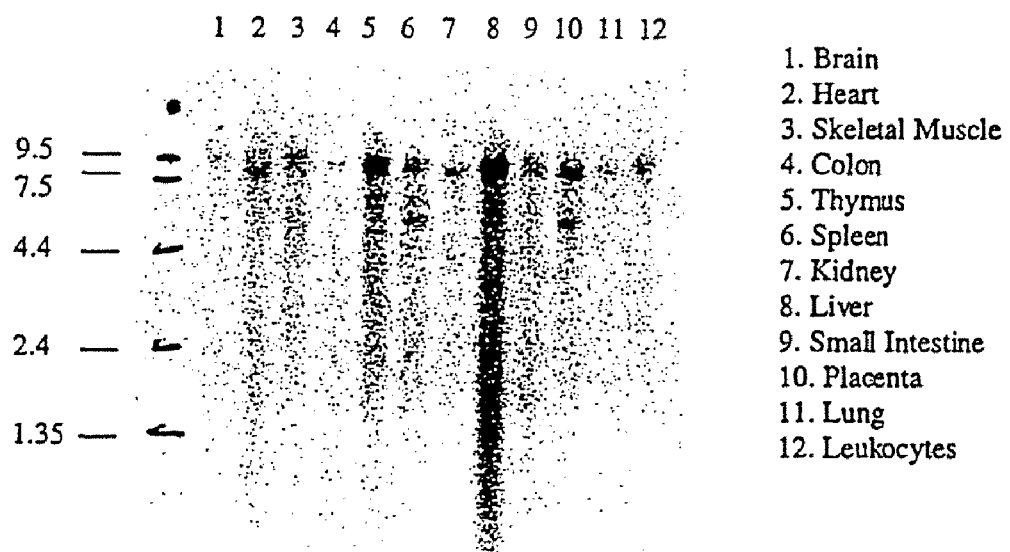
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 M

Gene 608
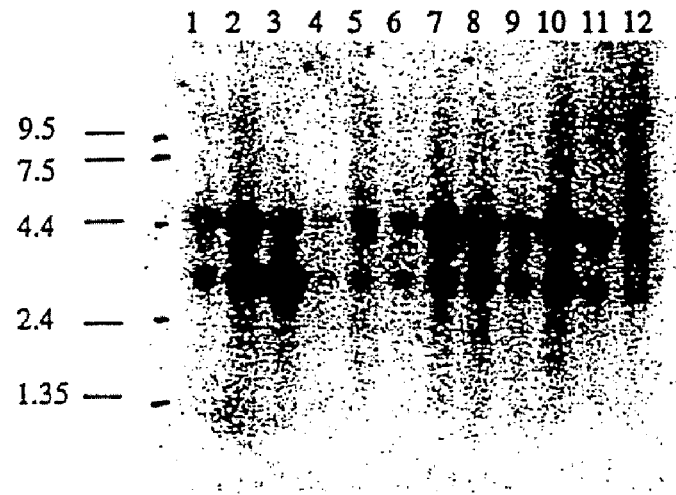
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 611
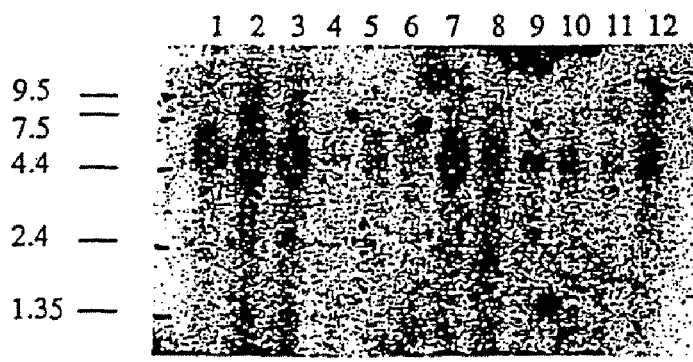
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 N

Gene 615
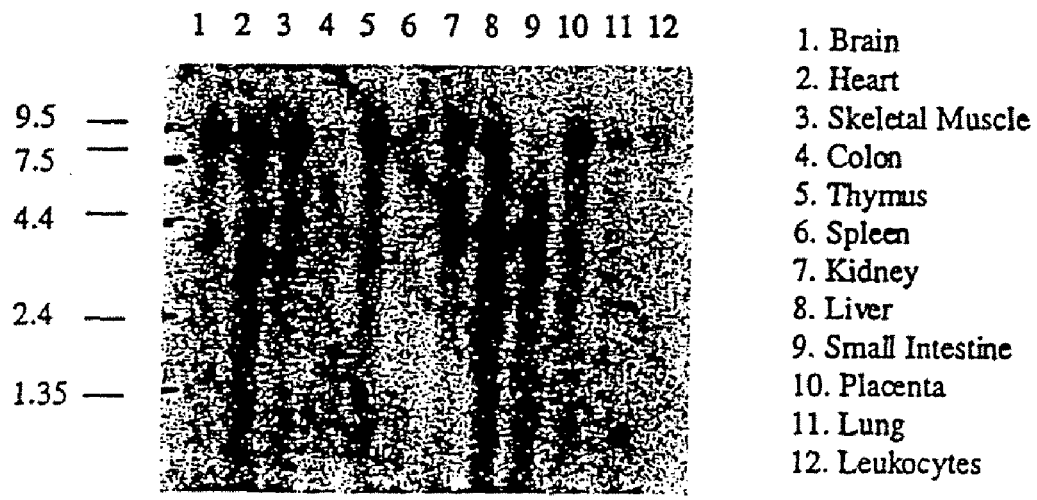
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 617
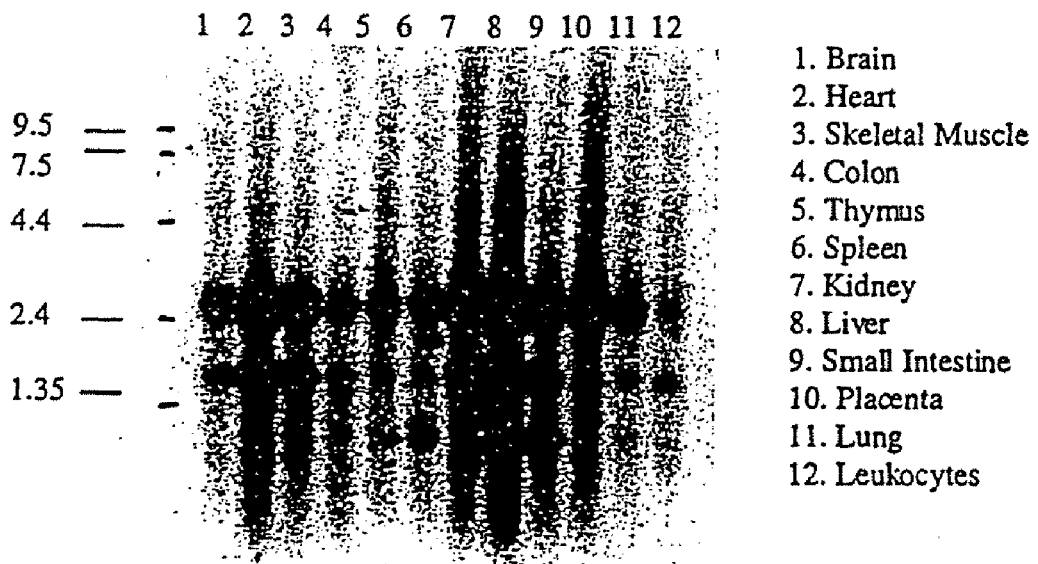
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 O

Gene 618
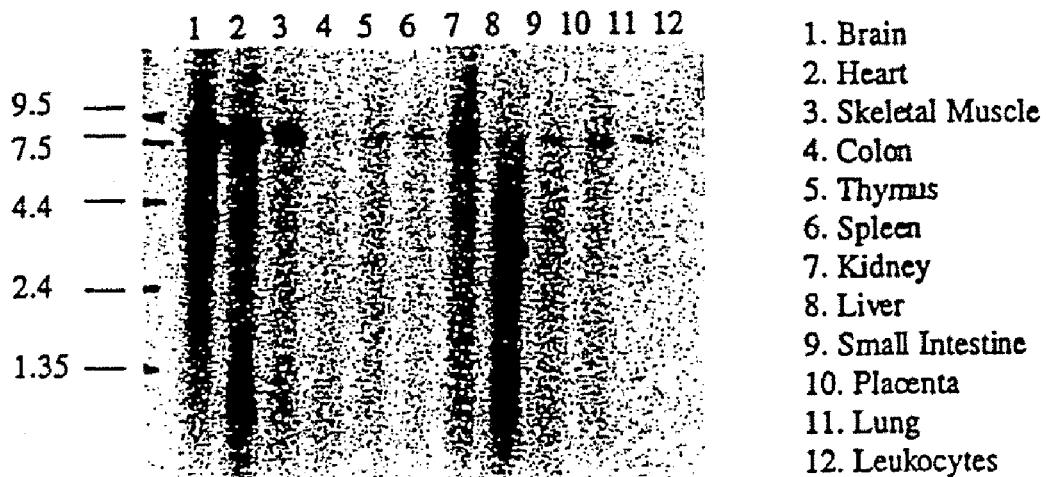
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 619
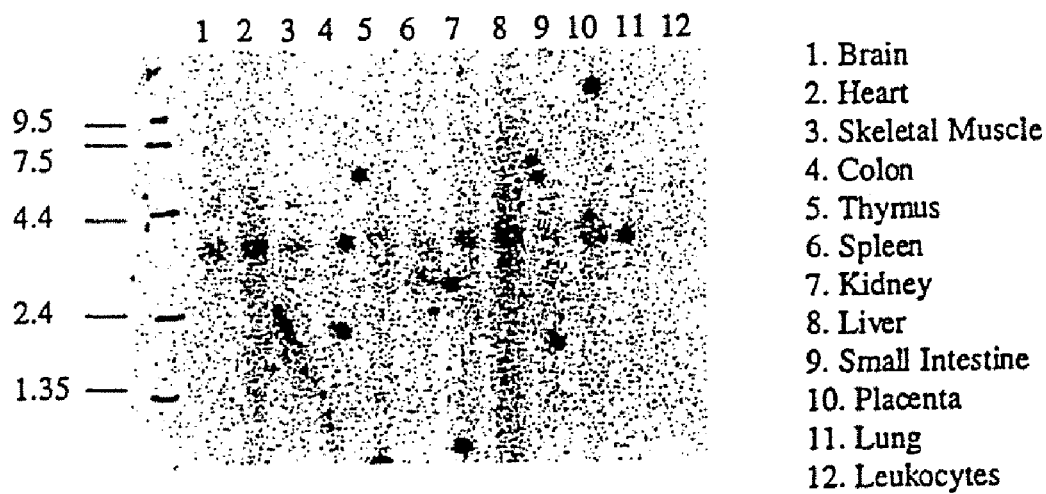
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 P

Gene 621
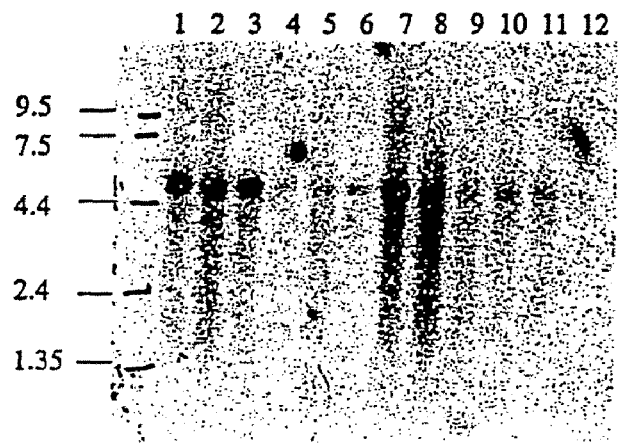
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 693
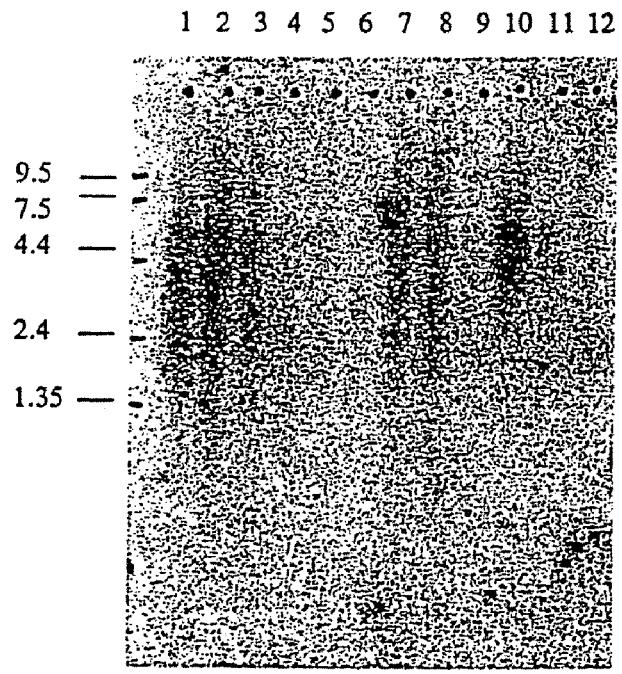
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 Q

Gene 698
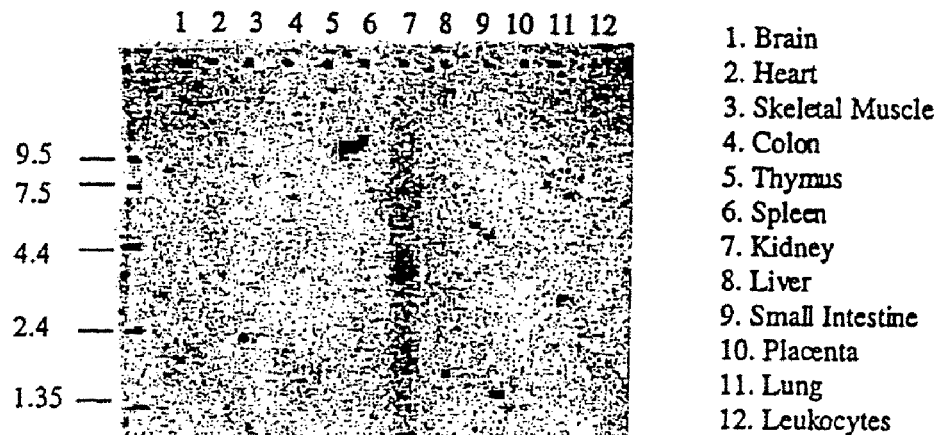
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 699
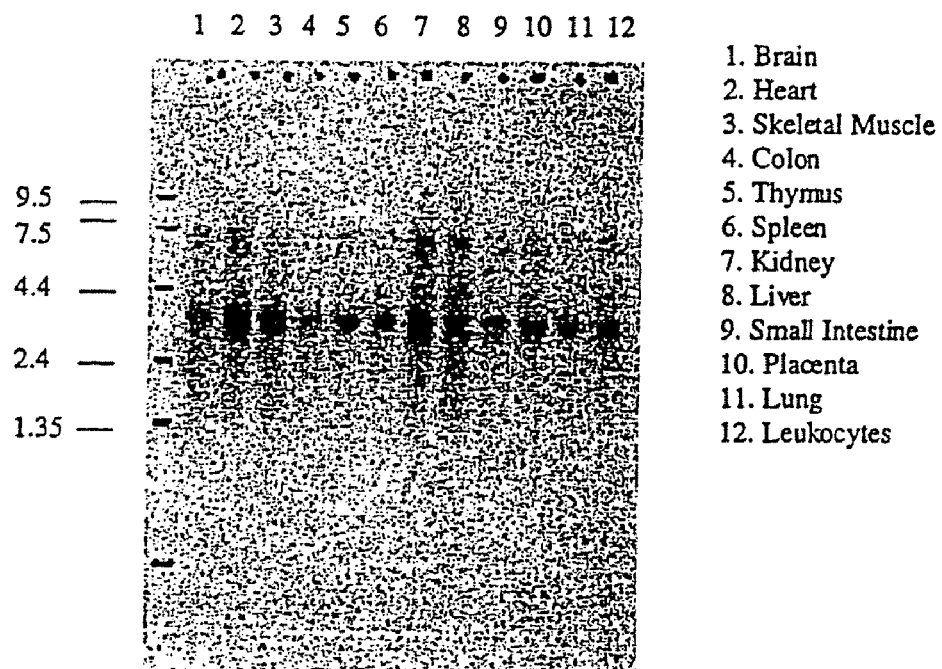
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 R

Gene 702
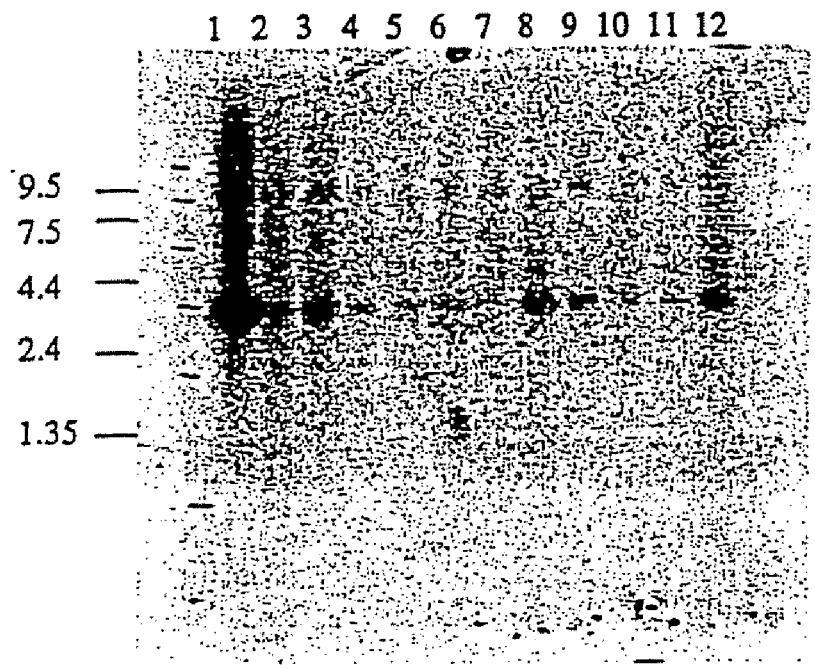
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 722
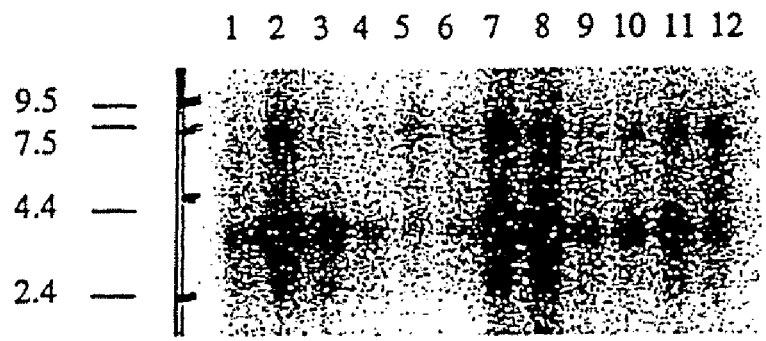
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 S

Gene 751
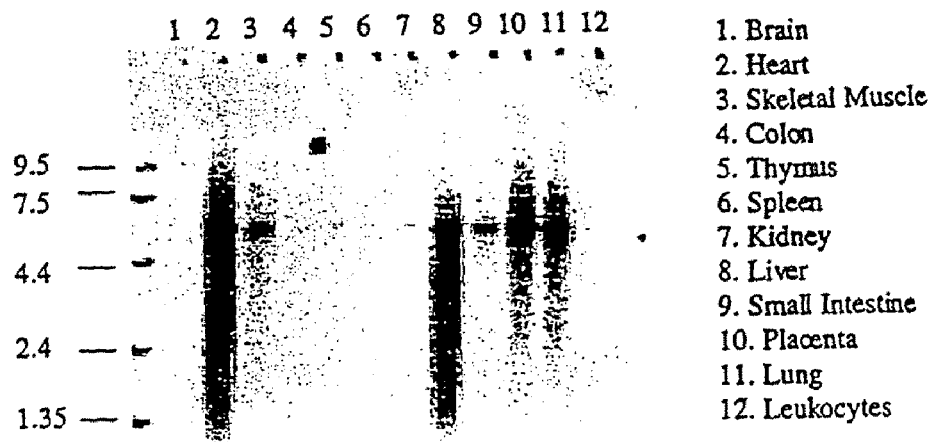
Gene 756
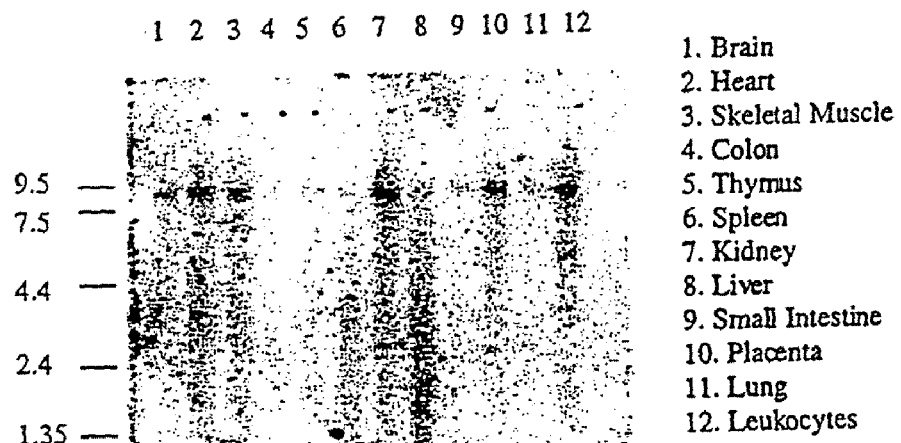
FIG. 6 T

Gene 757
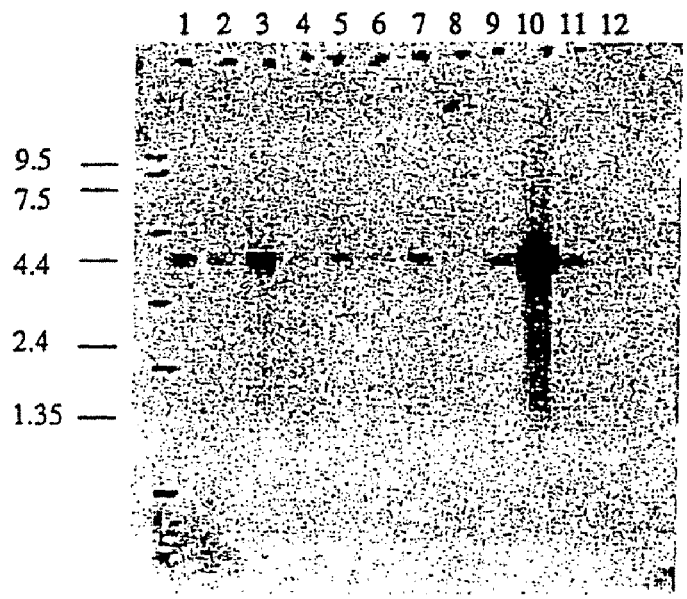
1. Brain
2. Heart
3. Skeletal Muscle
4. Colon
5. Thymus
6. Spleen
7. Kidney
8. Liver
9. Small Intestine
10. Placenta
11. Lung
12. Leukocytes
Gene 848
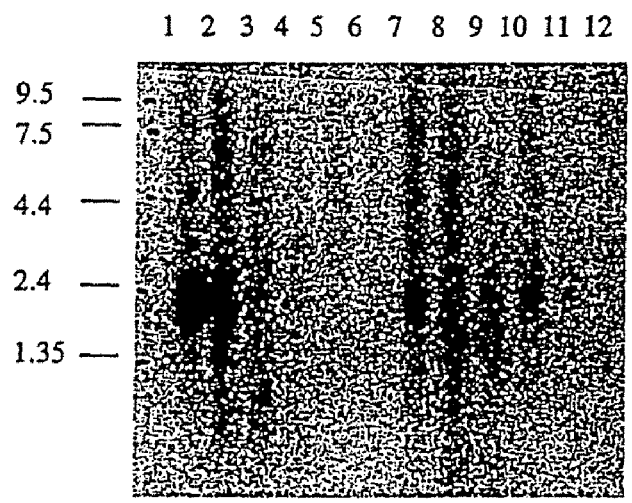
1. Brain
2. Heart
3. Skeletal Muscle
4. Colon
5. Thymus
6. Spleen
7. Kidney
8. Liver
9. Small Intestine
10. Placenta
11. Lung
12. Leukocytes
FIG. 6 U

```
            10                    30                    50
             .                     .                     .
     GCTTGCTGTGGCCCTGTCAGGAAGAGTAGAGCTCTGGTCCAGCTCCGCGCAGGGAGGGAG 70                    90                   110
             .                     .                     .
     GCTGTCACCATGCCGGCCTGCTGCAGCTGCAGTGATGTTTTCCAGTATGAGACGAACAAA
              MetProAlaCysCysSerCysSerAspValPheGlnTyrGluThrAsnLys 130                   150                   170
             .                     .                     .
     GTCACTCGGATCCAGAGCATGAATTATGGCACCATTAAGTGGTTCTTCCACGTGATCATC
     ValThrArgIleGlnSerMetAsnTyrGlyThrIleLysTrpPhePheHisValIleIle 190                   210                   230
             .                     .                     .
     TTTTCCTACGTTTGCTTTGCTCTGGTGAGTGACAAGCTGTACCAGCGGAAAGAGCCTGTC
     PheSerTyrValCysPheAlaLeuValSerAspLysLeuTyrGlnArgLysGluProVal 250                   270                   290
             .                     .                     .
     ATCAGTTCTGTGCACACCAAGGTGAAGGGGATAGCAGAGGTGAAAGAGGAGATCGTGGAG
     IleSerSerValHisThrLysValLysGlyIleAlaGluValLysGluGluIleValGlu 310                   330                   350
             .                     .                     .
     AATGGAGTGAAGAAGTTGGTGCACAGTGTCTTTGACACCGCAGACTACACCTTCCCTTTG
     AsnGlyValLysLysLeuValHisSerValPheAspThrAlaAspTyrThrPheProLeu 370                   390                   410
             .                     .                     .
     CAGGGGAACTCTTTCTTCGTGATGACAAACTTTCTCAAAACAGAAGGCCAAGAGCAGCGG
     GlnGlyAsnSerPhePheValMetThrAsnPheLeuLysThrGluGlyGlnGluGlnArg 430                   450                   470
             .                     .                     .
     TTGTGTCCCGAGTATCCCACCCGCAGGACGCTCTGTTCCTCTGACCGAGGTTGTAAAAAG
     LeuCysProGluTyrProThrArgArgThrLeuCysSerSerAspArgGlyCysLysLys 490                   510                   530
             .                     .                     .
     GGATGGATGGACCCGCAGAGCAAAGGAATTCAGACCGGAAGGTGTGTAGTGCATGAAGGG
     GlyTrpMetAspProGlnSerLysGlyIleGlnThrGlyArgCysValValHisGluGly 550                   570                   590
             .                     .                     .
```

FIG. 7A

```
AACCAGAAGACCTGTGAAGTCTCTGCCTGGTGCCCCATCGAGGCAGTGGAAGAGGCCCCC
AsnGlnLysThrCysGluValSerAlaTrpCysProIleGluAlaValGluGluAlaPro 610                 630                 650
                 .                   .                   .
CGGCCTGCTCTCTTGAACAGTGCCGAAAACTTCACTGTGCTCATCAAGAACAATATCGAC
ArgProAlaLeuLeuAsnSerAlaGluAsnPheThrValLeuIleLysAsnAsnIleAsp 670                 690                 710
                 .                   .                   .
TTCCCCGGCCACAACTACACCACGAGAAACATCCTGCCAGGTTTAAACATCACTTGTACC
PheProGlyHisAsnTyrThrThrArgAsnIleLeuProGlyLeuAsnIleThrCysThr 730                 750                 770
                 .                   .                   .
TTCCACAAGACTCAGAATCCACAGTGTCCCATTTTCCGACTAGGAGACATCTTCCGAGAA
PheHisLysThrGlnAsnProGlnCysProIlePheArgLeuGlyAspIlePheArgGlu 790                 810                 830
                 .                   .                   .
ACAGGCGATAATTTTTCAGATGTGGCAATTCAGGGCGGAATAATGGGCATTGAGATCTAC
ThrGlyAspAsnPheSerAspValAlaIleGlnGlyGlyIleMetGlyIleGluIleTyr 850                 870                 890
                 .                   .                   .
TGGGACTGCAACCTAGACCGTTGGTTCCATCACTGCCGTCCCAAATACAGTTTCCGTCGC
TrpAspCysAsnLeuAspArgTrpPheHisHisCysArgProLysTyrSerPheArgArg 910                 930                 950
                 .                   .                   .
CTTGACGACAAGACCACCAACGTGTCCTTGTACCCTGGCTACAACTTCAGATACGCCAAG
LeuAspAspLysThrThrAsnValSerLeuTyrProGlyTyrAsnPheArgTyrAlaLys 970                 990                1010
                 .                   .                   .
TACTACAAGGAAAACAATGTTGAGAAACGGACTCTGATAAAAGTCTTCGGGATCCGTTTT
TyrTyrLysGluAsnAsnValGluLysArgThrLeuIleLysValPheGlyIleArgPhe 1030                1050                1070
                 .                   .                   .
GACATCCTGGTTTTTGGCACCGGAGGAAAATTTGACATTATCCAGCTGGTTGTGTACATC
AspIleLeuValPheGlyThrGlyGlyLysPheAspIleIleGlnLeuValValTyrIle 1090                1110                1130
                 .                   .                   .
GGCTCAACCCTCTCCTACTTCGGTCTGGCCACTGTGTTCATCGACTTCCTCATCGACACT
GlySerThrLeuSerTyrPheGlyLeuAlaThrValPheIleAspPheLeuIleAspThr
```

FIG. 7 B

```
       1150                 1170                 1190
         .                    .                    .
TACTCCAGTAACTGCTGTCGCTCCCATATTTATCCCTGGTGCAAGTGCTGTCAGCCCTGT
TyrSerSerAsnCysCysArgSerHisIleTyrProTrpCysLysCysCysGlnProCys 1210                 1230                 1250
         .                    .                    .
GTGGTCAACGAATACTACTACAGGAAGAAGTGCGAGTCCATTGTGGAGCCAAAGCCGACA
ValValAsnGluTyrTyrTyrArgLysLysCysGluSerIleValGluProLysProThr 1270                 1290                 1310
         .                    .                    .
TTAAAGTATGTGTCCTTTGTGGATGAATCCCACATTAGGATGGTGAACCAGCAGCTACTA
LeuLysTyrValSerPheValAspGluSerHisIleArgMetValAsnGlnGlnLeuLeu 1330                 1350                 1370
         .                    .                    .
GGGAGAAGTTTGCAAGATGTCAAGGGCCAAGAAGTCCCAAGACCTGCGATGGACTTCACA
GlyArgSerLeuGlnAspValLysGlyGlnGluValProArgProAlaMetAspPheThr 1390                 1410                 1430
         .                    .                    .
GATTTGTCCAGGCTGCCCCTGGCCCTCCATGACACACCCCCGATTCCTGGACAACCAGAG
AspLeuSerArgLeuProLeuAlaLeuHisAspThrProProIleProGlyGlnProGlu 1450                 1470                 1490
         .                    .                    .
GAGATACAGCTGCTTAGAAAGGAGGCGACTCCTAGATCCAGGGATAGCCCCGTCTGGTGC
GluIleGlnLeuLeuArgLysGluAlaThrProArgSerArgAspSerProValTrpCys 1510                 1530                 1550
         .                    .                    .
CAGTGTGGAAGATGCCTCCCATCTCAACTCCCTGAGAGCCACAGGTGCCTGGAGGAGCTG
GlnCysGlyArgCysLeuProSerGlnLeuProGluSerHisArgCysLeuGluGluLeu 1570                 1590                 1610
         .                    .                    .
TGCTGCCGGAAAAAGCCGGGGGCCTGCATCACCACCTCAGAGCTGTTCAGGAAGCTGGTC
CysCysArgLysLysProGlyAlaCysIleThrThrSerGluLeuPheArgLysLeuVal 1630                 1650                 1670
         .                    .                    .
CTGTCCAGACACGTCCTGCAGTTCCTCCTGCTCTACCAGGAGCCCTTGCTGGCGCTGGAT
LeuSerArgHisValLeuGlnPheLeuLeuLeuTyrGlnGluProLeuLeuAlaLeuAsp 1690                 1710                 1730
         .                    .                    .
```

FIG. 7 C

```
GTGGATTCCACCAACAGCCGGCTGCGGCACTGTGCCTACAGGTGCTACGCCACCTGGCGC
ValAspSerThrAsnSerArgLeuArgHisCysAlaTyrArgCysTyrAlaThrTrpArg 1750            1770            1790
          .               .               .
TTCGGCTCCCAGGACATGGCTGACTTTGCCATCCTGCCCAGCTGCTGCCGCTGGAGGATC
PheGlySerGlnAspMetAlaAspPheAlaIleLeuProSerCysCysArgTrpArgIle 1810            1830            1850
          .               .               .
CGGAAAGAGTTTCCAAAGAGTGAAGGGCAGTACAGTGGCTTCAAGAGTCCTTACTGAAGC
ArgLysGluPheProLysSerGluGlyGlnTyrSerGlyPheLysSerProTyrEnd 1870            1890            1910
          .               .               .
CAGGCACCGTGGCTCACGTCTGTAATCCCAGCGCTTTGGGAGGCCGAGGCAGGCAGATCA 1930            1950            1970
          .               .               .
CCTGAGATCGGGAGTTGGAGACCCGCCTGGCTAACAAGGCGAAATCCTGTCTGTACTAAA 1990            2010            2030
          .               .               .
AATACAAAAATCAGCCAGACATGGTGGCATGCACCTGCAATCCCAGCTACTCGGGAGGCT 2050            2070            2090
          .               .               .
GAGGCACAAGAATCACTTGAACCCGGGAGGCAGAGGTTGTAGTGAGCCCAGATTGTGCCA 2110            2130            2150
          .               .               .
CTGCTCTCCAGCCTGGGAGGCACAGCAAACTGTCCCAAAAAAAAAAAAAAGAGTCCTTAC 2170            2190            2210
          .               .               .
CAATAGCAGGGGCTGCAGTAGCCATGTTAACATGACATTTACCAGCAACTTGAACTTCAC 2230            2250            2270
          .               .               .
CTGCAAAGCTCTGTGGCCACATTTTCAGCCAAAGGGAAATATGCTTTCATCTTCTGTTGC 2290            2310            2330
          .               .               .
TCTCTGTGTCTGAGAGCAAAGTGACCTGGTTAAACAAACCAGAATCCCTCTACATGGACT 2350            2370            2390
```

FIG. 7 D

```
           CAGAGAAAAGAGATTGAGATGTAAGTCTCAACTCTGTCCCCAGGAAGTTGTGTGACCCTA 2410                2430                2450
      .                   .                   .
    GGCCTCTCACCTCTGTGCCTCTGTCTCCTTGTTGCCCAACTACTATCTCAGAGATATTGT 2470                2490                2510
      .                   .                   .
    GAGGACAAATTGAGACAGTGCACATGAACTGTCTTTTAATGTGTAAAGATCTACATGAAT 2530                2550                2570
      .                   .                   .
    GCAAAACATTTCATTATGAGGTCAGACTAGGATAATGTCCAACTAAAAACAAACCCTTTT 2590                2610                2630
      .                   .                   .
    CATCCTGGCTGGAGAATGTGGAGAACTAAAGGTGGCCACAAATTCTTTGACACTCAAGTC 2650                2670                2690
      .                   .                   .
    CCCCAAGACCTAAGGGTTTTATCTCCTCCCCTTGAATATGGGTGGCTCTGATTGCTTTAT 2710                2730                2750
      .                   .                   .
    CCAAAAGTGGAAGTGACATTGTGTCAGTTTCAGATCCTGATCTTAAGAGGCTGACAGCTT 2770                2790                2810
      .                   .                   .
    CTACTTGCTGTCCCTTGGAACTCTTGCTATCGGGGAAGCCAGACGCCATTTAAAAGTCTG 2830                2850                2870
      .                   .                   .
    CCTATCCTGGCCAGGTGTGGTGGCTCACACCTGTAATCCCAGCACTTTGGGAGACCAAGG 2890                2910                2930
      .                   .                   .
    CGGGCGGATCACTTAAAGTCAGGAGTCCAAGACCAGACTCGCCAACATGGTGAAACCGTA 2950                2970                2990
      .                   .                   .
    TCTCTAATAAAAATACAAAAATTAGCTGGGCATGGTGCGGGCACCTGTAGTCCTAGCTAT 3010                3030                3050
      .                   .                   .
    CAAGAGGCTGAGACAGGAGAAACACTTGAACCTGGGAGGTGGAGGTTGCATTGAGCTGAG
```

FIG. 7 E

```
              3070                 3090                3110
               .                    .                   .
    ATCGTGCCACTGCACTCCAGGCTGGGTGACAGAGCGAGACTCCATCTCAAAAAAAAAAAA 3130                 3150                3170
               .                    .                   .
    AAAAGAAAAAAAAAATGTCTGCCTATCCTGAGACTGCCCTGCTGTGAGGAAGCCCAAGCA 3190                 3210                3230
               .                    .                   .
    GTCACGTGGACAGTGCCTGACCAGCCCCAGCTTTCAAGCCATCCAAGCCCAGTCACCAAA 3250                 3270                3290
               .                    .                   .
    CATGAGAGAGAAGAAGCCTTCAGGTGATTCTGGACTCCACTAACATATGACTGATACCGC 3310                 3330                3350
               .                    .                   .
    ATGATACATCCCAAGTGAGAACTGCCCCATAAATCCAGAAAACCACATTGCTATCTTAAG 3370                 3390                3410
               .                    .                   .
    TCCCTAAGTTTGGGGCTTATTTGTTCCACAGCAACAGGTAACTGGAACAGAGGGCAAGCC 3430                 3450                3470
               .                    .                   .
    TGATGAATGGGCACACAGACTCAGCCCATACCTTCCCTGGTTCTAATGTTCTCAGGGAGC 3490                 3510                3530
               .                    .                   .
    CCGGACCAACCCTGGGAGCCTCAGGAACTTAGGTTTCCACTGGACAGTTCTAGAAGGGCT 3550                 3570                3590
               .                    .                   .
    ATAGACCAAATCAGGTAACTCACCAGACCAGCCTTGGAATCTATCAAATCTAACTGCTGA 3610                 3630                3650
               .                    .                   .
    GCTACCCAGTGCATTCCGATCCTCATCACAATTCTTTGACTGAAGGCCGGGCGTGGTGGC 3670                 3690                3710
               .                    .                   .
    TCACGCCTGTAATCCCAGCACTTTGGGAGGCTGAGGCGGGTGGATCACCTGAGGTCAGGA
```

FIG. 7 F

```
       3730                3750                3770
         .                   .                   .
GTTCGAGACCAGCCTGGCCAACATGGTGAGACCCTGTCTCTACTAAGAATACAAAAATTA 3790                3810                3830
         .                   .                   .
GGTGGGGTGGCGGTGGGCGCCTGTAATCCCAGCTACTTGGGAGGCTGAGGCAGGAGAATC 3850                3870                3890
         .                   .                   .
TCTTGAACCTGGAAGGTGGAGGTTGCAATAAGCCGAGATAGTGCCACTGCACTCCAGCCT 3910                3930                3950
         .                   .                   .
AGATAACAGAGCAAGACTCTGTCTCAAAAAACAACAACAACAACAACAAAACAATTCTAT 3970                3990                4010
         .                   .                   .
GACTGAAAGTGACTAAAAAGCTGGCTTTATGCCATTAACACTCTGTACTTTGCAGCCAAT 4030                4050                4070
         .                   .                   .
CAGAACTGACGCAGTCTGGGTGCTAGCTGCTTCAAAAGCAACCCACACCACACTTTTACC 4090                4110                4130
         .                   .                   .
ATTTCCATACATCAACTGCTGAGAATATGAAAATGCACAGTGACAGGTTTTAGGATCCTG 4150                4170                4190
         .                   .                   .
CTTCAGGATTTCCTTTTCCTGGTTTGGTCACTAGAGTTGGCTATTTATCTGTTTCTAAAC 4210                4230                4250
         .                   .                   .
AATAGCTATTTTATCGAATAGTTTAGAGACCACTATTAAATATTGTGACTGATGAAGGAT 4270                4290                4310
         .                   .                   .
CTGTGAATTTTTTTATATATGTTCTAAGAGTTACCATTTTGATACCTTTTAAAAACCAGC 4330                4350                4370
         .                   .                   .
AGCTTTCTACTATATTCATGTAAAACAGCATGAATAAAACCATTTTTTGATACAGGGTTT 4390                4410                4430
         .                   .                   .
```

FIG. 7G

```
        TATTTGGCTTTAAACTCAGGAACCAAGTTAATTATGCCAGATTGAACTTTGATTTTTACT 4450              4470              4490
                .                 .                 .
        ACCTTTTCAAAGATATTTTAAAAAGTGGATTACTACATATGATTTCTTTGGAGCTTACAT 4510              4530              4550
                .                 .                 .
        TTCTTTACTTCACGAATTCTATGTCACTGTTACAAGTTTCCATTCTGATGGCTTCTGGGC 4570              4590              4610
                .                 .                 .
        CTTTGTACCTTTGTTTTGGTGCCTTATTCCTAGTATGTTTCTATCACCTTAATGAGGCC 4630              4650              4670
                .                 .                 .
        GCAGATGGAGTCAGAATGTGAAATTACAAATAATCACTGGATCCATCTACTGTTTTCCAT 4690              4710              4730
                .                 .                 .
        CACCTTCCCCACTGATGCTCTGGGCGAGAGAGTGATGTGTCACTTCAACTGTGTGTAATA 4750              4770              4790
                .                 .                 .
        TGTCAGACACGTCCTACAATAACAGGCGTCATATTTGTATTATTTTAGTTTACTGTAGA 4810              4830              4850
                .                 .                 .
        AAATAATGTCACCGCCAAAGGTGATGAGAGTCACGTTTTGTAGGATCTGTTTTCTTATAC 4870              4890              4910
                .                 .                 .
        TTAAAGACAGACTTCTGCTACGGTAATTGCCAGTATTCATGGCTTCCTTTCTGTGTCAGA 4930              4950              4970
                .                 .                 .
        AGAGAAGGGATCTGCTTTCTCTTGGCTGATTTCACATAGCATTGGTAATAGACATGCATT 4990              5010              5030
                .                 .                 .
        TCTCTTTCTAAAGGGGAGTAACTTTTTAAACCCTTCCTGATTTTAGCCTGGCAATGTAAG 5050              5070
                .                 .
        TGTCCTTAATGTGACTGTTTTGATAATTAAAAAAAGGTATATAATTT
```

FIG. 7 H

RT/PCR of Gene561.nt1 and Gene561.nt2

```
            10                  30                  50
             .                   .                   .
TCGAAACAGCTGCCGGCTGGTCCCGGCCGAGGCCGGCGCAGGGAGGGAGGAGCCGCCCGG 70                  90                 110
             .                   .                   .
GCTGTGGGGGCGCCGCGAGCTGGGCCGGCCTCGGTGTGCCCGCGCCGCCAGCCCGCTCCA 130                 150                 170
             .                   .                   .
GACGCGCCACCTGGGCGCTCCAAGAAGAGGCCGAAGTTTGCCGCGGCCGTGAGTTGGAGC 190                 210                 230
             .                   .                   .
TCGCGCCGGGCCGCTGCGCCGGGAGCTCCGGGGGCTTCCCTCGCTTCCCGGTATTGTTTG 250                 270                 290
             .                   .                   .
CAAACTTTGCTGCTCTCCGCCGCGGCCCCCAACTCGGCGGACGCCGGGCGCGGAGAGCCG 310                 330                 350
             .                   .                   .
AGCCGGGGGCGCTGTGCGCAGCGCTCGGGCCAGGCCGGGCGGGCATGGGCGGGGGCCCGA 370                 390                 410
             .                   .                   .
GCAGGGGTGGAGAGCCGGGGCCAGCAGCAGCCCGTGCCCGGGAGCGGCGGCGCTGAGGGG 430                 450                 470
             .                   .                   .
CGCGGAGCTCCCCGCGAGGACACGTCCAACGCCAGCATGCAGCGCCCGGGCCCCCGCCTG
                                          MetGlnArgProGlyProArgLeu 490                 510                 530
             .                   .                   .
TGGCTGGTCCTGCAGGTGATGGGCTCGTGCGCCGCCATCAGCTCCATGGACATGGAGCGC
TrpLeuValLeuGlnValMetGlySerCysAlaAlaIleSerSerMetAspMetGluArg 550                 570                 590
             .                   .                   .
CCGGGCGACGGCAAATGCCAGCCCATCGAGATCCCGATGTGCAAGGACATCGGCTACAAC
ProGlyAspGlyLysCysGlnProIleGluIleProMetCysLysAspIleGlyTyrAsn 610                 630                 650
             .                   .                   .
```

FIG. 9 A

```
ATGACTCGTATGCCCAACCTGATGGGCCACGAGAACCAGCGCGAGGCAGCCATCCAGTTG
MetThrArgMetProAsnLeuMetGlyHisGluAsnGlnArgGluAlaAlaIleGlnLeu
```

670                690                710

```
CACGAGTTCGCGCCGCTGGTGGAGTACGGCTGCCACGGCCACCTCCGCTTCTTCCTGTGC
HisGluPheAlaProLeuValGluTyrGlyCysHisGlyHisLeuArgPhePheLeuCys
```

730                750                770

```
TCGCTGTACGCGCCGATGTGCACCGAGCAGGTCTCTACCCCCATCCCCGCCTGCCGGGTC
SerLeuTyrAlaProMetCysThrGluGlnValSerThrProIleProAlaCysArgVal
```

790                810                830

```
ATGTGCGAGCAGGCCCGGCTCAAGTGCTCCCCGATTATGGAGCAGTTCAACTTCAAGTGG
MetCysGluGlnAlaArgLeuLysCysSerProIleMetGluGlnPheAsnPheLysTrp
```

850                870                890

```
CCCGACTCCCTGGACTGCCGGAAACTCCCCAACAAGAACGACCCCAACTACCTGTGCATG
ProAspSerLeuAspCysArgLysLeuProAsnLysAsnAspProAsnTyrLeuCysMet
```

910                930                950

```
GAGGCGCCCAACAACGGCTCGGACGAGCCCACCCGGGGCTCGGGCCTGTTCCCGCCGCTG
GluAlaProAsnAsnGlySerAspGluProThrArgGlySerGlyLeuPheProProLeu
```

970                990                1010

```
TTCCGGCCGCAGCGGCCCCACAGCGCGCAGGAGCACCCGCTGAAGGACGGGGGCCCCGGG
PheArgProGlnArgProHisSerAlaGlnGluHisProLeuLysAspGlyGlyProGly
```

1030               1050               1070

```
CGCGGCGGCTGCGACAACCCGGGCAAGTTCCACCACGTGGAGAAGAGCGCGTCGTGCGCG
ArgGlyGlyCysAspAsnProGlyLysPheHisHisValGluLysSerAlaSerCysAla
```

1090               1110               1130

```
CCGCTCTGCACGCCCGGCGTGGACGTGTACTGGAGCCGCGAGGACAAGCGCTTCGCAGTG
ProLeuCysThrProGlyValAspValTyrTrpSerArgGluAspLysArgPheAlaVal
```

```
GTCTGGCTGGCCATCTGGGCGGTGCTGTGCTTCTTCTCCAGCGCCTTCACCGTGCTCACC
ValTrpLeuAlaIleTrpAlaValLeuCysPhePheSerSerAlaPheThrValLeuThr 1210                1230                1250

TTCCTCATCGACCCGGCCCGCTTCCGCTACCCCGAGCGCCCCATCATCTTCCTCTCCATG
PheLeuIleAspProAlaArgPheArgTyrProGluArgProIleIlePheLeuSerMet 1270                1290                1310

TGCTACTGCGTCTACTCCGTGGGCTACCTCATCCGCCTCTTCGCCGGCGCCGAGAGCATC
CysTyrCysValTyrSerValGlyTyrLeuIleArgLeuPheAlaGlyAlaGluSerIle 1330                1350                1370

GCCTGCGACCGGGACAGCGGCCAGCTCTATGTCATCCAGGAGGGACTGGAGAGCACCGGC
AlaCysAspArgAspSerGlyGlnLeuTyrValIleGlnGluGlyLeuGluSerThrGly 1390                1410                1430

TGCACGCTGGTCTTCCTGGTCCTCTACTACTTCGGCATGGCCAGCTCGCTGTGGTGGGTG
CysThrLeuValPheLeuValLeuTyrTyrPheGlyMetAlaSerSerLeuTrpTrpVal 1450                1470                1490

GTCCTCACGCTCACCTGGTTCCTGGCCGCCGGCAAGAAGTGGGGCCACGAGGCCATCGAA
ValLeuThrLeuThrTrpPheLeuAlaAlaGlyLysLysTrpGlyHisGluAlaIleGlu 1510                1530                1550

GCCAACAGCAGCTACTTCCACCTGGCAGCCTGGGCCATCCCGGCGGTGAAGACCATCCTG
AlaAsnSerSerTyrPheHisLeuAlaAlaTrpAlaIleProAlaValLysThrIleLeu 1570                1590                1610

ATCCTGGTCATGCGCAGGGTGGCGGGGGACGAGCTCACCGGGGTCTGCTACGTGGGCAGC
IleLeuValMetArgArgValAlaGlyAspGluLeuThrGlyValCysTyrValGlySer 1630                1650                1670

ATGGACGTCAACGCGCTCACCGGCTTCGTGCTCATTCCCCTGGCCTGCTACCTGGTCATC
MetAspValAsnAlaLeuThrGlyPheValLeuIleProLeuAlaCysTyrLeuValIle 1690                1710                1730
```

FIG. 9 C

```
GGCACGTCCTTCATCCTCTCGGGCTTCGTGGCCCTGTTCCACATCCGGAGGGTGATGAAG
GlyThrSerPheIleLeuSerGlyPheValAlaLeuPheHisIleArgArgValMetLys 1750               1770              1790
           .                  .                 .
ACGGGCGGCGAGAACACGGACAAGCTGGAGAAGCTCATGGTGCGTATCGGGCTCTTCTCT
ThrGlyGlyGluAsnThrAspLysLeuGluLysLeuMetValArgIleGlyLeuPheSer 1810               1830              1850
           .                  .                 .
GTGCTGTACACCGTGCCGGCCACCTGTGTGATCGCCTGCTACTTTTACGAACGCCTCAAC
ValLeuTyrThrValProAlaThrCysValIleAlaCysTyrPheTyrGluArgLeuAsn 1870               1890              1910
           .                  .                 .
ATGGATTACTGGAAGATCCTGGCGGCGCAGCACAAGTGCAAAATGAACAACCAGACTAAA
MetAspTyrTrpLysIleLeuAlaAlaGlnHisLysCysLysMetAsnAsnGlnThrLys 1930               1950              1970
           .                  .                 .
ACGCTGGACTGCCTGATGGCCGCCTCCATCCCCGCCGTGGAGATCTTCATGGTGAAGATC
ThrLeuAspCysLeuMetAlaAlaSerIleProAlaValGluIlePheMetValLysIle 1990               2010              2030
           .                  .                 .
TTTATGCTGCTGGTGGTGGGGATCACCAGCGGGATGTGGATTTGGACCTCCAAGACTCTG
PheMetLeuLeuValValGlyIleThrSerGlyMetTrpIleTrpThrSerLysThrLeu 2050               2070              2090
           .                  .                 .
CAGTCCTGGCAGCAGGTGTGCAGCCGTAGGTTAAAGAAGAAGAGCCGGAGAAAACCGGCC
GlnSerTrpGlnGlnValCysSerArgArgLeuLysLysLysSerArgArgLysProAla 2110               2130              2150
           .                  .                 .
AGCGTGATCACCAGCGGTGGGATTTACAAAAAAGCCCAGCATCCCCAGAAAACTCACCAC
SerValIleThrSerGlyGlyIleTyrLysLysAlaGlnHisProGlnLysThrHisHis 2170               2190              2210
           .                  .                 .
GGGAAATATGAGATCCCTGCCCAGTCGCCCACCTGCGTGTGAACAGGGCTGGAGGGAAGG
GlyLysTyrGluIleProAlaGlnSerProThrCysValEnd 2230               2250              2270
```

```
                 .                  .                  .
     GCACAGGGGCGCCCGGAGCTAAGATGTGGTGCTTTTCTTGGTTGTGTTTTTCTTTCTTCT 2290               2310               2330
                 .                  .                  .
     TCTTCTTTTTTTTTTTTTATAAAAGCAAAAGAGAAATACATAAAAAAGTGTTTACCCTG 2350               2370               2390
                 .                  .                  .
     AAATTCAGGATGCTGTGATACACTGAAAGGAAAAATGTACTTAAAGGGTTTTGTTTTGTT 2410               2430               2450
                 .                  .                  .
     TTGGTTTTCCAGCGAAGGGAAGCTCCTCCAGTGAAGTAGCCTCTTGTGTAACTAATTTGT 2470               2490               2510
                 .                  .                  .
     GGTAAAGTAGTTGATTCAGCCCTCAGAAGAAAACTTTTGTTTAGAGCCCTCCSTAAATAT 2530               2550               2570
                 .                  .                  .
     ACATCTGTGTATTTGAGTTGGCTTTGCTACCCATTTACAAATAAGAGGACAGATAACTGC 2590               2610               2630
                 .                  .                  .
     TTTGCAAATTCAAGAGCCTCCCCTGGGTTAACAAATGAGCCATCCCCAGGGCCCACCCCC 2650               2670               2690
                 .                  .                  .
     AGGAAGGCCACAGTGCTGGGCGGCATCCCTGCAGAGGAAAGACAGGACCCGGGGCCCGCC 2710               2730               2750
                 .                  .                  .
     TCACACCCCAGTGGATTTGGAGTTGCTTAAAATAGACTCCGGCCTTCACCAATAGTCTCT 2770               2790               2810
                 .                  .                  .
     CTGCAAGACAGAAACCTCCATCAAACCTCACATTTGTGAACTCAAACGATGTGCAATACA 2830               2850               2870
                 .                  .                  .
     TTTTTTTCTCTTTCCTTGAAAATAAAAAGAGAAACAAGTATTTTGCTATATATAAAGACA 2890               2910               2930
```

FIG. 9 E

```
          ACAAAAGAAATCTCCTAACAAAAGAACTAAGAGGCCCAGCCCTCAGAAACCCTTCAGTGC 2950                2970                2990
          TACATTTTGTGGCTTTTTAATGGAAACCAAGCCAATGTTATAGACGTTTGGACTGATTTG 3010                3030                3050
          TGGAAAGGAGGGGGGAAGAGGGAGAAGGATCATTCAAAAGTTACCCAAAGGGCTTATTGA 3070                3090                3110
          CTCTTTCTATTGTTAAACAAATGATTTCCACAAACAGATCAGGAAGCACTAGGTTGGCAG 3130                3150                3170
          AGACACTTTGTCTAGTGTATTCTCTTCACAGTGCCAGGAAAGAGTGGTTTCTGCGTGTGT 3190                3210                3230
          ATATTTGTAATATATGATATTTTTCATGCTCCACTATTTTATTAAAAATAAAATATGTTC

3250
          TTTAGTTTGCTGCT
```

FIG. 9 F

Location of SNPs/Amino Acid Changes/Domain within the Transcript of Gene 454

```
                10                       30                       50
                 .                        .                        .
        CTTGGAAATGACCCGCCACACCTGAAGCCTGCAGGTGCTGAGGCCACATTCGATCAGACC 70                       90                      110
                 .                        .                        .
        CAAGCTTTGGGAGACCGCTGGGGAAATTTCCCACTTCCTCTCCTGAGACCAGGAACTCAG 130                      150                      170
                 .                        .                        .
        CAGAGAAACTTTGTGGAAAATGAACTGAAGGATGCCACCCAGGGAGAGTATCTCCTGAGA 190                      210                      230
                 .                        .                        .
        TCCCATCATGCAGGCCTTCCCACAAGGGCCCGGCAGCATGACAAGGTGAAGGCAGAGTAT 250                      270                      290
                 .                        .                        .
        GTGCATCTCAACCAYCCGCTCACCCTCGTGACCAGAGAGCGCGATTTGGCCGTGAAGGAG 310                      330                      350
                 .                        .                        .
        AAACACCAGCTCCAAGCCAAGCTGGAGAACCTAGAACAGGTCCTGAAGCATATGCGAGAG
                                                              MetArgGlu 370                      390                      410
                 .                        .                        .
        GCGGCTGAACGGCGGCAGCAGCTGCAGTTGGAGCATGACCAGGCCCTGGCTGTTCTCAGT
        AlaAlaGluArgArgGlnGlnLeuGlnLeuGluHisAspGlnAlaLeuAlaValLeuSer 430                      450                      470
                 .                        .                        .
        GCCAAGCAGCAGGAAATTGACCTTCTGCAGAAGTCCAAGGTTCGAGAGCTGGAAGAGAAA
        AlaLysGlnGlnGluIleAspLeuLeuGlnLysSerLysValArgGluLeuGluGluLys 490                      510                      530
                 .                        .                        .
        TGCCGGACTCAAAGTGAGCAGTTCAACCTGCTGTCCCGGGACCTGGAGAAGTTCCGGCAG
        CysArgThrGlnSerGluGlnPheAsnLeuLeuSerArgAspLeuGluLysPheArgGln 550                      570                      590
                 .                        .                        .
        CACGCTGGCAAGATTGACCTGCTGGGTGGCAGCGCGGTGGCCCCCCTGGACATCTCCACG
        HisAlaGlyLysIleAspLeuLeuGlyGlySerAlaValAlaProLeuAspIleSerThr
```

FIG. 27 A

```
           610                630                650
            .                  .                  .
GCCCCCAGCAAGCCTTTCCCACAGTTCATGAATGGCCTAGCCACCTCCCTCGGCAAAGGT
AlaProSerLysProPheProGlnPheMetAsnGlyLeuAlaThrSerLeuGlyLysGly 670                690                710
            .                  .                  .
CAGGAGAGCGCTATTGGAGGCAGCTCTGCGATCGGTGAATATATCCGGCCCCTTCCGCAG
GlnGluSerAlaIleGlyGlySerSerAlaIleGlyGluTyrIleArgProLeuProGln 730                750                770
            .                  .                  .
CCTGGTGACAGGCCGGAGCCTCTGTCCGCCAAGCCCACCTTCCTGTCGAGATCCGGTAGC
ProGlyAspArgProGluProLeuSerAlaLysProThrPheLeuSerArgSerGlySer 790                810                830
            .                  .                  .
GCAAGATGCAGATCTGAGTCAGACATGGAGAATGAACGGAATTCCAATACCTCCAAGCAG
AlaArgCysArgSerGluSerAspMetGluAsnGluArgAsnSerAsnThrSerLysGln 850                870                890
            .                  .                  .
AGATACTCGGGGAAGGTCCACCTCTGTGTTGCCCGCTATAGTTACAACCCCTTCGATGGA
ArgTyrSerGlyLysValHisLeuCysValAlaArgTyrSerTyrAsnProPheAspGly 910                930                950
            .                  .                  .
CCGAACGAGAACCCCGAAGCTGAGCTGCCCCTCACGGCGGGAAAATACCTCTACGTCTAT
ProAsnGluAsnProGluAlaGluLeuProLeuThrAlaGlyLysTyrLeuTyrValTyr 970                990                1010
            .                  .                  .
GGAGACATGGATGAGGATGGGTTCTATGAAGGAGAGCTCCTCGATGGCCAGAGGGGTCTG
GlyAspMetAspGluAspGlyPheTyrGluGlyGluLeuLeuAspGlyGlnArgGlyLeu 1030               1050               1070
            .                  .                  .
GTGCCCTCCAACTTCGTGGACTTTGTGCAGGACAACGAGTCGCGGTTGGCAAGCACGCTG
ValProSerAsnPheValAspPheValGlnAspAsnGluSerArgLeuAlaSerThrLeu 1090               1110               1130
            .                  .                  .
GGGAACGAGCAGGATCAGAACTTCATCAACCATTCCGGCATCGGCCTGGAGGGAGAGCAC
GlyAsnGluGlnAspGlnAsnPheIleAsnHisSerGlyIleGlyLeuGluGlyGluHis 1150               1170               1190
            .                  .                  .
ATCCTGGACCTCCACTCCCCAACCCACATAGATGCGGGCATCACCGACAACAGTGCCGGG
```

FIG. 27 B

IleLeuAspLeuHisSerProThrHisIleAspAlaGlyIleThrAspAsnSerAlaGly

```
         1210                1230                1250
          .                   .                   .
ACCCTGGACGTGAACATCGACGACATCGGAGAAGACATCGTGCCTTACCCTAGAAAAATC
ThrLeuAspValAsnIleAspAspIleGlyGluAspIleValProTyrProArgLysIle 1270                1290                1310
          .                   .                   .
ACCCTCATCAAACAACTCGCCAAAAGTGTTATTGTGGGCTGGGAGCCCCCGGCGGTGCCA
ThrLeuIleLysGlnLeuAlaLysSerValIleValGlyTrpGluProProAlaValPro 1330                1350                1370
          .                   .                   .
CCAGGATGGGGAACGGTGAGCAGCTACAACGTCCTGGTGGACAAGGAGACACGCATGAAC
ProGlyTrpGlyThrValSerSerTyrAsnValLeuValAspLysGluThrArgMetAsn 1390                1410                1430
          .                   .                   .
CTCACGCTGGGGAGCAGAACTAAAGCCCTCATCGAGAAGCTCAACATGGCAGCCTGCACC
LeuThrLeuGlySerArgThrLysAlaLeuIleGluLysLeuAsnMetAlaAlaCysThr 1450                1470                1490
          .                   .                   .
TACCGCATCTCCGTGCAGTGCGTCACCAGCAGGGGCAGCTCGGATGAGCTGCAGTGCACG
TyrArgIleSerValGlnCysValThrSerArgGlySerSerAspGluLeuGlnCysThr 1510                1530                1550
          .                   .                   .
CTGCTGGTGGGCAAGGACGTGGTGGTGGCCCCCTCCCACCTGCGGGTGGACAACATCACG
LeuLeuValGlyLysAspValValValAlaProSerHisLeuArgValAspAsnIleThr 1570                1590                1610
          .                   .                   .
CAGATCTCCGCCCAGCTCTCCTGGCTACCCACCAACAGCAACTACAGCCACGTCATCTTC
GlnIleSerAlaGlnLeuSerTrpLeuProThrAsnSerAsnTyrSerHisValIlePhe 1630                1650                1670
          .                   .                   .
CTCAACGAGGAGGAGTTCGACATCGTCAAGGCCGCCAGGTACAAGTACCAGTTCTTCAAT
LeuAsnGluGluGluPheAspIleValLysAlaAlaArgTyrLysTyrGlnPhePheAsn 1690                1710                1730
          .                   .                   .
CTCAGGCCCAACATGGCCTATAAGGTGAAGGTTCTGGCCAAACCCCACCAGATGCCGTGG
LeuArgProAsnMetAlaTyrLysValLysValLeuAlaLysProHisGlnMetProTrp
```

FIG. 27 C

```
                1750                      1770                      1790
                 .                         .                         .
     CAGCTCCCGCTGGAGCAAAGGGAGAAGAAGGAGGCCTTTGTGGAGTTCTCCACGTTGCCT
     GlnLeuProLeuGluGlnArgGluLysLysGluAlaPheValGluPheSerThrLeuPro 1810                      1830                      1850
                 .                         .                         .
     GCAGGACCCCCAGCACCCCCACAAGATGTTACCGTCCAGGCTGGGGTGACCCCCGCCACC
     AlaGlyProProAlaProProGlnAspValThrValGlnAlaGlyValThrProAlaThr 1870                      1890                      1910
                 .                         .                         .
     ATCCGGGTCTCCTGGAGACCACCTGTGCTGACGCCCACCGGGCTGTCCAATGGCGCAAAC
     IleArgValSerTrpArgProProValLeuThrProThrGlyLeuSerAsnGlyAlaAsn 1930                      1950                      1970
                 .                         .                         .
     GTTACCGGCTACGGCGTGTATGCCAAAGGGCAGAGGGTGGCTGAAGTCATCTTCCCCACG
     ValThrGlyTyrGlyValTyrAlaLysGlyGlnArgValAlaGluValIlePheProThr 1990                      2010                      2030
                 .                         .                         .
     GCAGACAGCACGGCCGTGGAGCTTGTGCGGCTGCGGAGCCTGGAGGCCAAGGGCGTGACC
     AlaAspSerThrAlaValGluLeuValArgLeuArgSerLeuGluAlaLysGlyValThr 2050                      2070                      2090
                 .                         .                         .
     GTGCGGACCCTCTCCGCCCAGGGCGAGTCCGTGGACTCTGCAGTTGCTGCCGTTCCCCCC
     ValArgThrLeuSerAlaGlnGlyGluSerValAspSerAlaValAlaAlaValProPro 2110                      2130                      2150
                 .                         .                         .
     GAGCTCCTGGTGCCTCCTACCCCCCACCCGAGACCTGCACCCCAATCAAAGCCATTAGCA
     GluLeuLeuValProProThrProHisProArgProAlaProGlnSerLysProLeuAla 2170                      2190                      2210
                 .                         .                         .
     AGTTCTGGAGTCCCCGAAACCAAAGACGAGCACCTGGGTCCCCACGCCAGGATGGATGAG
     SerSerGlyValProGluThrLysAspGluHisLeuGlyProHisAlaArgMetAspGlu 2230                      2250                      2270
                 .                         .                         .
     GCCTGGGAGCAGAGCCGTGCACCTGGCCCTGTGCATGGGCACATGCTGGAGCCGCCCGTG
     AlaTrpGluGlnSerArgAlaProGlyProValHisGlyHisMetLeuGluProProVal 2290                      2310                      2330
                 .                         .                         .
     GGCCCCGGAAGGCGGTCGCCCTCACCCAGCCGCATCCTGCCGCAGCCACAGGGCACCCCG
```

FIG. 27 D

```
                    GlyProGlyArgArgSerProSerProSerArgIleLeuProGlnProGlnGlyThrPro 2350                2370                2390
             .                   .                   .
    .GTGTCCACCACCGTCGCCAAGGCCATGGCCCGGGAGGCCGCGCAGAGGGTGGCCGAGAGC
     ValSerThrThrValAlaLysAlaMetAlaArgGluAlaAlaGlnArgValAlaGluSer 2410                2430                2450
             .                   .                   .
     AGCAGGTTAGAGAAAAGGAGCGTCTTCCTAGAGAGAAGCAGCGCGGGGCAGTACGCCGCC
     SerArgLeuGluLysArgSerValPheLeuGluArgSerSerAlaGlyGlnTyrAlaAla 2470                2490                2510
             .                   .                   .
     TCAGACGAGGAGGACGCCTATGACTCTCCAGACTTCAAGAGGAGGGGCGCCTCGGTGGAC
     SerAspGluGluAspAlaTyrAspSerProAspPheLysArgArgGlyAlaSerValAsp 2530                2550                2570
             .                   .                   .
     GACTTCCTGAAAGGCTCTGAACTTGGCAAGCAGCCGCACTGTTGCCATGGAGACGAGTAC
     AspPheLeuLysGlySerGluLeuGlyLysGlnProHisCysCysHisGlyAspGluTyr 2590                2610                2630
             .                   .                   .
     CACACAGAGAGCAGCCGGGGGTCTGACCTCTCAGACATCATGGAGGAGGACGAGGAGGAG
     HisThrGluSerSerArgGlySerAspLeuSerAspIleMetGluGluAspGluGluGlu 2650                2670                2690
             .                   .                   .
     CTGTATTCTGAAATGCAGCTGGAAGATGGGGGAAGGAGGCGGCCCAGCGGCACGTCCCAC
     LeuTyrSerGluMetGlnLeuGluAspGlyGlyArgArgArgProSerGlyThrSerHis 2710                2730                2750
             .                   .                   .
     AATGCCCTCAAGATTTTAGGGAACCCAGCCTCTGCAGGACGGGTGGATCACATGGGCCGG
     AsnAlaLeuLysIleLeuGlyAsnProAlaSerAlaGlyArgValAspHisMetGlyArg 2770                2790                2810
             .                   .                   .
     AGGTTTCCCCGTGGCAGCGCTGGTCCTCAGAGGTCCCGGCCCGTGACAGTCCCATCCATC
     ArgPheProArgGlySerAlaGlyProGlnArgSerArgProValThrValProSerIle 2830                2850                2870
             .                   .                   .
     GACGATTACGGGCGAGACCGCCTTTCTCCAGACTTCTATGAAGAGTCAGAAACTGACCCT
     AspAspTyrGlyArgAspArgLeuSerProAspPheTyrGluGluSerGluThrAspPro
```

FIG. 27 E

```
                2890              2910              2930
                  .                 .                 .
        GGTGCCGAAGAGCTCCCGGCCCGGATCTTTGTGGCTCTCTTTGACTACGACCCGCTCACC
        GlyAlaGluGluLeuProAlaArgIlePheValAlaLeuPheAspTyrAspProLeuThr 2950              2970              2990
                  .                 .                 .
        ATGTCCCCAAACCCAGATGCTGCAGAGGAGGAGCTTCCCTTTAAAGAAGGCCAGATCATC
        MetSerProAsnProAspAlaAlaGluGluGluLeuProPheLysGluGlyGlnIleIle 3010              3030              3050
                  .                 .                 .
        AAGGTTTATGGTGATAAAGACGCTGATGGATTCTACCGTGGGGAAACCTGTGCCCGGCTT
        LysValTyrGlyAspLysAspAlaAspGlyPheTyrArgGlyGluThrCysAlaArgLeu 3070              3090              3110
                  .                 .                 .
        GGCCTTATTCCTTGTAACATGGTCTCTGAGATACAAGCAGATGATGAGGAGATGATGGAT
        GlyLeuIleProCysAsnMetValSerGluIleGlnAlaAspAspGluGluMetMetAsp 3130              3150              3170
                  .                 .                 .
        CAGCTTCTTAGACAGGGCTTTCTCCCTCTGAATACACCTGTGGAGAAAATAGAGAGAAGC
        GlnLeuLeuArgGlnGlyPheLeuProLeuAsnThrProValGluLysIleGluArgSer 3190              3210              3230
                  .                 .                 .
        AGGAGAAGTGGCAGGCGTCATTCGGTATCGACGCGGAGAATGGTGGCCCTGTATGACTAC
        ArgArgSerGlyArgArgHisSerValSerThrArgArgMetValAlaLeuTyrAspTyr 3250              3270              3290
                  .                 .                 .
        GACCCCAGAGAAAGCTCGCCCAACGTCGATGTCGAGGCCGAACTTACATTTTGCACAGGA
        AspProArgGluSerSerProAsnValAspValGluAlaGluLeuThrPheCysThrGly 3310              3330              3350
                  .                 .                 .
        GATATTATTACAGTTTTTGGTGAAATTGATGAAGATGGATTTTATTATGGGGAGCTGAAC
        AspIleIleThrValPheGlyGluIleAspGluAspGlyPheTyrTyrGlyGluLeuAsn 3370              3390              3410
                  .                 .                 .
        GGGCAGAAAGGCCTTGTGCCCTCAAACTTCTTGGAAGAAGTGCCTGATGACGTAGAAGTC
        GlyGlnLysGlyLeuValProSerAsnPheLeuGluGluValProAspAspValGluVal 3430              3450              3470
                  .                 .                 .
        TATCTTTCTGATGCTCCATCCCACTACTCTCAAGATACGCCAATGCGCTCAAAGGCAAAA
```

FIG. 27 F

TyrLeuSerAspAlaProSerHisTyrSerGlnAspThrProMetArgSerLysAlaLys

```
           3490                3510                3530
            .                   .                   .
AGGAAGAAGAGTGTTCATTTCATACCTTAATCAGGCAATGTAGCCTTCACGTAAGTGAGC
ArgLysLysSerValHisPheIleProEnd 3550                3570                3590
            .                   .                   .
AACTGAAGATACCGATAAAGATACCAACTTAAGCTACCTTAACCGGGCCAGTGTGGTAGA 3610                3630                3650
            .                   .                   .
CTTAAGGCTTCATTGTGGGGTTAAAAAAAAAAAAAGATACAAAGAAATATGTCTCAAAAA 3670                3690                3710
            .                   .                   .
ACTATTGGACCTAAATAATTAGAATATTACTTGGTCTCAGTTGTAAAGCAACTGAATTTA 3730                3750                3770
            .                   .                   .
TAGTGAAGCAAATCATCTTTAATAATCATTTCCTACTATTTGCATTAAGAATATTTGAAA 3790                3810                3830
            .                   .                   .
GGCCAACATTGGGAACATATTTCTTAACAAGCTAACTGTGTGTTTACATAGAGAGAGCTG 3850                3870                3890
            .                   .                   .
CATATTGCATTGTTAGCCACTCTTGGAAAAAGCACAACCTAACAAACATGTTTACTATAG 3910                3930                3950
            .                   .                   .
GAAGCTTTACTTTAGAAACTTAACCCAAGGTCAAGCAGATGAGTAGTGAACACAGGTGAT 3970                3990                4010
            .                   .                   .
CGAGTGTTGGCTCTGAACACTCCAAACACTGGCTCGAGTGGCCAGAACGTGTTTTCCTTA 4030                4050                4070
            .                   .                   .
AGTAACCCTGCCTCTACCTTACGAGAGAGCTATGCTCCTCCTCAAAGCACAATCATCCTG 4090                4110                4130
            .                   .                   .
TGACAGAAGTTGCTGCAACACGCGTTTGTTGTTGGTATACCAATGCAATACTAAGTTGAT
```

FIG. 27 G

```
              4150                  4170                  4190
               .                     .                     .
      GAAGCACGCAGCTCAAATGATCACATTAGATGGAATAGATGGTATCTTCAGGTGTACTTT 4210                  4230                  4250
               .                     .                     .
      GGGATGCTTTACTAGGTGTTTTCCATTAGAATTAGACCTTGATTTTAAATCCAAGCAAGC 4270                  4290                  4310
               .                     .                     .
      TTGAAGCCCCTTGGCTTACAGCATTTGCCTGCTGAATACTAAACACTCACATGGCAAGAG 4330                  4350                  4370
               .                     .                     .
      TTGCTCTGGAGAGGTAGGGCCAGAGGAATGCTGCTGCACTGCCAACTCAGGCACATGCTT 4390                  4410                  4430
               .                     .                     .
      AGCTGTAAAGGGAAGCGAGGTGAAGTCGTCCTGCAGCGTATTAGAGTAAAAGTCTACCCC 4450                  4470                  4490
               .                     .                     .
      TCTGAAGCACTATTAAGCGCTTAACGTATATTTAAATACTACCATGTGCTATCTACTGAG 4510                  4530                  4550
               .                     .                     .
      GAAGATTCATGTTCAATTATTTGGAAATAATGCAAGCATCCACTAAGGGCCTTTAAGCTT 4570                  4590                  4610
               .                     .                     .
      TCTTTGATTATAATTAAGGTTCATTTTAGTTTTTTTTTTTCTTTCAACCAGTGTGCCAT 4630                  4650                  4670
               .                     .                     .
      CTCCAATATTTCTATAGTATACCAACCACCCCAGGAATGCACTTTAACAATATCAGGATT 4690                  4710                  4730
               .                     .                     .
      TTATATAACCAAATAGTTTCAAATACAACAAAATTCCCTTTATGAACTTTCGCTTTTTAA 4750                  4770                  4790
               .                     .                     .
      GACTACTGATGGGTACTCGGCCAACTTTACTATCAACCTAATTTCAGATCATGTCTCCCC
```

FIG. 27 H

```
                4810                4830                4850
                  .                   .                   .
TGCCCTTAGTCTTCATTTATGAAGTGAATTATTACCTGCCTTAGCTTTGCCAAAGCAACG 4870                4890                4910
                  .                   .                   .
GCCACCCCGCACTCCCTCGAGACAGAGAAACGGAACCCACACATTTATGTCTGGGGCCTC 4930                4950                4970
                  .                   .                   .
TCTCTGGCGTGCTGTGGGAGAGGACCTTTGCTTCTCATGGCATACTTCAACAACTGAAAG 4990                5010                5030
                  .                   .                   .
AACAAATGAACCCCCCTGACCTTTCCTGGTGGGAAACGGGGACAGTACGATGTTACCAAG 5050                5070                5090
                  .                   .                   .
TGAATTCTGTTGTTGGCGCTCACACACTCAATAAACTGTAACACTGTACCTACTAGGTTC 5110                5130                5150
                  .                   .                   .
CTCCTGAGGGTTCAGGTACAGCAAGGAGAGCTCCATCCCCCACAGTCCATCTCCATTCGG 5170                5190                5210
                  .                   .                   .
GGTCACCTACGTCATCTATGGGTTCTGGTAGTCCTGGGAGAGGCAGGGAAATGTCCTCGA 5230                5250                5270
                  .                   .                   .
AAAAGAAAAAGGGGCTGCTTTCCAAAGGCAAGAAACTGCTGAAAAAGCTGGGTGCAGTGA 5290                5310                5330
                  .                   .                   .
AATGATTCATGTGCTTCCGGACAACTGCCAAATCTATGTAATTTTCTTTAATTCCAAACT 5350                5370                5390
                  .                   .                   .
AGGGCTTTCATGACTCAAGTACTTCCTAAAAAAACCCAATCTTCTCCCCTGACACCAGTA 5410                5430                5450
                  .                   .                   .
GAGAAATGCACTTTTGCACTACCAACCACTTTAAACCAACCACGAGAACAAAGAGGAGCG 5470                5490                5510
                  .                   .                   .
```

FIG. 27 I

```
GTTGCTCTCTGTCACCGCTGGCAGTCTGCTCTCATTGTCCAAGCTCTGATTTGGGAGGTG 5530              5550              5570
          .                 .                 .
GGAGGGGACGTCTTATTAACAAACGGGGGCGCATAGCTATCACCTGTAGCTCCCTCCCTA 5590              5610              5630
          .                 .                 .
CCTGTAATTCCAGTCTTTGTGCATTTGTCATCTGCCCTTAAAGGAATGATTTTCAACCTT 5650              5670              5690
          .                 .                 .
TCTCCCTTCTCAAAATGCTTGCCTCATAATGCATAACTTTCACTTTGACTCTGGTCTTGA 5710              5730              5750
          .                 .                 .
AATTCCTAGTTTAATTCGCCTTGATGTTCTGCCTTATAAATGCACAATGATTTGTACTGT 5770              5790              5810
          .                 .                 .
CTAATAAAAACAGTGTATACTTTGTATGTGTCGTGCATTCAGTGGTCTTCATCCTGACAC 5830              5850              5870
          .                 .                 .
AGTGGTTCGAGATCAAGTTGTACAGGCTGTGCATTTTAAGATACTAGTTTCAGTCTTTCA 5890              5910              5930
          .                 .                 .
AAGCCAGCCAGGCTACACACAGAAAATGTTTACTCAATCATTCAAAAAGAGAAAAGGAG 5950              5970              5990
          .                 .                 .
AGAAAGTAACTTTGTTTGGTAAAGCACCAGTACTCCAACCTTCCAGAAAGCCGATTATCT 6010              6030              6050
          .                 .                 .
TCATTGCTTTTAATGTTCTATTCTGTGGCATATGGTTTTCTGTTACTTTCGTTGTCAAAA 6070              6090              6110
          .                 .                 .
TGCCATACCCAAATACACAGCAATGAATGGCACACAAGTAATCCACATAATGCATAAGCC 6130              6150              6170
          .                 .                 .
ACACCAAAACCAGACTCAATTTAAATCTGCTCCAAATGAGTCCATACCCATCTTCATCAT
```

FIG. 27 J

```
              6190                6210                6230
                 .                   .                   .
     TGGCATTTGAACAAAAGACTTACTTACAAAGTTGCTGGCAGATGTATTTGATGGTTACTC 6250                6270                6290
                 .                   .                   .
     TTTTGTAATTCTTGTCCACTTGTAAATTGTTTTTACTCTTTATACATACTTTTCAGACTG 6310                6330                6350
                 .                   .                   .
     CCTTTCTTTTGTAATTTATGGACGGTTTATAAATGAATGACAAAGCTTTCCCCATTGTGT 6370                6390                6410
                 .                   .                   .
     CTTCAAAAACGCTATTATAAATTGTAATATAATAGTATGTGGTAGATTTATTATTAAAGG 6430                6450                6470
                 .                   .                   .
     AAATCCATGTGTGGTTAAGCTCTGTGTGGGTGTGTGCATGTGCACAGTTAGTGTAAAATA

6490
                 .
     TTTTCTAGAAATAAAATTTGTTATTTTAT
```

FIG. 27 K

```
        10                  30                  50
         .                   .                   .
GGTCCCCACGCCAGGATGGATGAGGCCTGGGAGCAGAAGCCTGTGCACCTGGCCCTGTGC
              MetAspGluAlaTrpGluGlnLysProValHisLeuAlaLeuCys 70                  90                 110
         .                   .                   .
ATGGGCACATGCTGGAGCCGCCCGTGGGCCCCGCATCCTGCCACAGCCACAGGGCACCCC
MetGlyThrCysTrpSerArgProTrpAlaProHisProAlaThrAlaThrGlyHisPro 130                 150                 170
         .                   .                   .
GGTGTCCACCACCGTCGCCAAGGCCATGGCCCGGGAGGCCGCGCAGAGGGTGGCGAGAGC
GlyValHisHisArgArgGlnGlyHisGlyProGlyGlyArgAlaGluGlyGlyGluSer 190                 210                 230
         .                   .                   .
AGCAGGTTAGAGAAAAGGAGCGTCTTCCTAGAGAGAAGCAGCGCGGGGCAGTACGCCGCC
SerArgLeuGluLysArgSerValPheLeuGluArgSerSerAlaGlyGlnTyrAlaAla 250                 270                 290
         .                   .                   .
TCAGACGAGGAGGACGCCTATGACTCTCCAGACTTCAAGAGGAGGGGCGCCTCGGTGGAC
SerAspGluGluAspAlaTyrAspSerProAspPheLysArgArgGlyAlaSerValAsp 310                 330                 350
         .                   .                   .
GACTTCCTGAAAGGCTCTGAACTTGGCAAGCAGGGAAACTGAGGCCCACAGAATTGAGAA
AspPheLeuLysGlySerGluLeuGlyLysGlnGlyAsnEnd 370                 390                 410
         .                   .                   .
TTTTTGTCCATGATTACGCAGATGGTCTCCTAACAGAGCTGGAATTAGATTGAACCGAGG 430                 450                 470
         .                   .                   .
CCTGAAGAAGACCTGTTTCCACGCCTTTCCCCATGTGCCACGTTCTCCTCACCTATCCAG 490                 510                 530
         .                   .                   .
GAGTGAATCATCACCTTCCCTGCAATCTGCTCAGGTTACAAACCCGGAGGAAAGGCTGGA 550                 570                 590
         .                   .                   .
GCACTTGTTCTCTGGGTGAAGGACCCATACCCCCACTGGTTTTTGAGATCGGCATTCAGC
```

FIG. 28 A

```
         610                630                650
          .                  .                  .
GCTGTCTTATGGCAGCCMCAGCCCCAGGTGGCCCCAGAGCCCTTGACATGTGGCCACCTG 670                690                710
          .                  .                  .
GGGCTGAGTGTGACTGAGGCCCTGAATTTTTACTTCTATAAAATTAGTTCCAGATTAGTT 730                750                770
          .                  .                  .
TACATTCCTAATTAGTTTACATGTAAACAGCCACACGTGGCTGGTGGCCACCAGTGCTGA 790                810                830
          .                  .                  .
CGCCCAGCTCTGGATGACCACACCTGCTACAAGAGATGACTTTTCTAGAGAAGAGTAGAA 850                870                890
          .                  .                  .
ACACAGCGGCAGAAACACAGCTCTGCACTTCCGAGGGCCTCCCACTCCTTCTGATGAGAC 910                930                950
          .                  .                  .
TGCAGAGGAAGTCTGTTTGGCCAAGCATGCTATTAACACGTTTTCCTGCTTGTTTTGTTT 970                990                1010
          .                  .                  .
TTTAACAGAGCAAACAGGTCTGTTTCTATTAAAATTTAAAAAGCGTTAATATTTARCAGC 1030               1050               1070
          .                  .                  .
ATTGTTTTATGTTGTATTCATAACATAATAATATAACAATATATTAATTGTTAATATATA 1090               1110               1130
          .                  .                  .
TTGTTAATAATATAATAATATAACATAAAATAAGTGATACTTATTTTCCATTTACAGTTG 1150               1170               1190
          .                  .                  .
AGATATTTCTTTAAAAGTAACGTTAAATATTGATTCAATTCAAAGAATACATTCATTAA 1210               1230               1250
          .                  .                  .
TCATACAGATGGCGTCTGGCTAGGTGACGCATCATGACAGTGGTAGGGAGTGACTGAAGT 1270               1290               1310
```

FIG. 28 B

```
TGAGCTGGTGCACAGACTGCCAGTTTTACAACCCGGGAAGTGTTCCCTGACCATCCGCTT 1330              1350              1370
CCCCATGCTGCCCGCCCCGTCACATGAGCCCTTACCCCCTGGCGCTATCCCATCTGCTCC 1390              1410              1430
AAGACACCGATGTTCTAGTGGGTGGAAGCCTCCACTTTTAGTTGACTACGGTATCTCTAG 1450              1470              1490
CATTTCACACATAGTAGGTGCTCAATGAATGTTTGTCGAATGAATGAATGAAAGAAGGGA 1510              1530              1550
GGCTGAGAGTAGCTGGGACATTTGCTCTGAAAAAATCACCTCCATTCTCCCAATATTACA 1570              1590              1610
AAAGCATTTTCATTAAGTCCACAATGAAAAATGCTCACTGTACCAATAAATAATATCTTT 1630              1650
AGTTATCTATTTTTAAAAGTAAAAAAAAACCTCGTGCCGAAGTC
```

FIG. 28 C

NUCLEOTIDE AND AMINO ACID SEQUENCES RELATING TO RESPIRATORY DISEASES AND OBESITY

RELATED APPLICATIONS

This application is a divisional of U.S. application Ser. No. 10/021,698, filed Oct. 22, 2001, now U.S. Pat. No. 7,205,146 which is a continuation of U.S. Ser. No. 09/881,797, filed Jun. 14, 2001, now abandoned and claims the benefit of provisional application U.S. Ser. No. 60/211,749, filed Jun. 14, 2000, all of which are incorporated by reference in their entirety.

FIELD OF THE INVENTION

This invention relates to genes identified from human chromosome 12q23-qter, including Gene 454, Gene 561, and Gene 757, which are associated with asthma, obesity, inflammatory bowel disease, and other human diseases. The invention also relates to the nucleotide sequences of these genes, including genomic DNA sequences, cDNA sequences, and single nucleotide polymorphisms. The invention further relates to isolated nucleic acids comprising these nucleotide sequences, and isolated polypeptides or peptides encoded thereby. Also related are expression vectors and host cells comprising the disclosed nucleic acids or fragments thereof, as well as antibodies that bind to the encoded polypeptides or peptides. The present invention further relates to ligands that modulate the activity of the disclosed genes or gene products. In addition, the invention relates to diagnostics and therapeutics for various diseases, including asthma, utilizing the disclosed nucleic acids, polypeptides or peptides, antibodies, and/or ligands.

BRIEF DESCRIPTION OF THE SEQUENCE LISTING

Incorporated herein by reference in its entirety is a Sequence Listing, comprising SEQ ID NO:1 to SEQ ID NO:4687 and a substitute sequence listing filed on Mar. 5, 2004. The Sequence Listing filed on Oct. 22, 2001 is contained on a CD-ROM, three copies of which are filed, the Sequence Listing being in a computer-readable ASCII file named "Seqlist.txt", created on Jun. 7, 2001 and of 11,976 kilobyte in size, in IBM-PC Windows®NT v4.0 format.

BACKGROUND

Asthma has been linked to markers on human chromosome 12 (Wilson et al., 1998, *Genomics*, 53: 251-259). In addition, obesity has been linked to asthma (Wilson et al., 1999, *Arch. Intern. Med.* 159: 2513-14). In particular, chromosomal region 12q23-qter has been associated with a variety of genetic disorders, including male germ cell tumors, histidinemia, growth retardation with deafness and mental retardation, deficiency of Acyl-CoA dehydrogenase, spinal muscular atrophy, Darier disease, cardiomyopathy, Spinocerebellar ataxia-2, brachydactyl), Mevalonicaciduria, Hyperimmunoglobulinemia D, Noonan syndrome-1, Cardiofaciocutaneous syndrome, spinal muscular atrophy-4, tyrosinemia, phenylketonuria, B-cell non-Hodgkin lymphoma, Ulnar-mammary syndrome, Holt-Oram syndrome, Scapuloperoneal spinal muscular atrophy, alcohol intolerance, MODY, Diabetes mellitus, noninsulin-dependent 2, and diabetes mellitus insulin-dependent (See National Center for Biotechnology Information; Bethesda, Md.). The genes of this regions are also associated with obesity, lung disease, particularly, inflammatory lung disease phenotypes such as Chronic Obstructive Lung Disease (COPD), Adult Respiratory Distress Syndrome (ARDS), and asthma. However, few genes in chromosomal region 12q23-qter have been discovered. Thus, there is a need in the art for the identification of specific genes that are involved in these disorders. Identification and characterization of such genes will allow the development of effective diagnostics and therapeutic means to diagnose, prevent, and/or treat lung related disorders, as well as the other diseases described herein.

SUMMARY OF THE INVENTION

This invention relates to isolated DNA comprising genes located on chromosome 12q23-qter (see Table 4). In specific embodiments, the invention relates to isolated nucleic acids comprising 12q23-qter genomic sequences (e.g., SEQ ID NO:1 to SEQ ID NO:92 and SEQ ID NO: 156 to SEQ ID NO: 4973), cDNA and EST sequences (e.g., SEQ ID NO:1 to SEQ ID NO:92), BAC sequences (e.g., SEQ ID NO:156 to SEQ ID NO:693), BAC clones and contigs (e.g., SEQ ID NO: 694 to SEQ ID NO: 1265), direct selected sequences (e.g., SEQ ID NO: 1266 to SEQ ID NO: 2052), clusters (e.g., SEQ ID NO: 2053 to SEQ ID NO: 4973), complementary sequences, sequence variants, or fragments thereof, as described herein. The present invention also encompasses nucleic acid probes or primers useful for assaying a biological sample for the presence or expression of 12q23-qter genes.

The invention further encompasses nucleic acids variants comprising single nucleotide polymorphisms (SNPs) identified in several 12q23-qter genes (Table 10; FIGS. 7A-7H; FIGS. 9A-9F; FIGS. 27A-27K; and FIGS. 28A-28C). These include SNPs for gene 454 (SEQ ID NO: 19; FIGS. 7A-7H), gene 561.1 (SEQ ID NO: 31; FIGS. 27A-27K), gene 561.2 (SEQ ID NO: 32; FIGS. 28A-28C), and gene 757 (SEQ ID NO: 90; FIGS. 9A-9F). SNPs can be used to diagnose diseases such as asthma, or to determine a genetic predisposition thereto. In addition, the present invention encompasses nucleic acids comprising alternate splicing variants—(e.g., SEQ ID NO:1 to SEQ ID NO:5; SEQ ID NO:17 to SEQ ID NO:18; SEQ ID NO:36 to SEQ ID NO:37; SEQ ID NO:43 to SEQ ID NO:44; and SEQ ID NO:80 to SEQ ID NO:81).

This invention also relates to vectors and host cells comprising vectors comprising the 12q23-qter nucleic acid sequences disclosed herein. Such vectors can be used for nucleic acid preparations, including antisense nucleic acids, and for the expression of encoded polypeptides or peptides. Host cells can be prokaryotic or eukaryotic cells. In specific embodiments, an expression vector comprises a DNA sequence encoding the 12q23-qter polypeptide sequence (e.g., SEQ ID NO:93 to SEQ ID NO:155), sequence variants, or fragments thereof, as described herein.

The present invention further relates to isolated 12q23-qter polypeptides and peptides. In specific embodiments, the polypeptides or peptides comprise the amino acid sequences encoded by the 12q23-qter genes (e.g., SEQ ID NO:93 to SEQ ID NO:155), sequence variants, or portions thereof, as described herein. In addition, this invention encompasses isolated fusion proteins comprising 12q23-qter polypeptides or peptides.

The present invention also relates to isolated antibodies, including monoclonal and polyclonal antibodies, and antibody fragments, that are specifically reactive with the 12q23-qter polypeptides, fusion proteins, or variants, or portions thereof, as disclosed herein. In specific embodiments, monoclonal antibodies are prepared to be specifically reactive with a 12q23-qter polypeptide (e.g., SEQ ID NO:93 to SEQ ID NO:155) or peptides, or sequence variants thereof.

In addition, the present invention relates to methods of obtaining 12q23-qter polynucleotides and polypeptides, variant sequences, or fragments thereof, as disclosed herein. Also related are methods of obtaining antibodies and antibody fragments that bind to 12q23-qter polypeptides, variant sequences, or fragments thereof. The present invention also encompasses methods of obtaining 12q23-qter ligands, e.g., agonists, antagonists, inhibitors, and binding factors. Such ligands can be used as therapeutics for asthma and related diseases.

The present invention also relates to diagnostic methods and kits utilizing obtaining 12q23-qter (wild-type, mutant, or variant) nucleic acids, polypeptides, antibodies, or functional fragments thereof. Such factors can be used, for example, in diagnostic methods and kits for measuring expression levels of obtaining 12q23-qter gene expression, and to screen for various obtaining 12q23-qter-related diseases, especially asthma. In addition, the nucleic acids described herein can be used to identify chromosomal abnormalities affecting 12q23-qter genes, and to identify allelic variants or mutations of 12q23-qte genes in an individual or population.

The present invention further relates to methods and therapeutics for the treatment of various diseases, including asthma. In various embodiments, therapeutics comprising the disclosed 12q23-qter nucleic acids, polypeptides, antibodies, ligands, or variants, derivatives, or portions thereof, are administered to a subject to treat, prevent, or ameliorate asthma. Specifically related are therapeutics comprising 12q23-qter antisense nucleic acids, monoclonal antibodies, and gene therapy vectors. Such therapeutics can be administered alone, or in combination with one or more asthma treatments.

In addition, this invention relates to non-human transgenic animals and cell lines comprising one or more of the disclosed 12q23-qter nucleic acids, which can be used for drug screening, protein production, and other purposes. Also related are non-human knock-out animals and cell lines, wherein one or more endogenous 12q23-qter genes (i.e., orthologs), or portions thereof, are deleted or replaced by marker genes.

This invention further relates to methods of identifying proteins that are candidates for being involved in asthma (i.e., a "candidate protein"). Such proteins are identified by a method comprising: 1) identifying a protein in a first individual having the asthma phenotype; 2) identifying a protein in a second individual not having the asthma phenotype; and 3) comparing the protein of the first individual to the protein of the second individual, wherein a) the protein that is present in the second individual but not the first individual is the candidate protein; or b) the protein that is present in a higher amount in the second individual than in the first individual is the candidate protein; or c) the protein that is present in a lower amount in the second individual than in the first individual is the candidate protein.

BRIEF DESCRIPTION OF THE FIGURES

FIGS. 7A-7H show the cDNA sequence (SEQ ID NO: 19) and amino acid sequence (SEQ ID NO: 111) of Gene 454 with the corresponding SNPs underlined.

FIGS. 9A-9F show the cDNA sequence (SEQ ID NO: 90) and amino acid sequence (SEQ ID NO: 153) of Gene 757 with the corresponding SNPs underlined.

FIGS. 27A-27K show the cDNA sequence (SEQ ID NO: 31) and amino acid sequence (SEQ ID NO:6161) of Gene 561.1 with the corresponding SNPs underlined.

FIGS. 28A-28C show the cDNA sequence (SEQ ID NO: 32) and amino acid sequence (SEQ ID NO:120) of Gene 561.2 with the corresponding SNPs underlined.

DETAILED DESCRIPTION OF THE INVENTION

Figure 1A:
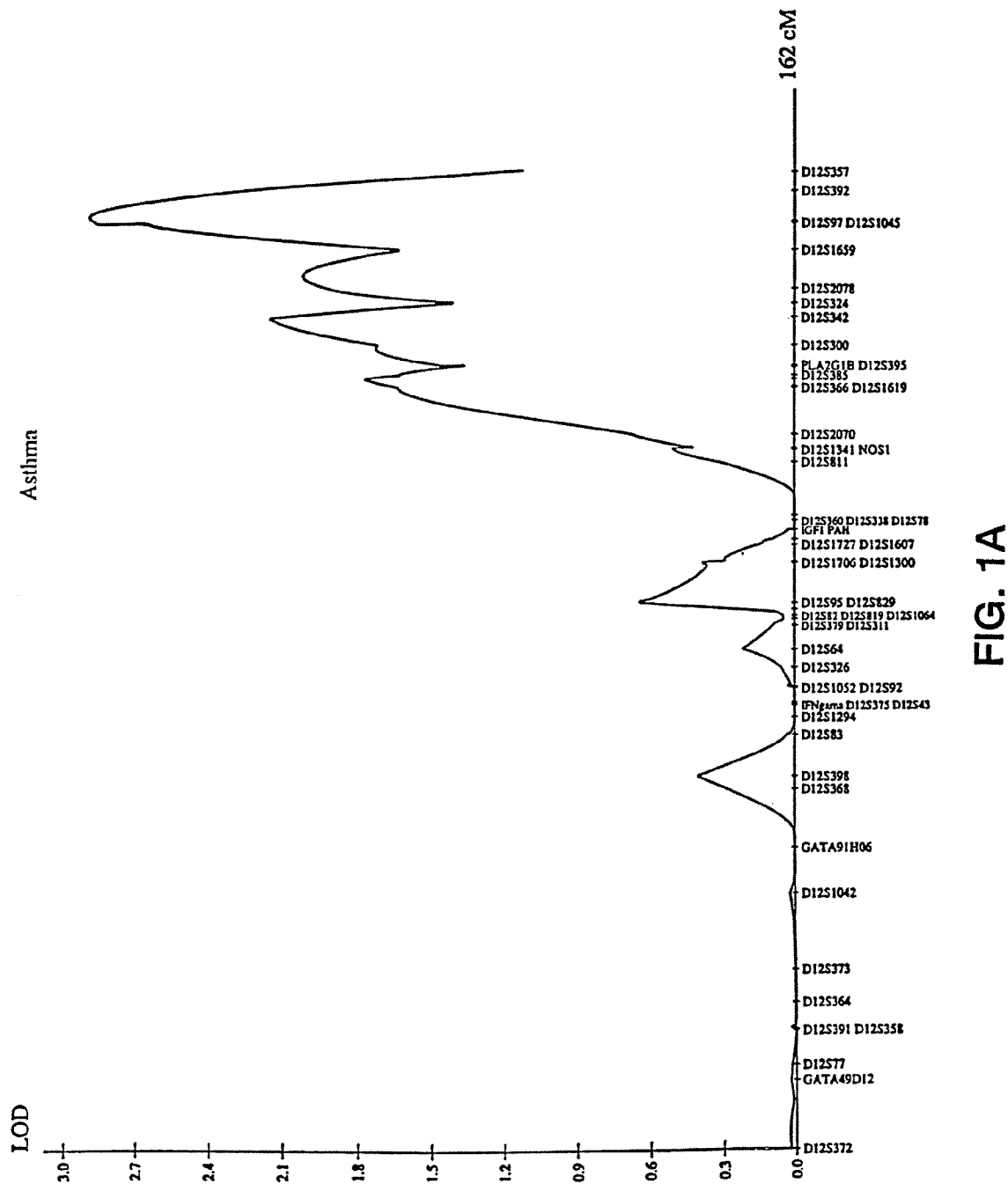
FIGS. 1A-1D show the plot of multipoint LOD score against the map location of the markers along chromosome 12 for four phenotypes: asthma, bronchial hyper-responsiveness, total IgE, and specific IgE.

Chromosome 12q23-qter genes were isolated by narrowly defining the region of chromosome 12q23-qter that showed association with asthma. Chromosome 12q23-qter genes have been implicated in other diseases, including obesity. Bronchial asthma, furthermore, has been linked to intestinal conditions such as inflammatory bowel disease (B. Wallaert et al., 1995, *J. Exp. Med.* 182:1897-1904). Thus, there was a need to identify and isolate the gene(s) associated with this region of human chromosome 12.

To aid in the understanding of the specification and claims, the following definitions are provided.

Definitions

"Disorder region" refers to a portion of the human chromosome 12 bounded by the markers D12S2070 to the 12q telomere. A "disorder-associated" nucleic acid or "disorder-associated" polypeptide sequence refers to a nucleic acid sequence that maps to region 12q23-qter and polypeptides encoded thereby. For nucleic acid sequences, this encompasses sequences that are homologous or complementary to the reference sequence, as well as "sequence-conservative variants" and "function-conservative variants." For polypeptide sequences, this encompasses "function-conservative variants." Also encompassed are naturally-occurring mutations associated with respiratory diseases including, but not limited to, asthma and atopy, as well as other diseases arising from mutations in this region including those described in detail herein. These mutations are not limited to mutations that cause inappropriate expression (e.g., lack of expression, over-expression, and expression in an inappropriate tissue type).

"Sequence-conservative" variants are those in which a change of one or more nucleotides in a given codon position results in no alteration in the amino acid encoded at that position (i.e., silent mutations). "Function-conservative" variants are those in which a change in one or more nucleotides in a given codon position results in a polypeptide sequence in which a given amino acid residue in a polypeptide has been changed without substantially altering the overall conformation and function of the native polypeptide, including, but not limited to, replacement of an amino acid with one having similar physico-chemical properties (such as, for example, acidic, basic, hydrophobic, and the like). "Function-conservative" variants also include analogs of a given polypeptide and any polypeptides that have the ability to elicit antibodies specific to a designated polypeptide.

"Nucleic acid or "polynucleotide" as used herein refers to purine- and pyrimidine-containing polymers of any length, either polyribonucleotides or polydeoxyribonucleotide or mixed polyribo-polydeoxyribonucleotides. This includes single- and double-stranded molecules, i.e., DNA-DNA, DNA-RNA and RNA-RNA hybrids, as well as "protein nucleic acids" (PNA) formed by conjugating bases to an amino acid backbone. This also includes nucleic acids containing modified bases.

A "coding sequence" or a "protein-coding sequence" is a polynucleotide sequence capable of being transcribed into mRNA and/or capable of being translated into a polypeptide. The boundaries of the coding sequence are typically determined by a translation start codon at the 5'-terminus and a translation stop codon at the 3'-terminus.

As used herein, the "reference sequence" refers to the sequence used to compare individuals in identifying single nucleotide polymorphisms and the like. "Variant" sequences refer to nucleotide sequences (and in some cases, the encoded amino acid sequences) that differ from the reference sequence(s) at one or more positions. Non-limiting examples of variant sequences include the disclosed single nucleotide polymorphisms (SNPs), alternate splice variants, and the amino acid sequences encoded by these variants.

"Expressed Sequence Tag (EST)" is a nucleic acid that encodes for a portion of or a full-length protein sequence.

"12q23-qter genes" and "12q23-qter nucleic acids" include the genes and EST's shown in FIGS. 2A-2P and FIGS. 3A-3G, as well as the sequences listed in Table 4 (i.e., Gene 214, Gene 215, Gene 224, Gene 266, Gene 283, Gene 292, Gene 298, Gene 321, Gene 399, Gene 422, Gene 436, Gene 454, Gene 515, Gene 536, Gene 543, Gene 548, Gene 549, Gene 550, Gene 551, Gene 553, Gene 555, Gene 558, Gene 559, Gene 561, Gene 562, Gene 563, Gene 564, Gene 566, Gene 567, Gene 570, Gene 571, Gene 572, Gene 575, Gene 577, Gene 579, Gene 580, Gene 581, Gene 583, Gene 584, Gene 586, Gene 587, Gene 589, Gene 590, Gene 592, Gene 593, Gene 594, Gene 595, Gene 596, Gene 601, Gene 603, Gene 604, Gene 605, Gene 606, Gene 608, Gene 611, Gene 615, Gene 617, Gene 618, Gene 620, Gene 621, Gene 622, Gene 690, Gene 692, Gene 693, Gene 694, Gene 695, Gene 697, Gene 698, Gene 699, Gene 702, Gene 705, Gene 707, Gene 722, Gene 748, Gene 749, Gene 751, Gene 752, Gene 753, Gene 754, Gene 756, Gene 757, Gene 835, and Gene 848).

"12q23q-qter proteins" and "12q23q-qter polypeptides" include the polypeptide sequences encoded by the genes listed in Table 4.

A "complement" of a nucleic acid sequence as used herein refers to the "antisense" sequence that participates in Watson-Crick base-pairing with the original sequence.

A "probe" refers to a nucleic acid or oligonucleotide that forms a hybrid structure with a sequence in a target region due to complementarily of at least one sequence in the probe with a sequence in the target region.

Nucleic acids are "hybridizable" to each other when at least one strand of nucleic acid can anneal to another nucleic acid strand under defined stringency conditions. As is well known in the art, stringency of hybridization is determined, e.g., by (a) the temperature at which hybridization and/or washing is performed, and (b) the ionic strength and polarity (e.g., formamide) of the hybridization and washing solutions, as well as other parameters. Hybridization requires that the two nucleic acids contain substantially complementary sequences; depending on the stringency of hybridization, however, mismatches may be tolerated. The appropriate stringency for hybridizing nucleic acids depends on the length of the nucleic acids and the degree of complementarily, variables well known in the art.

"Gene" refers to a DNA sequence that encodes through its template or messenger RNA a sequence of amino acids characteristic of a specific peptide, polypeptide, or protein. The term "gene" as used herein with reference to genomic DNA includes intervening, non-coding regions, as well as regulatory regions, and can include 5' and 3' ends.

"Gene sequence" refers to a DNA molecule, including a DNA molecule that contains a non-transcribed or non-translated sequence. The term is also intended to include any combination of gene(s), gene fragment(s), non-transcribed sequence(s), or non-translated sequence(s) that are present on the same DNA molecule.

A gene sequence is "wild-type" if such sequence is usually found in individuals unaffected by the disease or condition of interest. However, environmental factors and other genes can also play an important role in the ultimate determination of the disease. In the context of complex diseases involving multiple genes ("oligogenic disease"), the "wild type", or normal sequence can also be associated with a measurable risk or susceptibility, receiving its reference status based on its frequency in the general population. As used herein, "wild-type" refers to the reference sequence. The wild-type sequences are used to identify the variants (single nucleotide polymorphisms) described in detail herein.

A gene sequence is a "mutant" sequence if it differs from the wild-type sequence. For example, a Gene 454 nucleic acid containing a single nucleotide polymorphism is a mutant sequence. In some cases, the individual carrying such gene has increased susceptibility toward the disease or condition of interest. In other cases, the "mutant" sequence might also refer to a sequence that decreases the susceptibilty toward a disease or condition of interest, and thus acting in a protective manner. Also a gene is a "mutant" gene if too much ("overexpressed") or too little ("underexpressed") of such gene is expressed in the tissues in which such gene is normally expressed, thereby causing the disease or condition of interest.

"cDNA" refers to complementary or copy DNA produced from an RNA template by the action of RNA-dependent DNA polymerase (reverse transcriptase). Thus, a "cDNA clone" means a duplex DNA sequence complementary to an RNA molecule of interest, carried in a cloning vector or PCR amplified. This term includes genes from which the intervening sequences have been removed.

"Recombinant DNA" means a molecule that has been recombined by in vitro splicing/and includes cDNA or a genomic DNA sequence.

"Cloning" refers to the use of in vitro recombination techniques to insert a particular gene or other DNA sequence into a vector molecule. In order to successfully clone a desired gene, it is necessary to use methods for generating DNA fragments, for joining the fragments to vector molecules, for introducing the composite DNA molecule into a host cell in which it can replicate, and for selecting the clone having the target gene from amongst the recipient host cells.

"cDNA library" refers to a collection of recombinant DNA molecules containing cDNA inserts, which together comprise the entire genome of an organism. Such a cDNA library can be prepared by methods known to one skilled in the art and described by, for example, Cowell and Austin, 1997, "cDNA Library Protocols," Methods in Molecular Biology. Generally, RNA is first isolated from the cells of an organism from whose genome it is desired to clone a particular gene.

The term "vector" as used herein refers to a nucleic acid molecule capable of replicating another nucleic acid to which it has been linked. A vector, for example, can be a plasmid.

"Cloning vector" refers to a plasmid or phage DNA or other DNA sequence that is able to replicate in a host cell. The cloning vector is characterized by one or more endonuclease recognition sites at which such DNA sequences may be cut in a determinable fashion without loss of an essential biological function of the DNA, which may contain a marker suitable for use in the identification of transformed cells.

"Expression vector" refers to a vehicle or vector similar to a cloning vector but which is capable of expressing a nucleic acid sequence that has been cloned into it, after transformation into a host. A nucleic acid sequence is "expressed" when it is transcribed to yield an mRNA sequence. In most cases, this transcript will be translated to yield amino acid sequence. The cloned gene is usually placed under the control of (i.e., operably linked to) an expression control sequence.

"Expression control sequence" or "regulatory sequence" refers to a nucleotide sequence that controls or regulates expression of structural genes when operably linked to those genes. These include, for example, the lac systems, the trp system, major operator and promoter regions of the phage lambda, the control region of fd coat protein and other sequences known to control the expression of genes in prokaryotic or eukaryotic cells. Expression control sequences will vary depending on whether the vector is designed to express the operably linked gene in a prokaryotic or eukaryotic host, and may contain transcriptional elements such as enhancer elements, termination sequences, tissue-specificity elements and/or translational initiation and termination sites.

"Operably linked" means that the promoter controls the initiation of expression of the gene. A promoter is operably linked to a sequence of proximal DNA if upon introduction into a host cell the promoter determines the transcription of the proximal DNA sequence(s) into one or more species of RNA. A promoter is operably linked to a DNA sequence if the promoter is capable of initiating transcription of that DNA sequence.

"Host" includes prokaryotes and eukaryotes. The term includes an organism or cell that is the recipient of a replicable expression vector.

The introduction of the nucleic acids into the host cell by any method known in the art, including those described herein, will be referred to herein as "transformation." The cells into which have been introduced nucleic acids described above are meant to also include the progeny of such cells.

"Amplification of nucleic acids" refers to methods such as polymerase chain reaction (PCR), ligation amplification (or ligase chain reaction, LCR) and amplification methods based on the use of Q-beta replicase. These methods are well known in the art and described, for example, in U.S. Pat. Nos. 4,683,195 and 4,683,202. Reagents and hardware for conducting PCR are commercially available. Primers useful for amplifying sequences from the disorder region are preferably complementary to, and preferably hybridize specifically to, sequences in the 12q23-qter region or in regions that flank a target region therein. Chromosome 12q23-qter genes generated by amplification may be sequenced directly. Alternatively, the amplified sequence(s) may be cloned prior to sequence analysis.

A nucleic acid or fragment thereof is "substantially homologous" or "substantially similar" to another if, when optimally aligned (with appropriate nucleotide insertions and/or deletions) with the other nucleic acid (or its complementary strand), there is nucleotide sequence identity in at least 60% of the nucleotide bases, usually at least 70%, more usually at least 80%, preferably at least 90%, and more preferably at least 95-98% of the nucleotide bases.

Alternatively, substantial homology or similarity exists when a nucleic acid or fragment thereof will hybridize, under selective hybridization conditions, to another nucleic acid (or a complementary strand thereof). Selectivity of hybridization exists when hybridization which is substantially more selective than total lack of specificity occurs. Typically, selective hybridization will occur when there is at least 55% homology over a stretch of at least nine or more nucleotides, preferably at least 65%, more preferably at least 75%, and most preferably at least 90% (see, M. Kanehisa, 1984, *Nucl. Acids Res.* 11:203-213). The length of homology comparison, as described, may be over longer stretches, and in certain embodiments will often be over a stretch of at least 14 nucleotides, usually at least 20 nucleotides, more usually at least 24 nucleotides, typically at least 28 nucleotides, more typically at least 32 nucleotides, and preferably at least 36 or more nucleotides.

Nucleic acids referred to herein as "isolated" are nucleic acids separated away from the nucleic acids of the genomic DNA or cellular RNA of their source of origin (e.g., as it exists in cells or in a mixture of nucleic acids such as a library), and may have undergone further processing. "Isolated", as used herein, refers to nucleic or amino acid sequences that are at least 60% free, preferably 75% free, and most preferably 90% free from other components with which they are naturally associated. "Isolated" nucleic acids (polynucleotides) include nucleic acids obtained by methods described herein, similar methods or other suitable methods, including essentially pure nucleic acids, nucleic acids produced by chemical synthesis, by combinations of biological and chemical methods, and recombinant nucleic acids which are isolated. Nucleic acids referred to herein as "recombinant" are nucleic acids which have been produced by recombinant DNA methodology, including those nucleic acids that are generated by procedures which rely upon a method of artificial replication, such as the polymerase chain reaction (PCR) and/or cloning into a vector using restriction enzymes. "Recombinant" nucleic acids are also those that result from recombination events that occur through the natural mechanisms of cells, but are selected for after the introduction to the cells of nucleic acids designed to allow or make probable a desired recombination event. Portions of the isolated nucleic acids which code for polypeptides having a certain function can be identified and isolated by, for example, the method of Jasin, M., et al., U.S. Pat. No. 4,952,501.

In the context of this invention, the term "oligonucleotide" refers to naturally-occurring species or synthetic species formed from naturally-occurring subunits or their close homologs. The term may also refer to moieties that function similarly to oligonucleotides, but have non-naturally-occurring portions. Thus, oligonucleotides may have altered sugar moieties or inter-sugar linkages. Exemplary among these are phosphorothioate and other sulfur containing species which are known in the art.

As used herein, the terms "protein" and "polypeptide" are synonymous. "Peptides" are defined as fragments or portions of polypeptides, preferably fragments or portions having at least one functional activity (e.g., proteolysis, adhesion, fusion, antigenic, or intracellular activity) as the complete polypeptide sequence.

As used herein, "isolated" proteins or polypeptides are proteins or polypeptides purified to a state beyond that in which they exist in cells. In a preferred embodiment, they are at least 10% pure; i.e., most preferably they are substantially purified to 80 or 90% purity. "Isolated" proteins or polypeptides include proteins or polypeptides obtained by methods described infra, similar methods or other suitable methods, and include essentially pure proteins or polypeptides, proteins or polypeptides produced by chemical synthesis or by combinations of biological and chemical methods, and recombinant proteins or polypeptides which are isolated. Proteins or polypeptides referred to herein as "recombinant" are proteins or polypeptides produced by the expression of recombinant nucleic acids.

A "portion" as used herein with regard to a protein or polypeptide, refers to fragments of that protein or polypeptide. The fragments can range in size from 5 amino acid residues to all but one residue of the entire protein sequence. Thus, a portion or fragment can be at least 5, 5-50, 50-100, 100-200, 200-400, 400-800, or more consecutive amino acid residues of a chromosome 12q23-qter protein or polypeptide, for example, SEQ ID NO:93 to SEQ ID NO:155, or variants thereof.

The term "immunogenic", refers to the ability of a molecule (e.g., a polypeptide or peptide) to elicit a humoral and/or cellular immune response in a host animal.

The term "antigenic" refers to the ability of a molecule (e.g., a polypeptide or peptide) to bind to its specific antibody with sufficiently high affinity to form a detectable antigen-antibody complex.

"Antibodies" refer to polyclonal and/or monoclonal antibodies and fragments thereof, and immunologic binding equivalents thereof, that can bind to asthma proteins and fragments thereof or to nucleic acid sequences from the 12q23-qter region, particularly from the asthma locus or a portion thereof. The term antibody is used both to refer to a homogeneous molecular entity, or a mixture such as a serum product made up of a plurality of different molecular entities.

The term "monoclonal antibody" or "monoclonal antibody composition" as used herein, refers to a population of antibody molecules that contain only one species of an antigen binding site capable of immunoreacting with a particular epitope of a 12q23-qter polypeptide or peptide. A monoclonal antibody composition thus typically displays a single binding affinity for a particular 12q23-qter polypeptide or peptide with which it immunoreacts.

The term "ligand" as used herein describes any molecule, protein, peptide, or compound with the capability of directly or indirectly altering the physiological function, stability, or levels of a polypeptide.

A "sample" as used herein refers to a biological sample, such as, for example, tissue or fluid isolated from an individual (including, without limitation, plasma, serum, cerebrospinal fluid, lymph, tears, saliva, milk, pus, and tissue exudates and secretions) or from in vitro cell culture constituents, as well as samples obtained from, for example, a laboratory procedure.

As used herein, the term "ortholog" denotes a gene or polypeptide obtained from one species that has homology to an analogous gene or polypeptide from a different species. This is in contrast to "paralog", which denotes a gene or polypeptide obtained from a given species that has homology to a distinct gene or polypeptide from that same species.

Standard reference works setting forth the general principles of recombinant DNA technology include J. Sambrook et al., 1989, *Molecular Cloning: A Laboratory Manual*, 2d Ed., Cold Spring Harbor Laboratory Press, Cold Spring Harbor, N.Y.; P. B. Kaufman et al., (eds), 1995, *Handbook of Molecular and Cellular Methods in Biology and Medicine*, CRC Press, Boca Raton; M. J. McPherson (ed), 1991, *Directed Mutagenesis: A Practical Approach*, IRL Press, Oxford; J. Jones, 1992, *Amino Acid and Peptide Synthesis*, Oxford Science Publications, Oxford; B. M. Austen and O. M. R. Westwood, 1991, *Protein Targeting and Secretion*, IRL Press, Oxford; D. N Glover (ed), 1985, *DNA Cloning*, Volumes I and II; M. J. Gait (ed), 1984, *Oligonucleotide Synthesis*; B. D. Hames and S. J. Higgins (eds), 1984, *Nucleic Acid Hybridization*; Wu and Grossman (eds), *Methods in Enzymoloqy* (Academic Press, Inc.), Vol. 154 and Vol. 155; Quirke and Taylor (eds), 1991, *PCR-A Practical Approach*; Hames and Higgins (eds), 1984, *Transcription and Translation*; R. I. Freshney (ed), 1986, *Animal Cell Culture; Immobilized Cells and Enzymes*, 1986, IRL Press; Perbal, 1984, *A Practical Guide to Molecular Cloning*; J. H. Miller and M. P. Calos (eds), 1987, *Gene Transfer Vectors for Mammalian Cells*, Cold Spring Harbor Laboratory Press; M. J. Bishop (ed), 1998, *Guide to Human Genome Computing*, 2d Ed., Academic Press, San Diego, Calif.; L. F. Peruski and A. H. Peruski, 1997, *The Internet and the New Biology: Tools for Genomic and Molecular Research*, American Society for Microbiology, Washington, D.C.

Standard reference works setting forth the general principles of immunology include S. Sell, 1996, *Immunology, Immunopathology & Immunity*, 5th Ed., Appleton & Lange, Publ., Stamford, Conn.; D. Male et al., 1996, *Advanced Immunology*, 3d Ed., Times Mirror Int'l Publishers Ltd., Publ., London; D. P. Stites and A. I. Terr, 1991, *Basic and Clinical Immunology*, 7th Ed., Appleton & Lange, Publ., Norwalk, Conn.; and A. K. Abbas et al., 1991, *Cellular and Molecular Immunology*, W. B. Saunders Co., Publ., Philadelphia, Pa. Any suitable materials and/or methods known to those of skill can be utilized in carrying out the present invention; however, preferred materials and/or methods are described. Materials, reagents, and the like to which reference is made in the following description and examples are generally obtainable from commercial sources, and specific vendors are cited herein.

Nucleic Acids

The present invention relates to nucleic acids from chromosome 12q23-qter genes (Table 4; e.g., SEQ ID NO: 1 to SEQ ID NO:92, genomic DNA within BAC end sequences (e.g., SEQ ID NO:156 to SEQ ID NO:693), and genomic DNA of BAC sequences (e.g., SEQ ID NO:694 to SEQ ID NO:979), direct selected sequences (e.g., SEQ ID NO:980 to SEQ ID NO:1766), clusters (e.g., SEQ ID NO:1767 to SEQ ID NO:4687), RNA, fragments of the genomic, cDNA, or RNA nucleic acids comprising 20, 40, 60, 100, 200, 500 or more contiguous nucleotides, and the complements thereof. Closely related variants are also included as part of this invention, as well as recombinant nucleic acids comprising at least 50, 60, 70, 80, or 90% of the nucleic acids described above which would be identical to nucleic acids from chromosome 12q23-qter genes except for one or a few substitutions, deletions, or additions.

Further, the nucleic acids of this invention include the adjacent chromosomal regions of chromosome 12q23-qter genes required for accurate expression of the respective gene. In a preferred embodiment, the present invention is directed to at least 15 contiguous nucleotides of the nucleic acid sequence of any of SEQ ID NO:1 to SEQ ID NO:92 and SEQ ID NO:156 to SEQ ID NO:4687. More particularly, embodiments of this invention include the BAC clones containing segments of chromosome 12q23-qter genes including RPCI-11_0899A17, RPCI-11_0666B20, RPCI-11_0723P10, RPCI-11_0831E18, RPCI-11_0932D22, and RPCI-11_0702C13. A preferred embodiment is the nucleotide sequence of the BAC clones consisting of SEQ ID NO:694 to SEQ ID NO:979 and those listed in Table 3. Another embodiment is the nucleotide sequence of the BAC end sequences of SEQ ID NO:156 to SEQ ID NO:693.

The invention also relates to direct selected clones and EST's from the 12q23-qter (e.g., SEQ ID NO:1 to SEQ ID NO:92). In a preferred embodiment, the invention relates to clusters of nucleic acids combining the direct selected clones with EST's homologous to the BAC sequences and BAC end sequences (SEQ ID NO:1675 to SEQ ID NO:4594).

The invention also concerns the use of the nucleotide sequence of the nucleic acids of this invention to identify DNA probes for genes of 12q23-qter (SEQ ID NO:1 to SEQ ID NO:92), BAC end sequences (SEQ ID NO:156 to SEQ ID NO:693), BACs (SEQ ID NO:694 to SEQ ID NO:979), direct selected clones (SEQ ID NO:980 to SEQ ID NO:1766), and sequence clusters (SEQ ID NO:1767 to SEQ ID NO:4687), PCR primers to amplify the genes of 12q23-qter, nucleotide polymorphisms (Table 10), and regulatory elements of the genes of 12q23-qter.

This invention further relates to methods of using isolated and/or recombinant 12q23-qter nucleic acids (DNA or RNA) that are characterized by their ability to hybridize to (a) a nucleic acid encoding a protein or polypeptide, such as a nucleic acid having any of the sequences SEQ ID NO:1 to SEQ ID NO:92 and SEQ ID NO:156 to SEQ ID NO:4687, or (b) a fragment of the foregoing (e.g., any of the nucleotide sequences set forth in Tables 8, 9, 11A and 11B). For example, a fragment can comprise the minimum nucleotides of a chromosome 12q23-qter protein required to encode a functional chromosome 12q23-qter protein, or the minimum nucleotides to encode a polypeptide having the amino acid sequence of SEQ ID NO:93 to SEQ ID NO:155, or to encode a functional equivalent thereof. A functional equivalent can include a polypeptide, which, when incorporated into a cell, has all or part of the activity of a chromosome 12q23-qter protein. A functional equivalent of a chromosome 12q23-qter protein, therefore, would have a similar amino acid sequence (at least 65% sequence identity) and similar characteristics to, or perform in substantially the same way as a chromosome 12q23-qter protein. A nucleic acid which hybridizes to a nucleic acid encoding a chromosome 12q23-qter protein or polypeptide, such as SEQ ID NO:93 to SEQ ID NO:155, can be double- or single-stranded. Hybridization to DNA, such as DNA having a sequence set forth in SEQ ID NO:1 to SEQ ID NO:92, SEQ ID NO:156 to SEQ ID NO:4687, Tables 8, 9, 11A, and 11B, includes hybridization to the strand shown, or to the complementary strand.

The sequences of the present invention may be derived from a variety of sources including DNA, cDNA, synthetic DNA, synthetic RNA, or combinations thereof. Such sequences may comprise genomic DNA, which may or may not include naturally occurring introns. Moreover, such genomic DNA may be obtained in association with promoter regions or poly (A) sequences. The sequences, genomic DNA, or cDNA may be obtained in any of several ways. Genomic DNA can be extracted and purified from suitable cells by means well known in the art. Alternatively, mRNA can be isolated from a cell and used to produce cDNA by reverse transcription or other means.

The present invention also relates to nucleic acids that encode a polypeptide having the amino acid sequence of any one of SEQ ID NO:93 to SEQ ID NO:155, or functional equivalents thereof. A functional equivalent of a 12q23-qter protein includes fragments or variants that perform at least on characteristic function of the 12q23-qter protein (e.g., antigenic or intracellular activity). Preferably, a functional equivalent will share at least 65% sequence identity with the 12q23-qter polypeptide.

Sequence identity calculations can be performed using computer programs, hybridization methods, or calculations. Preferred computer program methods to determine identity and similarity between two sequences include, but are not limited to, the GCG program package, BLASTN, BLASTX, TBLASTX, and FASTA (J. Devereux et al., 1984, *Nucleic Acids Research* 12(1):387; S. F. Altschul et al., 1990, *J. Molec. Biol.* 215:403-410; W. Gish and D. J. States, 1994, *Nature Genet.* 3:266-272; W. R. Pearson and D. J. Lipman, 1988, *Proc Natl. Acad. Sci. USA* 85(8):2444-8). The BLAST programs are publicly available from NCBI and other sources. The well-known Smith Waterman algorithm may also be used to determine identity.

For example, nucleotide sequence identity can be determined by comparing a query sequences to sequences in publicly available sequence databases (NCBI) using the BLASTN2 algorithm (S. F. Altschul et al., 1997, *Nucl. Acids Res.*, 25:3389-3402). The parameters for a typical search are: E=0.05, v=50, B=50, wherein E is the expected probability score cutoff, V is the number of database entries returned in the reporting of the results, and B is the number of sequence alignments returned in the reporting of the results (S. F. Altschul et al., 1990, *J. Mol. Biol.*, 215:403-410).

In another approach, nucleotide sequence identity can be calculated using the following equation: % identity=(number of identical nucleotides)/(alignment length in nucleotides)*100. For this calculation, alignment length includes internal gaps but not includes terminal gaps. Alternatively, nucleotide sequence identity can be determined experimentally using the specific hybridization conditions described below.

In accordance with the present invention, polynucleotide alterations are selected from the group consisting of at least one nucleotide deletion, substitution, including transition and transversion, insertion, or modification (e.g., via RNA or DNA analogs). Alterations may occur at the 5' or 3' terminal positions of the reference nucleotide sequence or anywhere between those terminal positions, interspersed either individually among the nucleotides in the reference sequence or in one or more contiguous groups within the reference sequence. Alterations of a polynucleotide sequence of any one of SEQ ID NO:1 to SEQ ID NO:92 and SEQ ID NO:156 to SEQ ID NO:4687 may create nonsense, missense, or frameshift mutations in this coding sequence, and thereby alter the polypeptide encoded by the polynucleotide following such alterations.

Such altered nucleic acids, including DNA or RNA, can be detected and isolated by hybridization under high stringency conditions or moderate stringency conditions, for example, which are chosen to prevent hybridization of nucleic acids having non-complementary sequences. "Stringency conditions" for hybridizations is a term of art which refers to the conditions of temperature and buffer concentration which permit hybridization of a particular nucleic acid to another nucleic acid in which the first nucleic acid may be perfectly complementary to the second, or the first and second may share some degree of complementarity which is less than perfect.

For example, certain high stringency conditions can be used which distinguish perfectly complementary nucleic acids from those of less complementarity. "High stringency conditions" and "moderate stringency conditions" for nucleic acid hybridizations are explained in F. M. Ausubel et al. (eds), 1995, *Current Protocols in Molecular Biology*, John Wiley and Sons, Inc., New York, N.Y., the teachings of which are hereby incorporated by reference. In particular, see pages 2.10.1-2.10.16 (especially pages 2.10.8-2.10.11) and pages 6.3.1-6.3.6. The exact conditions which determine the stringency of hybridization depend not only on ionic strength, temperature and the concentration of destabilizing agents such as formamide, but also on factors such as the length of the nucleic acid sequence, base composition, percent mismatch between hybridizing sequences and the frequency of occurrence of subsets of that sequence within other non-identical sequences. Thus, high or moderate stringency conditions can be determined empirically.

By varying hybridization conditions from a level of stringency at which no hybridization occurs to a level at which hybridization is first observed, conditions which will allow a given sequence to hybridize with the most similar sequences in the sample can be determined. Preferably the hybridizing sequences will have 60-70% sequence identity, more preferably 70-85% sequence identity, and even more preferably 90-100% sequence identity.

Typically, the hybridization reaction is initially performed under conditions of low stringency, followed by washes of varying, but higher stringency. Reference to hybridization stringency, e.g., high, moderate, or low stringency, typically relates to such washing conditions. Hybridization conditions are based on the melting temperature ($T_m$) of the nucleic acid probe or primer and are typically classified by degree of stringency of the conditions under which hybridization is measured (Ausubel et al., 1995). For example, high stringency hybridization typically occurs at about 5-10% C below the $T_m$; moderate stringency hybridization occurs at about 10-20% below the $T_m$; and low stringency hybridization occurs at about 20-25% below the $T_m$. The melting temperature can be approximated by the formulas as known in the art, depending on a number of parameters, such as the length of the hybrid or probe in number of nucleotides, or hybridization buffer ingredients and conditions. As a general guide, $T_m$ decreases approximately 1° C. with every 1% decrease in sequence identity at any given SSC concentration. Generally, doubling the concentration of SSC results in an increase in $T_m$ of ~17° C. Using these guidelines, the washing temperature can be determined empirically for moderate or low stringency, depending on the level of mismatch sought.

High stringency hybridization conditions are typically carried out at 65 to 68° C. in 0.1×SSC and 0.1% SDS. Highly stringent conditions allow hybridization of nucleic acid molecules having about 95 to 100% sequence identity. Moderate stringency hybridization conditions are typically carried out at 50 to 65° C. in 1×SSC and 0.1% SDS. Moderate stringency conditions allow hybridization of sequences having at least 80 to 95% nucleotide sequence identity. Low stringency hybridization conditions are typically carried out at 40 to 50° C. in 6×SSC and 0.1% SDS. Low stringency hybridization conditions allow detection of specific hybridization of nucleic acid molecules having at least 50 to 80% nucleotide sequence identity.

For example, high stringency conditions can be attained by hybridization in 50% formamide, 5×Denhardt's solution, 5×SSPE or SSC (1×SSPE buffer comprises 0.15 M NaCl, 10 mM Na$_2$HPO$_4$, 1 mM EDTA; 1×SSC buffer comprises 150 mM NaCl, 15 mM sodium citrate, pH 7.0), 0.2% SDS at about 42° C., followed by washing in 1×SSPE or SSC and 0.1% SDS at a temperature of at least 42° C., preferably about 55° C., more preferably about 65° C. Moderate stringency conditions can be attained, for example, by hybridization in 50% formamide, 5×Denhardt's solution, 5×SSPE or SSC, and 0.2% SDS at 42° C. to about 50° C., followed by washing in 0.2×SSPE or SSC and 0.2% SDS at a temperature of at least 42° C., preferably about 55° C., more preferably about 65° C. Low stringency conditions can be attained, for example, by hybridization in 10% formamide, 5×Denhardt's solution, 6×SSPE or SSC, and 0.2% SDS at 42° C., followed by washing in 1×SSPE or SSC, and 0.2% SDS at a temperature of about 45° C., preferably about 50° C. in 4×SSC at 60° C. for 30 min.

High stringency hybridization procedures typically (1) employ low ionic strength and high temperature for washing, such as 0.015 M NaCl/0.0015 M sodium citrate, pH 7.0 (0.1×SSC) with 0.1% sodium dodecyl sulfate (SDS) at 50° C.; (2) employ during hybridization 50% (vol/vol) formamide with 5×Denhardt's solution (0.1% weight/volume highly purified bovine serum albumin/0.1% wt/vol Ficoll/0.1% wt/vol polyvinylpyrrolidone), 50 mM sodium phosphate buffer at pH 6.5 and 5×SSC at 42° C.; or (3) employ hybridization with 50% formamide, 5×SSC, 50 mM sodium phosphate (pH 6.8)0.1% sodium pyrophosphate, 5×Denhardt's solution, sonicated salmon sperm DNA (50 μg/ml), 0.1% SDS, and 10% dextran sulfate at 42° C., with washes at 42° C. in 0.2×SSC and 0.1% SDS.

In one particular embodiment, high stringency hybridization conditions may be attained by:
Prehybridization treatment of the support (e.g., nitrocellulose filter or nylon membrane), to which is bound the nucleic acid capable of hybridizing with any of the sequences of the invention, is carried out at 65° C. for 6 hr with a solution having the following composition: 4×SSC, 10×Denhardt's (1×Denhardt's comprises 1% Ficoll, 1% polyvinylpyrrolidone, 1% BSA (bovine serum albumin); 1×SSC comprises of 0.15 M of NaCl and 0.015 M of sodium citrate, pH 7);
Replacement of the pre-hybridization solution in contact with the support by a buffer solution having the following composition: 4×SSC, 1×Denhardt's, 25 mM NaPO$_4$, pH 7, 2 mM EDTA, 0.5% SDS, 100 μg/ml of sonicated salmon sperm DNA containing a nucleic acid derived from the sequences of the invention as probe, in particular a radioactive probe, and previously denatured by a treatment at 100° C. for 3 min;
Incubation for 12 hr at 65° C.;
Successive washings with the following solutions: 1) four washings with 2×SSC, 1×Denhardt's, 0.5% SDS for 45 min at 65° C.; 2) two washings with 0.2×SSC, 0.1×SSC for 45 min at 65° C.; and 3) 0.1×SSC, 0.1% SDS for 45 min at 65° C.

Additional examples of high, medium, and low stringency conditions can be found in Sambrook et al., 1989. Exemplary conditions are also described in M. H. Krause and S. A. Aaronson, 1991, *Methods in Enzymology*, 200:546-556; Ausubel et al., 1995. It is to be understood that the low, moderate and high stringency hybridization/washing conditions may be varied using a variety of ingredients, buffers, and temperatures well known to and practiced by the skilled practitioner.

Isolated and/or recombinant nucleic acids that are characterized by their ability to hybridize to a) a nucleic acid encoding a chromosome 12q23-qter polypeptide, such as the nucleic acids depicted as SEQ ID NO:1 to SEQ ID NO:92; b) the complement of (a); c) or a portion of (a) or (b) (e.g., under high or moderate stringency conditions), may further encode a protein or polypeptide having at least one function characteristic of a chromosome 12q23-qter polypeptide, such as Gene 702, a metalloprototease-like gene involved in inflammatory responses including tissue destruction and repair, or binding of antibodies that also bind to non-recombinant chromosome 12q23-qter proteins or polypeptides. The catalytic or binding function of a protein or polypeptide encoded by the hybridizing nucleic acid may be detected by standard enzymatic assays for activity or binding (e.g., assays that measure the binding of a transit peptide or a precursor, or other components of the translocation machinery). Enzymatic assays, complementation tests, or other suitable methods can also be used in procedures for the identification and/or isolation of nucleic acids which encode a polypeptide such as a polypeptide of the amino acid sequences SEQ ID NO:93 to SEQ ID NO:155, or a functional equivalent of these polypeptides. The antigenic properties of proteins or polypeptides encoded by hybridizing nucleic acids can be determined by immunological methods employing antibodies that bind to a chromosome 12q23-qter polypeptide such as immunoblot, immunoprecipitation and radioimmunoassay. PCR methodology, including RAGE (Rapid Amplification of Genomic DNA Ends), can also be used to screen for and detect the presence of nucleic acids which encode chromosome 12q23-qter gene-like proteins and polypeptides, and to assist in cloning such nucleic acids from genomic DNA. PCR methods for these purposes can be found in Innis, M. A., et al., 1990, *PCR Protocols: A Guide to Methods and Applications*, Academic Press, Inc., San Diego, Calif., incorporated herein by reference.

It is understood that, as a result of the degeneracy of the genetic code, many nucleic acid sequences are possible which encode a chromosome 12q23-qter gene-like protein or polypeptide. Some of these will have little homology to the nucleotide sequences of any known or naturally-occurring chromosome 12q23-qter gene-like gene but can be used to produce the proteins and polypeptides of this invention by selection of combinations of nucleotide triplets based on codon choices. Such variants, while not hybridizable to a naturally-occurring chromosome 12q23-qter gene, are contemplated within this invention.

Also encompassed by the present invention are alternate splice variants produced by differential processing of the primary transcript(s) from 12q23-qter genomic DNA. An alternate splice variant may comprise, for example, the sequence of any one of SEQ ID NO:1 to SEQ ID NO:5; SEQ ID NO:17 to SEQ ID NO:18; SEQ ID NO:36 to SEQ ID NO:37; SEQ ID NO:43 to SEQ ID NO:44; and SEQ ID NO:80 to SEQ ID NO:81. Alternate splice variants can also comprise other combinations of introns/exons of 12q23-qter genes, which can be determined by those of skill in the art. Alternate splice variants can be determined experimentally, for example, by isolating and analyzing cellular RNAs (e.g., Southern blotting or PCR), or by screening cDNA libraries using the 12q23-qter nucleic acid probes or primers described herein. In another approach, alternate splice variants can be predicted using various methods, computer programs, or computer systems available to practitioners in the field.

General methods for splice site prediction can be found in Nakata, 1985, *Nucleic Acids Res.* 13:5327-5340. In addition, splice sites can be predicted using, for example, the GRAIL™ (E. C. Uberbacher and R. J. Mural, 1991, *Proc. Natl. Acad. Sci. USA,* 88:11261-11265; E. C. Uberbacher, 1995, *Trends Biotech.,* 13:497-500); GenView (L. Milanesi et al., 1993, *Proceedings of the Second International Conference on Bioinformatics, Supercomputing, and Complex Genome Analysis*, H. A. Lim et al. (eds), World Scientific Publishing, Singapore, pp. 573-588); SpliceView (The Institute of Biomedical Technologies I.T.B.; Italy); and HSPL (V. V. Solovyev et al., 1994, *Nucleic Acids Res.* 22:5156-5163; V. V. Solovyev et al., 1994, "The Prediction of Human Exons by Oligonucleotide Composition and Discriminant Analysis of Spliceable Open Reading Frames," R. Altman et al. (eds), *The Second International conference on Intelligent systems for Molecular Biology*, AAAI Press, Menlo Park, Calif., pp. 354-362; V. V. Solovyev et al., 1993, "Identification Of Human Gene Functional Regions Based On Oligonucleotide Composition," L. Hunter et al. (eds), *In Proceedings of First International conference on Intelligent System for Molecular Biology*, Bethesda, pp. 371-379) computer systems.

Additionally, computer programs such as GeneParser (E. E. Snyder and G. D. Stormo, 1995, *J. Mol. Biol.* 248: 1-18; E. E. Snyder and G. D. Stormo, 1993, *Nucl. Acids Res.* 21(3): 607-613; Boulder, Colo.); MZEF (M. Q. Zhang, 1997, *Proc. Natl. Acad. Sci. USA,* 94:565-568 Cold Spring Harbor Laboratory; Cold Spring Harbor, N.Y.); MORGAN (S. Salzberg et al., 1998, *J. Comp. Biol.* 5:667-680; S. Salzberg et al. (eds), 1998, *Computational Methods in Molecular Biology*, Elsevier Science, New York, N.Y., pp. 187-203); VEIL (J. Henderson et al., 1997, *J. Comp. Biol.* 4:127-141); GeneScan (S. Tiwari et al., 1997, *CABIOS (BioInformatics)* 13: 263-270); GeneBuilder (L. Milanesi et al., 1999, *Bioinformatics* 15:612-621); Eukaryotic GeneMark (J. Besemer et al., 1999, *Nucl. Acids Res.* 27:3911-3920); and FEXH (V. V. Solovyev et al., 1994, *Nucleic Acids Res.* 22:5156-5163). In addition, splice sites (i.e., former or potential splice sites) in cDNA sequences can be predicted using, for example, the RNASPL (V. V. Solovyev et al., 1994, *Nucleic Acids Res.* 22:5156-5163); or INTRON (A. Globek et al., 1991, INTRON version 1.1 manual, Laboratory of Biochemical Genetics, NIMH, Washington, D.C.) programs.

The present invention also encompasses naturally-occurring polymorphisms of 12q23-qter genes. As will be understood by those in the art, the genomes of all organisms undergo spontaneous mutation in the course of their continuing evolution generating variant forms of gene sequences (Gusella, 1986, *Ann. Rev. Biochem.* 55:831-854). Restriction fragment length polymorphisms (RFLPs) include variations in DNA sequences that alter the length of a restriction fragment in the sequence (Botstein et al., 1980, *Am. J. Hum. Genet.* 32, 314-331). RFLPs have been widely used in human and animal genetic analyses (see WO 90/13668; WO90/11369; Donis-Keller, 1987, *Cell* 51:319-337; Lander et al., 1989, *Genetics* 121: 85-99). Short tandem repeats (STRs) include tandem di-, tri- and tetranucleotide repeated motifs, also termed variable number tandem repeat (VNTR) polymorphisms. VNTRs have been used in identity and paternity analysis (U.S. Pat. No. 5,075,217; Armour et al., 1992, *FEBS Lett.* 307:113-115; Horn et al., WO 91/14003; Jeffreys, E P 370,719), and in a large number of genetic mapping studies.

Single nucleotide polymorphisms (SNPs) are far more frequent than RFLPS, STRs, and VNTRs. SNPs may occur in protein coding (e.g., exon), or non-coding (e.g., intron, 5'UTR, 3'UTR) sequences. SNPs in protein coding regions may comprise silent mutations that do not alter the amino acid sequence of a protein. Alternatively, SNPs in protein coding regions may produce conservative or non-conservative amino acid changes, described in detail below. In some cases, SNPs may give rise to the expression of a defective or other variant protein and, potentially, a genetic disease. SNPs within protein-coding sequences can give rise to genetic diseases, for example, in the β-globin (sickle cell anemia) and CFTR (cystic fibrosis) genes. In non-coding sequences, SNPs may also result in defective protein expression (e.g., as a result of defective splicing). Other single nucleotide polymorphisms have no phenotypic effects.

Single nucleotide polymorphisms can be used in the same manner as RFLPs and VNTRs, but offer several advantages. Single nucleotide polymorphisms tend to occur with greater frequency and are typically spaced more uniformly throughout the genome than other polymorphisms. Also, different SNPs are often easier to distinguish than other types of polymorphisms (e.g., by use of assays employing allele-specific hybridization probes or primers). In one embodiment of the present invention, a 12q23-qter nucleic acid contains at least one SNP as set forth in Table 10, FIGS. 7A-7H; FIGS. 9A-9F; FIGS. 27A-27K; and FIGS. 28A-28C, described herein. Various combinations of these SNPs are also encompassed by the invention. In a preferred aspect, a 12q23-qter SNP is associated with a lung-related disorder, such as asthma. Nucleic acids comprising such SNPs can be used as diagnostic and/or therapeutic reagents.

The nucleic acid sequences of the present invention may be derived from a variety of sources including DNA, cDNA, synthetic DNA, synthetic RNA, or combinations thereof. Such sequences may comprise genomic DNA, which may or may not include naturally occurring introns. Moreover, such genomic DNA may be obtained in association with promoter regions or poly(A)+ sequences. The sequences, genomic DNA, or cDNA may be obtained in any of several ways. Genomic DNA can be extracted and purified from suitable cells by means well known in the art. Alternatively, mRNA can be isolated from a cell and used to produce cDNA by reverse transcription or other means.

The nucleic acids described herein are used in the methods of the present invention for production of proteins or polypeptides, through incorporation into cells, tissues, or organisms. In one embodiment, DNA containing all or part of the coding sequence for a 12q23-qter polypeptide, or DNA which hybridizes to DNA having the sequence of any one of SEQ ID NO:1 to SEQ ID NO:92 and SEQ ID NO:156 to SEQ ID NO:4687, or a fragment thereof, is incorporated into a vector for expression of the encoded polypeptide in suitable host cells. The encoded amino acid sequence consisting of a 12q23-qter polypeptide, or its functional equivalent is capable of normal activity, such as antigenic or intracellular activity.

The invention also concerns the use of the nucleotide sequence of the nucleic acids of this invention to identify DNA probes for 12q23-qter genes, PCR primers to amplify 12q23-qter genes, nucleotide polymorphisms in 12q23-qter genes, and regulatory elements of 12q23-qter genes.

The nucleic acids of the present invention find use as primers and templates for the recombinant production of disorder-associated peptides or polypeptides, for chromosome and gene mapping, to provide antisense sequences, for tissue distribution studies, to locate and obtain full length genes, to identify and obtain homologous sequences (wild-type and mutants), and in diagnostic applications. The primers of this invention may comprise all or a portion of the nucleotide sequence of any one of SEQ ID NO:1 to SEQ ID NO:92, SEQ ID NO:156 to SEQ ID NO:4687, and the sequences set forth in Tables 8, 9, 11A, and 11B, or a complementary sequence thereof.

Probes may also be used for the detection of 12q23-qter-related sequences, and should preferably contain at least 50%, preferably at least 80%, identity to a 12q23-qter polynucleotide, or a complementary sequence, or fragments thereof. The probes of this invention may be DNA or RNA, the probes may comprise all or a portion of the nucleotide sequence of any one of SEQ ID NO:1 to SEQ ID NO:92, SEQ ID NO:156 to SEQ ID NO:4687, and the sequences set forth in Tables 8, 9, 11A, and 11B, or a complementary sequence thereof, and may include promoter, enhancer elements, and introns of the naturally occurring 12q23-qter polynucleotide.

The probes and primers based on the 12q23-qter gene sequences disclosed herein are used to identify homologous 12q23-qter gene sequences and proteins in other species. These 12q23-qter gene sequences and proteins are used in the diagnostic/prognostic, therapeutic and drug-screening methods described herein for the species from which they have been isolated.

Vectors and Host Cells

The nucleic acids described herein are used in the methods of the present invention for production of proteins or polypeptides, through incorporation into cells, tissues, or organisms. In one embodiment, DNA containing all or part of the coding sequence for a chromosome 12q23-qter polypeptide, or DNA which hybridizes to DNA having the sequence SEQ ID NO:1 to SEQ ID NO:92 and SEQ ID NO: 156 to SEQ ID NO:4687, is incorporated into a vector for expression of the encoded polypeptide in suitable host cells. The encoded polypeptides consisting of chromosome 12q23-qter genes, or their functional equivalents are capable of normal activity, such as Gene 702, a metalloprotease-like gene involved in inflammatory responses including tissue destruction and repair. A large number of vectors, including bacterial, yeast, and mammalian vectors, have been described for replication and/or expression in various host cells or cell-free systems, and may be used for gene therapy as well as for simple cloning or protein expression.

In one aspect, an expression vectors comprises a nucleic acid encoding a 12q23-qter polypeptide or peptide, as described herein, operably linked to at least one regulatory sequence. Regulatory sequences are known in the art and are selected to direct expression of the desired protein in an appropriate host cell. Accordingly, the term regulatory sequence includes promoters, enhancers and other expression control elements (see D. V. Goeddel, 1990, *Methods Enzymol.* 185:3-7). Enhancer and other expression control sequences are described in *Enhancers and Eukaryotic Gene Expression,* 1983, Cold Spring Harbor Press, Cold Spring Harbor, N.Y. It should be understood that the design of the expression vector may depend on such factors as the choice of the host cell to be transfected and/or the type of polypeptide to be expressed.

Several regulatory elements (e.g., promoters) have been isolated and shown to be effective in the transcription and translation of heterologous proteins in the various hosts. Such regulatory regions, methods of isolation, manner of manipulation, etc. are known in the art. Non-limiting examples of bacterial promoters include the β-lactamase (penicillinase) promoter; lactose promoter; tryptophan (trp) promoter; ara-BAD (arabinose) operon promoter; lambda-derived $P_1$ promoter and N gene ribosome binding site; and the hybrid tac promoter derived from sequences of the trp and lac UV5 promoters. Non-limiting examples of yeast promoters include the 3-phosphoglycerate kinase promoter, glyceraldehyde-3-phosphate dehydrogenase (GAPDH) promoter, galactokinase (GAL1) promoter, galactoepimerase promoter, and alcohol dehydrogenase (ADH1) promoter. Suitable promoters for mammalian cells include, without limitation, viral promoters, such as those from Simian Virus 40 (SV40), Rous sarcoma virus (RSV), adenovirus (ADV), and bovine papilloma virus (BPV). Preferred replication and inheritance systems include M13, ColE1, SV40, baculovirus, lambda, adenovirus, CEN ARS, 2 μm ARS and the like. While expression vectors may replicate autonomously, they may also replicate by being inserted into the genome of the host cell, by methods well known in the art.

To obtain expression in eukaryotic cells, terminator sequences, polyadenylation sequences, and enhancer sequences that modulate gene expression may be required. Sequences that cause amplification of the gene may also be desirable. These sequences are well known in the art. Furthermore, sequences that facilitate secretion of the recombinant product from cells, including, but not limited to, bacteria, yeast, and animal cells, such as secretory signal sequences and/or preprotein or proprotein sequences, may also be included. Such sequences are well described in the art.

Expression and cloning vectors will likely contain a selectable marker, a gene encoding a protein necessary for survival or growth of a host cell transformed with the vector. The presence of this gene ensures growth of only those host cells that express the inserts. Typical selection genes encode proteins that 1) confer resistance to antibiotics or other toxic substances, e.g., ampicillin, neomycin, methotrexate, etc.; 2) complement auxotrophic deficiencies, or 3) supply critical nutrients not available from complex media, e.g., the gene encoding D-alanine racemase for Bacilli. Markers may be an inducible or non-inducible gene and will generally allow for positive selection. Non-limiting examples of markers include the ampicillin resistance marker (i.e., beta-lactamase), tetracycline resistance marker, neomycin/kanamycin resistance marker (i.e., neomycin phosphotransferase), dihydrofolate reductase, glutamine synthetase, and the like. The choice of the proper selectable marker will depend on the host cell, and appropriate markers for different hosts as understood by those of skill in the art.

Suitable expression vectors for use with the present invention include, but are not limited to, pUC, pBluescript (Stratagene), pET (Novagen, Inc., Madison, Wis.), and pREP (Invitrogen) plasmids. Vectors can contain one or more replication and inheritance systems for cloning or expression, one or more markers for selection in the host, e.g., antibiotic resistance, and one or more expression cassettes. The inserted coding sequences can be synthesized by standard methods, isolated from natural sources, or prepared as hybrids. Ligation of the coding sequences to transcriptional regulatory elements (e.g., promoters, enhancers, and/or insulators) and/or to other amino acid encoding sequences can be carried out using established methods.

Suitable cell-free expression systems for use with the present invention include, without limitation, rabbit reticulocyte lysate, wheat germ extract, canine pancreatic microsomal membranes, *E. coli* S30 extract, and coupled transcription/translation systems (Promega Corp., Madison, Wis.). These systems allow the expression of recombinant polypeptides or peptides upon the addition of cloning vectors, DNA fragments, or RNA sequences containing protein-coding regions and appropriate promoter elements.

Non-limiting examples of suitable host cells include bacteria, archea, insect, fungi (e.g., yeast), plant, and animal cells (e.g., mammalian, especially human). Of particular interest are *Escherichia coli, Bacillus subtilis, Saccharomyces cerevi-*

*siae*, SF9 cells, C129 cells, 293 cells, *Neurospora*, and immortalized mammalian myeloid and lymphoid cell lines. Techniques for the propagation of mammalian cells in culture are well-known (see, Jakoby and Pastan (eds), 1979, *Cell Culture. Methods in Enzymology*, volume 58, Academic Press, Inc., Harcourt Brace Jovanovich, N.Y.). Examples of commonly used mammalian host cell lines are VERO and HeLa cells, CHO cells, and WI38, BHK, and COS cell lines, although it will be appreciated by the skilled practitioner that other cell lines may be used, e.g., to provide higher expression of desirable glycosylation patterns, or other features.

Host cells can be transformed, transfected, or infected as appropriate by any suitable method including electroporation, calcium chloride-, lithium chloride-, lithium acetate/polyethylene glycol-, calcium phosphate-, DEAE-dextran-, liposome-mediated DNA uptake, spheroplasting, injection, microinjection, microprojectile bombardment, phage infection, viral infection, or other established methods. Alternatively, vectors containing the nucleic acids of interest can be transcribed in vitro, and the resulting RNA introduced into the host cell by well-known methods, e.g., by injection (see, Kubo et al., 1988, *FEBS Letts.* 241:119). The cells into which have been introduced nucleic acids described above are meant to also include the progeny of such cells.

The nucleic acids of the invention may be isolated directly from cells. Alternatively, the polymerase chain reaction (PCR) method can be used to produce the nucleic acids of the invention, using either RNA (e.g., mRNA) or DNA (e.g., genomic DNA) as templates. Primers used for PCR can be synthesized using the sequence information provided herein and can further be designed to introduce appropriate new restriction sites, if desirable, to facilitate incorporation into a given vector for recombinant expression.

Using the information provided in SEQ ID NO:1 to SEQ ID NO:92 and SEQ ID NO:156 to SEQ ID NO:4687, one skilled in the art will be able to clone and sequence all representative nucleic acids of interest, including nucleic acids encoding complete protein-coding sequences. It is to be understood that non-protein-coding sequences contained within SEQ ID NO:156 to SEQ ID NO:693 and SEQ ID NO:694 to SEQ ID NO:979 are also within the scope of the invention. Such sequences include, without limitation, sequences important for replication, recombination, transcription, and translation. Non-limiting examples include promoters and regulatory binding sites involved in regulation of gene expression, and 5'- and 3'-untranslated sequences (e.g., ribosome-binding sites) that form part of mRNA molecules.

The nucleic acids of this invention can be produced in large quantities by replication in a suitable host cell. Natural or synthetic nucleic acid fragments, comprising at least ten contiguous bases coding for a desired peptide or polypeptide can be incorporated into recombinant nucleic acid constructs, usually DNA constructs, capable of introduction into and replication in a prokaryotic or eukaryotic cell. Usually the nucleic acid constructs will be suitable for replication in a unicellular host, such as yeast or bacteria, but may also be intended for introduction to (with and without integration within the genome) cultured mammalian or plant or other eukaryotic cells, cell lines, tissues, or organisms. The purification of nucleic acids produced by the methods of the present invention is described, for example, in Sambrook et al., 1989; F. M. Ausubel et al., 1992, *Current Protocols in Molecular Biology*, J. Wiley and Sons, New York, N.Y.

The nucleic acids of the present invention can also be produced by chemical synthesis, e.g., by the phosphoramidite method described by Beaucage et al., 1981, *Tetra. Letts.* 22:1859-1862, or the triester method according to Matteucci et al., 1981, *J. Am. Chem. Soc.*, 103:3185, and can performed on commercial, automated oligonucleotide synthesizers. A double-stranded fragment may be obtained from the single-stranded product of chemical synthesis either by synthesizing the complementary strand and annealing the strands together under appropriate conditions or by adding the complementary strand using DNA polymerase with an appropriate primer sequence.

These nucleic acids can encode full-length variant forms of proteins as well as the wild-type protein. The variant proteins (which could be especially useful for detection and treatment of disorders) will have the variant amino acid sequences encoded by the polymorphisms described in Table 10, when said polymorphisms are read so as to be in-frame with the full-length coding sequence of which it is a component.

Large quantities of the nucleic acids and proteins of the present invention may be prepared by expressing the 12q23-qter nucleic acids or portions thereof in vectors or other expression vectors in compatible prokaryotic or eukaryotic host cells. The most commonly used prokaryotic hosts are strains of *Escherichia coli*, although other prokaryotes, such as *Bacillus subtilis* or *Pseudomonas* may also be used. Mammalian or other eukaryotic host cells, such as those of yeast, filamentous fungi, plant, insect, or amphibian or avian species, may also be useful for production of the proteins of the present invention. For example, insect cell systems (i.e., lepidopteran host cells and baculovirus expression vectors) are particularly suited for large-scale protein production.

Host cells carrying an expression vector (i.e., transformants or clones) are selected using markers depending on the mode of the vector construction. The marker may be on the same or a different DNA molecule, preferably the same DNA molecule. In prokaryotic hosts, the transformant may be selected, e.g., by resistance to ampicillin, tetracycline or other antibiotics. Production of a particular product based on temperature sensitivity may also serve as an appropriate marker.

Prokaryotic or eukaryotic cells comprising the nucleic acids of the present invention will be useful not only for the production of the nucleic acids and proteins of the present invention, but also, for example, in studying the characteristics of 12q23-qter proteins. Cells and animals that carry a 12q23-qter gene can be used as model systems to study and test for substances that have potential as therapeutic agents. The cells are typically cultured mesenchymal stem cells. These may be isolated from individuals with a somatic or germline 12q23-qter gene. Alternatively, the cell line can be engineered to carry a 12q23-qter gene, as described above. After a test substance is applied to the cells, the transformed phenotype of the cell is determined. Any trait of transformed cells can be assessed, including respiratory diseases including asthma, atopy, and response to application of putative therapeutic agents.

Antisense Nucleic Acids

A further embodiment of the invention is antisense nucleic acids or oligonucleotides which are complementary, in whole or in part, to a target molecule comprising a sense strand, and can hybridize with the target molecule. The target can be DNA, or its RNA counterpart (i.e., wherein T residues of the DNA are U residues in the RNA counterpart). When introduced into a cell, antisense nucleic acids or oligonucleotides can inhibit the expression of the gene encoded by the sense strand or the mRNA transcribed from the sense strand. Antisense nucleic acids can be produced by standard techniques. See, for example, Shewmaker, et al., U.S. Pat. No. 5,107,065.

In a particular embodiment, an antisense nucleic acid or oligonucleotide is wholly or partially complementary to and can hybridize with a target nucleic acid (either DNA or RNA), wherein the target nucleic acid can hybridize to a nucleic acid having the sequence of the complement of the strands in SEQ ID NO:1 to SEQ ID NO:92 and SEQ ID NO:156 to SEQ ID NO:4687. For example, an antisense nucleic acid or oligonucleotide can be complementary to a target nucleic acid having the sequence shown as the strand of the open reading frames SEQ ID NO:1 to SEQ ID NO:92 and SEQ ID NO:156 to SEQ ID NO:4687 or nucleic acids encoding functional equivalents of chromosome 12q23-qter genes, or to a portion of these nucleic acids sufficient to allow hybridization. A portion, for example a sequence of 16 nucleotides, could be sufficient to inhibit expression of the protein. Or, an antisense nucleic acid or oligonucleotide, complementary to 5' or 3' untranslated regions, or overlapping the translation initiation codons (5' untranslated and translated regions), of chromosome 12q23-qter genes, or genes encoding a functional equivalent can also be effective. In another embodiment, the antisense nucleic acid is wholly or partially complementary to and can hybridize with a target nucleic acid that encodes a chromosome 12q23-qter polypeptide.

In addition to the antisense nucleic acids of the invention, oligonucleotides can be constructed which will bind to duplex nucleic acids either in the genes or the DNA:RNA complexes of transcription, to form stable triple helix-containing or triplex nucleic acids to inhibit transcription and/or expression of a gene encoding a chromosome 12q23-qter gene, or their functional equivalents (Frank-Kamenetskii, M. D. and Mirkin, S. M., 1995, *Ann. Rev. Biochem.* 64:65-95). Such oligonucleotides of the invention are constructed using the base-pairing rules of triple helix formation and the nucleotide sequences of the genes or mRNAs for chromosome 12q23-qter genes.

In preferred embodiments, at least one of the phosphodiester bonds of an antisense oligonucleotide has been substituted with a structure that functions to enhance the ability of the compositions to penetrate into the region of cells where the RNA whose activity is to be modulated is located. It is preferred that such substitutions comprise phosphorothioate bonds, methyl phosphonate bonds, or short chain alkyl or cycloalkyl structures. In accordance with other preferred embodiments, the phosphodiester bonds are substituted with structures which are, at once, substantially non-ionic and non-chiral, or with structures which are chiral and enantiomerically specific. Persons of ordinary skill in the art will be able to select other linkages for use in the practice of the invention.

Oligonucleotides may also include species that include at least some modified base forms. Thus, purines and pyrimidines other than those normally found in nature may be so employed. Similarly, modifications on the furanosyl portions of the nucleotide subunits may also be effected, as long as the essential tenets of this invention are adhered to. Examples of such modifications are 2'-O-alkyl- and 2'-halogen-substituted nucleotides. Some non-limiting examples of modifications at the 2' position of sugar moieties which are useful in the present invention include OH, SH, $SCH_3$, F, $OCH_3$, OCN, $O(CH_2)$, $NH_2$ and $O(CH_2)$, $CH_3$, where n is from 1 to about 10. Such oligonucleotides are functionally interchangeable with natural oligonucleotides or synthesized oligonucleotides, which have one or more differences from the natural structure. All such analogs are comprehended by this invention so long as they function effectively to hybridize with a 12q23-qter nucleic acid to inhibit the function thereof.

The oligonucleotides in accordance with this invention preferably comprise from about 3 to about 50 subunits. It is more preferred that such oligonucleotides and analogs comprise from about 8 to about 25 subunits and still more preferred to have from about 12 to about 20 subunits. As defined herein, a "subunit" is a base and sugar combination suitably bound to adjacent subunits through phosphodiester or other bonds.

Antisense nucleic acids or oligonulcleotides can be produced by standard techniques (see, e.g., Shewmaker et al., U.S. Pat. No. 5,107,065. The oligonucleotides used in accordance with this invention may be conveniently and routinely made through the well-known technique of solid phase synthesis. Equipment for such synthesis is available from several vendors, including PE Applied Biosystems (Foster City, Calif.). Any other means for such synthesis may also be employed, however, the actual synthesis of the oligonucleotides is well within the abilities of the practitioner. It is also will known to prepare other oligonucleotide such as phosphorothioates and alkylated derivatives.

The oligonucleotides of this invention are designed to be hybridizable with 12q23-qter RNA (e.g., mRNA) or DNA. For example, an oligonucleotide (e.g., DNA oligonucleotide) that hybridizes to 12q23-qter mRNA can be used to target the mRNA for RnaseH digestion. Alternatively, an oligonucleotide that hybridizes to the translation initiation site of 12q23-qter mRNA can be used to prevent translation of the mRNA. In another approach, oligonucleotides that bind to the double-stranded DNA of 12q23-qter can be administered. Such oligonucleotides can form a triplex construct and inhibit the transcription of the DNA encoding 12q23-qter polypeptides. Triple helix pairing prevents the double helix from opening sufficiently to allow the binding of polymerases, transcription factors, or regulatory molecules. Recent therapeutic advances using triplex DNA have been described (see, e.g., J. E. Gee et al., 1994, *Molecular and Immunologic Approaches*, Futura Publishing Co., Mt. Kisco, N.Y.).

As non-limiting examples, antisense oligonucleotides may be targeted to hybridize to the following regions: mRNA cap region; translation initiation site; translational termination site; transcription initiation site; transcription termination site; polyadenylation signal; 3' untranslated region; 5' untranslated region; 5' coding region; mid coding region; and 3' coding region. Preferably, the complementary oligonucleotide is designed to hybridize to the most unique 5' sequence of a 12q23-qter gene, including any of about 15-35 nucleotides spanning the 5' coding sequence. Appropriate oligonucleotides can be designed using OLIGO software (Molecular Biology Insights, Inc.; Cascade, Colo.).

In accordance with the present invention, an antisense oligonucleotide can be synthesized, formulated as a pharmaceutical composition, and administered to a subject. The synthesis and utilization of antisense and triplex oligonucleotides have been previously described (e.g., H. Simon et al., 1999, *Antisense Nucleic Acid Drug Dev.* 9:527-31; F. X. Barre et al., 2000, *Proc. Natl. Acad. Sci. USA* 97:3084-3088; R. Elez et al., 2000, *Biochem. Biophys. Res. Commun.* 269:352-6; E. R. Sauter et al., 2000, *Clin. Cancer Res.* 6:654-60). Alternatively, expression vectors derived from retroviruses, adenovirus, herpes or vaccinia viruses, or from various bacterial plasmids may be used for delivery of nucleotide sequences to the targeted organ, tissue or cell population. Methods which are well known to those skilled in the art can be used to construct recombinant vectors which will express nucleic acid sequence that is complementary to the nucleic acid sequence encoding a 12q23-qter polypeptide. These techniques are described both in Sambrook et al., 1989 and in Ausubel et al., 1992. For example, 12q23-qter expression can be inhibited by transforming a cell or tissue with an expression vector that expresses high levels of untranslatable 12q23-qter sense or antisense sequences. Even in the absence of integration into the DNA, such vectors may continue to transcribe RNA molecules until they are disabled by endogenous nucleases. Transient expression may last for a month or more with a non-replicating vector, and even longer if appropriate replication elements included in the vector system.

Various assays may be used to test the ability of antisense oligonucleotides to inhibit 12q23-qter gene expression. For example, 12q23-qter mRNA levels can be assessed Northern blot analysis (Sambrook et al., 1989; Ausubel et al., 1992; J. C. Alwine et al. 1977, *Proc. Natl. Acad. Sci. USA* 74:5350-5354; I. M. Bird, 1998, *Methods Mol. Biol.* 105:325-36), quantitative or semi-quantitative RT-PCR analysis (see, e.g., W. M. Freeman et al., 1999, *Biotechniques* 26:112-122; Ren et al., 1998, *Mol. Brain. Res.* 59:256-63; J. M. Cale et al., 1998, *Methods Mol. Biol.* 105:351-71), or in situ hybridization (reviewed by A. K. Raap, 1998, *Mutat. Res.* 400:287-298). Alternatively, 12q23-qter polypeptide levels can be measured, e.g., by western blot analysis, indirect immunofluorescence, immunoprecipitation techniques (see, e.g., J. M. Walker, 1998, *Protein Protocols on CD-ROM*, Humana Press, Totowa, N.J.).

Polypeptides

The invention also relates to 12q23-qter proteins or polypeptides encoded by the nucleic acids described herein, e.g., SEQ ID NO:93 to SEQ ID NO:155, or portions or variants thereof. The proteins and polypeptides of this invention can be isolated and/or recombinant. In a preferred embodiment, the proteins or portions thereof have at least one function characteristic of a chromosome 12q23-qter protein or polypeptide for example, Gene 702, a metalloprotease-like gene, the product of which is involved in inflammatory responses including, but not limited to tissue destruction and repair. These proteins are referred to as analogs, and the genes encoding them include, for example, naturally occurring chromosome 12q23-qter genes, variants (e.g., mutants) encoding those proteins and/or portions thereof. Such protein or polypeptide variants include mutants differing by the addition, deletion or substitution of one or more amino acid residues, or modified polypeptides in which one or more residues are modified (e.g., by phosphorylation, sulfation, acylation, etc.), and mutants comprising one or more modified residues. The variant can have "conservative" changes, wherein a substituted amino acid has similar structural or chemical properties, e.g., replacement of leucine with isoleucine. More infrequently, a variant can have "nonconservative" changes, e.g., replacement of a glycine with a tryptophan. Guidance in determining which amino acid residues can be substituted, inserted, or deleted without abolishing biological or immunological activity can be determined using computer programs well known in the art, for example, DNASTAR software (DNASTAR, Inc., Madison, Wis.).

As non-limiting examples, conservative substitutions in a 12q23-qter amino acid sequence can be made in accordance with the following table:

| Original Residue | Conservative Substitution(s) |
|---|---|
| Ala | Ser |
| Arg | Lys |
| Asn | Gln, His |
| Asp | Glu |
| Cys | Ser |
| Gln | Asn |
| Glu | Asp |

-continued

| Original Residue | Conservative Substitution(s) |
|---|---|
| Gly | Pro |
| His | Asn, Gln |
| Ile | Leu, Val |
| Leu | Ile, Val |
| Lys | Arg, Gln, Glu |
| Met | Leu, Ile |
| Phe | Met, Leu, Tyr |
| Ser | Thr |
| Thr | Ser |
| Trp | Tyr |
| Tyr | Trp, Phe |
| Val | Ile, Leu |

Substantial changes in function or immunogenicity can be made by selecting substitutions that are less conservative than those shown in the table, above. For example, non-conservative substitutions can be made which more significantly affect the structure of the polypeptide in the area of the alteration, for example, the alpha-helical, or beta-sheet structure; the charge or hydrophobicity of the molecule at the target site; or the bulk of the side chain. The substitutions which generally are expected to produce the greatest changes in the polypeptide's properties are those where 1) a hydrophilic residue, e.g., seryl or threonyl, is substituted for (or by) a hydrophobic residue, e.g., leucyl, isoleucyl, phenylalanyl, valyl, or alanyl; 2) a cysteine or proline is substituted for (or by) any other residue; 3) a residue having an electropositive side chain, e.g., lysyl, arginyl, or histidyl, is substituted for (or by) an electronegative residue, e.g., glutamyl or aspartyl; or 4) a residue having a bulky side chain, e.g., phenylalanine, is substituted for (or by) a residue that does not have a side chain, e.g., glycine.

In one embodiment, the percent amino acid sequence identity between a chromosome 12q23-qter polypeptide such as SEQ ID NO:93 to SEQ ID NO:155, and functional equivalents thereof is at least 50%. In a preferred embodiment, the percent amino acid sequence identity between such a chromosome 12q23-qter polypeptide and its functional equivalents is at least 65%. More preferably, the percent amino acid sequence identity between a chromosome 12q23-qter polypeptide and its functional equivalents is at least 75%, still more preferably, at least 80%, and even more preferably, at least 90%.

Percent sequence identity can be calculated using computer programs or direct sequence comparison. Preferred computer program methods to determine identity between two sequences include, but are not limited to, the GCG program package, FASTA, BLASTP, and TBLASTN (see, e.g., D. W. Mount, 2001, *Bioinformatics: Sequence and Genome Analysis*, Cold Spring Harbor Laboratory Press, Cold Spring Harbor, N.Y.). The BLASTP and TBLASTN programs are publicly available from NCBI and other sources. The well-known Smith Waterman algorithm may also be used to determine identity.

Exemplary parameters for amino acid sequence comparison include the following: 1) algorithm from Needleman and Wunsch, 1970, *J. Mol. Biol.* 48:443-453; 2) BLOSSUM62 comparison matrix from Hentikoff and Hentikoff, 1992, *Proc. Natl. Acad. Sci. USA* 89:10915-10919; 3) gap penalty=12; and 4) gap length penalty=4. A program useful with these parameters is publicly available as the "gap" program (Genetics Computer Group, Madison, Wis.). The aforementioned parameters are the default parameters for polypeptide comparisons (with no penalty for end gaps).

Alternatively, polypeptide sequence identity can be calculated using the following equation: % identity=(the number of identical residues)/(alignment length in amino acid residues)*100. For this calculation, alignment length includes internal gaps but does not include terminal gaps.

In accordance with the present invention, polypeptide sequences may be identical to the sequence of any one of SEQ ID NO:93 to SEQ ID NO:155, or may include up to a certain integer number of amino acid alterations. Polypeptide alterations are selected from the group consisting of at least one amino acid deletion, substitution, including conservative and non-conservative substitution, or insertion. Alterations may occur at the amino- or carboxy-terminal positions of the reference polypeptide sequence or anywhere between those terminal positions, interspersed either individually among the amino acids in the reference sequence or in one or more contiguous groups within the reference sequence.

In specific embodiments, a polypeptide variant may be encoded by a 12q23-qter nucleic acid comprising a SNP and/or an alternate splice variant. For example, a polypeptide variant may be encoded by a 12q23-qter alternate splice variant comprising a nucleotide sequence of any one of SEQ ID NO:1 to SEQ ID NO:5; SEQ ID NO:17 to SEQ ID NO:18; SEQ ID NO:36 to SEQ ID NO:37; SEQ ID NO:43 to SEQ ID NO:44; SEQ ID NO:80 to SEQ ID NO:81, or any of the alternate splice sequences set forth in Table 4. In addition, a polypeptide variant may be encoded by a nucleic acid containing one or more 12q23-qter SNPs as set forth in Table 10; FIGS. 7A-7H; FIGS. 9A-9F; FIGS. 27A-27K; and FIGS. 28A-28C. Specific examples of amino acid changes encoded by 12q23-qter SNPs are provided in Table 10, and are described in detail hereinbelow.

The invention also relates to isolated, synthesized and/or recombinant portions or fragments of a 12q23-qter protein or polypeptide as described herein. Polypeptide fragments (i.e., peptides) can be made which have full or partial function on their own, or which when mixed together (though fully, partially, or nonfunctional alone), spontaneously assemble with one or more other polypeptides to reconstitute a functional protein having at least one functional characteristic of a 12q23-qter protein of this invention. In addition, 12q23-qter polypeptide fragments may comprise, for example, one or more domains of the 12q23-qter polypeptide, disclosed herein. In particular, a Gene 454 polypeptide may comprise one or more transmembrane, extracellular, or intracellular domains; a Gene 561 polypeptide may comprise a SH3 domain and/or one or more fibronectin type III repeats; and a Gene 757 polypeptide may comprise a cysteine rich domain, a Ser/Thr-XXX-Val motif, and/or one or more transmembrane repeats (see below).

Polypeptides according to the invention can comprise at least 5 contiguous amino acid residues; preferably the polypeptides comprise at least 12 contiguous residues; more preferably the polypeptides comprise at least 20 contiguous residues; and yet more preferably the polypeptides comprise at least 30 contiguous residues. Nucleic acids comprising protein-coding sequences can be used to direct the expression of asthma-associated polypeptides in intact cells or in cell-free translation systems. The coding sequence can be tailored, if desired, for more efficient expression in a given host organism, and can be used to synthesize oligonucleotides encoding the desired amino acid sequences. The resulting oligonucleotides can be inserted into an appropriate vector and expressed in a compatible host organism or translation system.

The polypeptides of the present invention, including function-conservative variants, may be isolated from wild-type or mutant cells (e.g., human cells or cell lines), from heterologous organisms or cells (e.g., bacteria, yeast, insect, plant, and mammalian cells), or from cell-free translation systems (e.g., wheat germ, microsomal membrane, or bacterial extracts) in which a protein-coding sequence has been introduced and expressed. Furthermore, the polypeptides may be part of recombinant fusion proteins. The polypeptides can also, advantageously, be made by synthetic chemistry. Polypeptides may be chemically synthesized by commercially available automated procedures, including, without limitation, exclusive solid phase synthesis, partial solid phase methods, fragment condensation or classical solution synthesis.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the protein contains an additional sequence (e.g., epitope or protein) tag that facilitates purification. Non-limiting examples of epitope tags include c-myc, haemagglutinin (HA), polyhistidine (6×-HIS) (SEQ ID NO: 6160), GLU-GLU, and DYKDDDDK (SEQ ID NO: 4688) (FLAG®) epitope tags. Non-limiting examples of protein tags include glutathione-S-transferase (GST), green fluorescent protein (GFP), and maltose binding protein (MBP).

In one approach, the coding sequence of a polypeptide or peptide can be cloned into a vector that creates a fusion with a sequence tag of interest. Suitable vectors include, without limitation, pRSET (Invitrogen Corp., San Diego, Calif.), pGEX (Amersham-Pharmacia Biotech, Inc., Piscataway, N.J.), pEGFP (CLONTECH Laboratories, Inc., Palo Alto, Calif.), and pMAL™ (New England BioLabs (NEB), Inc., Beverly, Mass.) plasmids. Following expression, the epitope, or protein tagged polypeptide or peptide can be purified from a crude lysate of the translation system or host cell by chromatography on an appropriate solid-phase matrix. In some cases, it may be preferable to remove the epitope or protein tag (i.e., via protease cleavage) following purification. As an alternative approach, antibodies produced against a disorder-associated protein or against peptides derived therefrom can be used as purification reagents. Other purification methods are also possible.

The present invention also encompasses modifications of 12q23-qter polypeptides. The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds, as described in detail herein.

Both the naturally occurring and recombinant forms of the polypeptides of the invention can advantageously be used to screen compounds for binding activity. Many methods of screening for binding activity are known by those skilled in the art and may be used to practice the invention. Several methods of automated assays have been developed in recent years so as to permit screening of tens of thousands of compounds in a short period of time. Such high-throughput screening methods are particularly preferred. The use of high-throughput screening assays to test for inhibitors is greatly facilitated by the availability of large amounts of purified polypeptides, as provided by the invention. The polypeptides of the invention also find use as therapeutic agents as well as antigenic components to prepare antibodies.

The polypeptides of this invention find use as immunogenic components useful as antigens for preparing antibodies by standard methods. It is well known in the art that immunogenic epitopes generally contain at least 5 contiguous amino acid residues (Ohno et al., 1985, *Proc. Natl. Acad. Sci. USA* 82:2945). Therefore, the immunogenic components of this invention will typically comprise at least 5 contiguous amino acid residues of the sequence of the complete polypeptide chains. Preferably, they will contain at least 7, and most preferably at least 10 contiguous amino acid residues or more to ensure that they will be immunogenic. Whether a given component is immunogenic can readily be determined by routine experimentation Such immunogenic components can be produced by proteolytic cleavage of larger polypeptides or by chemical synthesis or recombinant technology and are thus not limited by proteolytic cleavage sites. The present invention thus encompasses antibodies that specifically recognize asthma-associated immunogenic components.

Structural Studies

A purified 12q23-qter polypeptide (e.g., SEQ ID NO:93 to SEQ ID NO:155), or portions or complexes thereof, can be analyzed by well-established methods (e.g., X-ray crystallography, NMR, CD, etc.) to determine the three-dimensional structure of the molecule. The three-dimensional structure, in turn, can be used to model intermolecular interactions. Exemplary methods for crystallization and X-ray crystallography are found in P. G. Jones, 1981, *Chemistry in Britain*, 17:222-225; C. Jones et al. (eds), *Crystallographic Methods and Protocols*, Humana Press, Totowa, N.J.; A. McPherson, 1982, *Preparation and Analysis of Protein Crystals*, John Wiley & Sons, New York, N.Y.; T. L. Blundell and L. N. Johnson, 1976, *Protein Crystallography*, Academic Press, Inc., New York, N.Y.; A. Holden and P. Singer, 1960, *Crystals and Crystal Growing*, Anchor Books-Doubleday, New York, N.Y.; R. A. Laudise, 1970, *The Growth of Single Crystals*, Solid State Physical Electronics Series, N. Holonyak, Jr., (ed), Prentice-Hall, Inc.; G. H. Stout and L. H. Jensen, 1989, *X-ray Structure Determination: A Practical Guide*, 2nd edition, John Wiliey & Sons, New York, N.Y.; *Fundamentals of Analytical Chemistry*, 3rd. edition, Saunders Golden Sunburst Series, Holt, Rinehart and Winston, Philadelphia, Pa., 1976; P. D. Boyle of the Department of Chemistry of North Carolina State University; M. B. Berry, 1995, *Protein Crystallization: Theory and Practice, Structure and Dynamics of E. coli Adenylate Kinase*, Doctoral Thesis, Rice University, Houston Tex.

For X-ray diffraction studies, single crystals can be grown to suitable size. Preferably, a crystal has a size of 0.2 to 0.4 mm in at least two of the three dimensions. Crystals can be formed in a solution comprising a 12q23-qter polypeptide (e.g., 1.5-200 mg/ml) and reagents that reduce the solubility to conditions close to spontaneous precipitation. Factors that affect the formation of polypeptide crystals include: 1) purity; 2) substrates or co-factors; 3) pH; 4) temperature; 5) polypeptide concentration; and 6) characteristics of the precipitant. Preferably, the 12q23-qter polypeptides are pure, i.e., free from contaminating components (at least 95% pure), and free from denatured 12q23-qter polypeptides. In particular, polypeptides can be purified by FPLC and HPLC techniques to assure homogeneity (see, Lin et al., 1992, *J. Crystal. Growth.* 122:242-245). Optionally, 12q23-qter polypeptide substrates or co-factors can be added to stabilize the quaternary structure of the protein and promote lattice packing.

Suitable precipitants for crystallization include, but are not limited to, salts (e.g., ammonium sulphate, potassium phosphate); polymers (e.g., polyethylene glycol (PEG) 6000); alcohols (e.g., ethanol); polyalcohols (e.g., 1-methyl-2,4 pentane diol (MPD)); organic solvents; sulfonic dyes; and deionized water. The ability of a salt to precipitate polypeptides can be generally described by the Hofmeister series: $PO_4^{3-}$>$HPO_4^{2-}$=$SO_4^{2-}$>citrate>$CH_3CO_2^-$>$Cl^-$>$Br^-$>$NO_3^-$>$ClO_4^-$>$SCN^-$; and $NH_4^+$>$K^+$>$Na^+$>$Li^+$. Non-limiting examples of salt precipitants are shown below (see Berry, 1995).

| Precipitant | Maximum concentration |
| --- | --- |
| $(NH_4^+/Na^+/Li^+)_2$ or $Mg_2 + SO_4^{2-}$ | 4.0/1.5/2.1/2.5 M |
| $NH_4^+/Na^+/K^+$ $PO_4^{3-}$ | 3.0/4.0/4.0 M |
| $NH_4^+/K^+/Na^+/Li^+$ citrate | ~1.8 M |
| $NH_4^+/K^+/Na^+/Li^+$ acetate | ~3.0 M |
| $NH_4^+/K^+/Na^+/Li^+$ $Cl^-$ | 5.2/9.8/4.2/5.4 M |
| $NH_4^+ NO_3^-$ | ~8.0 M |

High molecular weight polymers useful as precipitating agents include polyethylene glycol (PEG), dextran, polyvinyl alcohol, and polyvinyl pyrrolidone (A. Polson et al., 1964, *Biochem. Biophys. Acta.* 82:463-475). In general, polyethylene glycol (PEG) is the most effective for forming crystals. PEG compounds with molecular weights less than 1000 can be used at concentrations above 40% v/v. PEGs with molecular weights above 1000 can be used at concentration 5-50% w/v. Typically, PEG solutions are mixed with ~0.1% sodium azide to prevent bacterial growth.

Typically, crystallization requires the addition of buffers and a specific salt content to maintain the proper pH and ionic strength for a protein's stability. Suitable additives include, but are not limited to sodium chloride (e.g., 50-500 mM as additive to PEG and MPD; 0.15-2 M as additive to PEG); potassium chloride (e.g., 0.05-2 M); lithium chloride (e.g., 0.05-2 M); sodium fluoride (e.g., 20-300 mM); ammonium sulfate (e.g., 20-300 mM); lithium sulfate (e.g., 0.05-2 M); sodium or ammonium thiocyanate (e.g., 50-500 mM); MPD (e.g., 0.5-50%); 1,6 hexane diol (e.g., 0.5-10%); 1,2,3 heptane triol (e.g., 0.5-15%); and benzamidine (e.g., 0.5-15%).

Detergents may be used to maintain protein solubility and prevent aggregation. Suitable detergents include, but are not limited to non-ionic detergents such as sugar derivatives, oligoethyleneglycol derivatives, dimethylamine-N-oxides, cholate derivatives, N-octyl hydroxyalkylsulphoxides, sulphobetains, and lipid-like detergents. Sugar-derived detergents include alkyl glucopyranosides (e.g., C8-GP, C9-GP), alkyl thio-glucopyranosides (e.g., C8-tGP), alkyl maltopyranosides (e.g., C10-M, C12-M; CYMAL-3, CYMAL-5, CYMAL-6), alkyl thio-maltopyranosides, alkyl galactopyranosides, alkyl sucroses (e.g., N-octanoylsucrose), and glucamides (e.g., HECAMEG, C-HEGA-10; MEGA-8). Oligoethyleneglycol-derived detergents include alkyl polyoxyethylenes (e.g., C8-E5, C8-En; C12-E8; C12-E9) and phenyl polyoxyethylenes (e.g., Triton X-100). Dimethylamine-N-oxide detergents include, e.g., C10-DAO; DDAO; LDAO. Cholate-derived detergents include, e.g., Deoxy-Big CHAP, digitonin. Lipid-like detergents include phosphocholine compounds. Suitable detergents further include zwitterionic detergents (e.g., ZWITTERGENT 3-10; ZWITTERGENT 3-12); and ionic detergents (e.g., SDS).

Crystallization of macromolecules has been performed at temperatures ranging from 60° C. to less than 0° C. However, most molecules can be crystallized at 4° C. or 22° C. Lower temperatures promote stabilization of polypeptides and inhibit bacterial growth. In general, polypeptides are more soluble in salt solutions at lower temperatures (e.g., 4° C.), but less soluble in PEG and MPD solutions at lower temperatures. To allow crystallization at 4° C. or 22° C., the precipitant or protein concentration can be increased or decreased as required. Heating, melting, and cooling of crystals or aggregates can be used to enlarge crystals. In addition, crystallization at both 4° C. and 22° C. can be assessed (A. McPherson, 1992, *J. Cryst. Growth.* 122:161-167; C. W. Carter, Jr. and C. W. Carter, 1979, *J. Biol. Chem.* 254:12219-12223; T. Bergfors, 1993, *Crystallization Lab Manual*).

A crystallization protocol can be adapted to a particular polypeptide or peptide. In particular, the physical and chemical properties of the polypeptide can be considered (e.g., aggregation, stability, adherence to membranes or tubing, internal disulfide linkages, surface cysteines, chelating ions, etc.). For initial experiments, the standard set of crystallization reagents can be used (Hampton Research; Laguna Niguel, Calif.). In addition, the CRYSTOOL program can provide guidance in determining optimal crystallization conditions (Brent Segelke, 1995, Efficiency analysis of sampling protocols used in protein crystallization screening and crystal structure from two novel crystal forms of PLA2, Ph.D. Thesis, University of California, San Diego). Exemplary crystallization conditions are shown below (see Berry, 1995).

| Major Precipitant | Additive | Concentration of Major Precipitant | Concentration of Additive |
|---|---|---|---|
| $(NH_4)_2SO_4$ | PEG 400-2000, MPD, ethanol, or methanol | 2.0-4.0 M | 6%-0.5% |
| Na citrate | PEG 400-2000, MPD, ethanol, or methanol | 1.4-1.8 M | 6%-0.5% |
| PEG 1000-20000 | $(NH4)_2SO_4$, NaCl, or Na formate | 40-50% | 0.2-0.6 M |

Robots can be used for automatic screening and optimization of crystallization conditions. For example, the IMPAX and Oryx systems can be used (Douglas Instruments, Ltd., East Garston, United Kingdom). The CRYSTOOL program (Segelke, supra) can be integrated with the robotics programming. In addition, the Xact program can be used to construct, maintain, and record the results of various crystallization experiments (see, e.g., D. E. Brodersen et al., 1999, *J. Appl. Cryst.* 32: 1012-1016; G. R. Andersen and J. Nyborg, 1996, *J. Appl. Cryst.* 29:236-240). The Xact program supports multiple users and organizes the results of crystallization experiments into hierarchies. Advantageously, Xact is compatible with both CRYSTOOL and Microsoft® Excel programs.

Four methods are commonly employed to crystallize macromolecules: vapor diffusion, free interface diffusion, batch, and dialysis. The vapor diffusion technique is typically performed by formulating a 1:1 mixture of a solution comprising the polypeptide of interest and a solution containing the precipitant at the final concentration that is to be achieved after vapor equilibration. The drop containing the 1:1 mixture of protein and precipitant is then suspended and sealed over the well solution, which contains the precipitant at the target concentration, as either a hanging or sitting drop. Vapor diffusion can be used to screen a large number of crystallization conditions or when small amounts of polypeptide are available. For screening, drop sizes of 1 to 2 μl can be used. Once preliminary crystallization conditions have been determined, drop sizes such as 10 μl can be used. Notably, results from hanging drops may be improved with agarose gels (see K. Provost and M.-C. Robert, 1991, *J. Cryst. Growth.* 110:258-264). Free interface diffusion is performed by layering of a low density solution onto one of higher density, usually in the form of concentrated protein onto concentrated salt. Since the solute to be crystallized must be concentrated, this method typically requires relatively large amounts of protein. However, the method can be adapted to work with small amounts of protein. In a representative experiment, 2 to 5 μl of sample is pipetted into one end of a 20 μl microcapillary pipet. Next, 2 to 5 μl of precipitant is pipetted into the capillary without introducing an air bubble, and the ends of the pipet are sealed. With sufficient amounts of protein, this method can be used to obtain relatively large crystals (see, e.g., S. M. Althoff et al., 1988, *J. Mol. Biol.* 199:665-666).

The batch technique is performed by mixing concentrated polypeptide with concentrated precipitant to produce a final concentration that is supersaturated for the solute macromolecule. Notably, this method can employ relatively large amounts of solution (e.g., milliliter quantities), and can produce large crystals. For that reason, the batch technique is not recommended for screening initial crystallization conditions.

The dialysis technique is performed by diffusing precipitant molecules through a semipermeable membrane to slowly increase the concentration of the solute inside the membrane. Dialysis tubing can be used to dialyze milliliter quantities of sample, whereas dialysis buttons can be used to dialyze microliter quantities (e.g., 7-200 μl). Dialysis buttons may be constructed out of glass, perspex, or Teflon™ (see, e.g., Cambridge Repetition Engineers Ltd., Greens Road, Cambridge CB4 3EQ, UK; Hampton Research). Using this method, the precipitating solution can be varied by moving the entire dialysis button or sack into a different solution. In this way, polypeptides can be "reused" until the correct conditions for crystallization are found (see, e.g., C. W. Carter, Jr. et al., 1988, *J. Cryst. Growth.* 90:60-73). However, this method is not recommended for precipitants comprising concentrated PEG solutions.

Various strategies have been designed to screen crystallization conditions, including 1) pI screening; 2) grid screening; 3) factorials; 4) solubility assays; 5) perturbation; and 6) sparse matrices. In accordance with the pI screening method, the pI of a polypeptide is presumed to be its crystallization point. Screening at the pI can be performed by dialysis against low concentrations of buffer (less than 20 mM) at the appropriate pH, or by use of conventional precipitants.

The grid screening method can be performed on two-dimensional matrices. Typically, the precipitant concentration is plotted against pH. The optimal conditions can be determined for each axis, and then combined. At that point, additional factors can be tested (e.g., temperature, additives). This method works best with fast-forming crystals, and can be readily automated (see M. J. Cox and P. C. Weber, 1988, *J. Cryst. Growth.* 90:318-324). Grid screens are commercially available for popular precipitants such as ammonium sulphate, PEG 6000, MPD, PEG/LiCl, and NaCl (see, e.g., Hamilton Research).

The incomplete factorial method can be performed by 1) selecting a set of ~20 conditions; 2) randomly assigning combinations of these conditions; 3) grading the success of the results of each experiment using an objective scale; and 4) statistically evaluating the effects of each of the conditions on crystal formation (see, e.g., C. W. Carter, Jr. et al., 1988, *J. Cryst. Growth.* 90:60-73). In particular, conditions such as pH, temperature, precipitating agent, and cations can be tested. Dialysis buttons are preferably used with this method. Typically, optimal conditions/combinations can be determined within 35 tests. Similar approaches, such as "footprinting" conditions, may also be employed (see, e.g., E. A. Stura et al., 1991, *J. Cryst. Growth.* 110:1-2).

The perturbation approach can be performed by altering crystallization conditions by introducing a series of additives designed to test the effects of altering the structure of bulk solvent and the solvent dielectric on crystal formation (see, e.g., Whitaker et al., 1995, *Biochem.* 34:8221-8226). Additives for increasing the solvent dialectric include, but are not limited to, NaCl, KCl, or LiCl (e.g., 200 mM); Na formate (e.g., 200 mM); $Na_2HPO_4$ or $K_2HPO_4$ (e.g., 200 mM); urea, triachloroacetate, guanidium HCl, or KSCN (e.g., 20-50 mM). A non-limiting list of additives for decreasing the solvent dialectric include methanol, ethanol, isopropanol, or tert-butanol (e.g., 1-5%); MPD (e.g., 1%); PEG 400, PEG 600, or PEG 1000 (e.g., 1-4%); PEG MME (monomethylether) 550, PEG MME 750, PEG MME 2000 (e.g., 1-4%).

As an alternative to the above-screening methods, the sparse matrix approach can be used (see, e.g., J. Jancarik and S.-H.J. Kim, 1991, *Appl. Cryst.* 24:409-411; A. McPherson, 1992, *J. Cryst. Growth.* 122:161-167; B. Cudney et al., 1994, *Acta. Cryst.* D50:414-423). Sparse matrix screens are commercially available (see, e.g., Hampton Research; Molecular Dimensions, Inc., Apopka, Fla.; Emerald Biostructures, Inc., Lemont, Ill.). Notably, data from Hampton Research sparse matrix screens can be stored and analyzed using ASPRUN software (Douglas Instruments).

Exemplary conditions for an initial screen are shown below (see Berry, 1995).

ecules to deposit on the surface of the seeds and produce crystals. Two seeding methods can be used: microseeding and macroseeding. For microseeding, a crystal can be ground into tiny pieces and transferred into the protein solution. Alternatively, seeds can be transferred by adding 1-2 µl of the seed solution directly to the equilibrated protein solution. In another approach, seeds can be transferred by dipping a hair in the seed solution and then streaking the hair across the surface of the drop (streak seeding; see Stura and Wilson, supra). For macroseeding, an intact crystal can be transferred into the protein solution (see, e.g., C. Thaller et al., 1981, *J. Mol. Biol.* 147:465-469). Preferably, the surface of the crystal seed is washed to regenerate the growing surface prior to being transferred. Optimally, the protein solution for crystallization is close to saturation and the crystal seed is not completely dissolved upon transfer.

Antibodies

Another aspect of the invention pertains to antibodies directed to 12q23-qter polypeptides, or portions or variants thereof. The invention provides polyclonal and monoclonal antibodies that bind 12q23-qter polypeptides or peptides. The antibodies may be elicited in an animal host (e.g., rabbit, goat, mouse, or other non-human mammal) by immunization with disorder-associated immunogenic components. Antibodies may also be elicited by in vitro immunization (sensitization) of immune cells. The immunogenic components used to elicit the production of antibodies may be isolated from cells or chemically synthesized. The antibodies may also be produced

TABLE 1A

CRYSTALIZATION CONDITIONS

Tray 1:

| PEG 8000 (wells 1-6) | | | | | | Ammonium sulfate (wells 7-12) | | | | | |
| --- | --- | --- | --- | --- | --- | --- | --- | --- | --- | --- | --- |
| 1 | 2 | 3 | 4 | 5 | 6 | 7 | 8 | 9 | 10 | 11 | 12 |
| 20% pH 5.0 | 20% pH 7.0 | 20% pH 8.6 | 35% pH 5.0 | 35% pH 7.0 | 35% pH 8.6 | 2.0 M pH 5.0 | 2.0 M pH 7.0 | 2.0 M pH 8.8 | 2.5 M pH 5.0 | 2.5 M pH 7.0 | 2.5 M pH 8.8 |

| MPD (wells 13-16) | | | | Na Citrate (wells 17-20) | | | | Na/K Phosphate (wells 21-24) | | | |
| --- | --- | --- | --- | --- | --- | --- | --- | --- | --- | --- | --- |
| 13 | 14 | 15 | 16 | 17 | 18 | 19 | 20 | 21 | 22 | 23 | 24 |
| 30% pH 5.8 | 30% pH 7.6 | 50% pH 5.8 | 50% pH 7.6 | 1.3 M pH 5.8 | 1.3 M pH 7.5 | 1.5 M pH 5.8 | 1.5 M pH 7.5 | 2.0 M pH 6.0 | 2.0 M pH 7.4 | 2.5 M pH 6.0 | 2.5 M pH 7.4 |

Tray 2:
PEG 2000 MME/0.2 M Ammon. sulfate (wells 25-30)

| 25 | 26 | 27 | 28 | 29 | 30 |
| --- | --- | --- | --- | --- | --- |
| 25% pH 5.5 | 25% pH 7.0 | 25% pH 8.5 | 40% pH 5.5 | 40% pH 7.0 | 40% pH 8.5 |

Random for wells 31 to 48

The initial screen can be used with hanging or sitting drops. To conserve the sample, tray 2 can be set up several weeks following tray 1. Wells 31-48 of tray 2 can comprise a random set of solutions. Alternatively, solutions can be formulated using sparse methods. Preferably, test solutions cover a broad range of precipitants, additives, and pH (especially pH 5.0-9.0).

Seeding can be used to trigger nucleation and crystal growth (Stura and Wilson, 1990, *J. Cryst. Growth.* 110:270-282; C. Thaller et al., 1981, *J. Mol. Biol.* 147:465-469; A. McPherson and P. Schlichta, 1988, *J. Cryst. Growth.* 90:47-50). In general, seeding can performed by transferring crystal seeds into a polypeptide solution to allow polypeptide molin recombinant systems programmed with appropriate antibody-encoding DNA. Alternatively, the antibodies may be constructed by biochemical reconstitution of purified heavy and light chains. The antibodies include hybrid antibodies, chimeric antibodies, and univalent antibodies. Also included are Fab fragments, including Fab[1] and Fab(ab)[2] fragments of antibodies.

In accordance with the present invention, antibodies are directed to a 12q23-qter polypeptide (e.g., SEQ ID NO:93 to SEQ ID NO:155), or variants, or portions thereof. For example, antibodies can be produced to bind to a 12q23-qter polypeptide encoded by an alternate splice variant comprising a nucleotide sequence of any one of SEQ ID NO:1 to SEQ ID NO:5; SEQ ID NO:17 to SEQ ID NO:18; SEQ ID NO:36 to SEQ ID NO:37; SEQ ID NO:43 to SEQ ID NO:44; SEQ ID NO:80 to SEQ ID NO:81; or any of the alternate splice sequences set forth in Table 4. As another example, antibodies can be produced to bind to a 12q23-qter polypeptide variant encoded by a nucleic acid containing one or more 12q23-qter SNPs as set forth in Table 10; FIGS. 7A-7H; FIGS. 9A-9F; FIGS. 27A-27K; and FIGS. 28A-28C. Such antibodies can be used as diagnostic and/or therapeutic reagents.

An isolated 12q23-qter polypeptide (e.g., SEQ ID NO:93 to SEQ ID NO:155), or variant, or portion thereof, can be used as an immunogen to generate antibodies using standard techniques for polyclonal and monoclonal antibody preparation. A full-length 12q23-qter polypeptide can be used or, alternatively, the invention provides antigenic peptide portions of 12q23-qter for use as immunogens. The antigenic peptide of 12q23-qter comprises at least 5 contiguous amino acid residues of the amino acid sequence shown in any one of SEQ ID NO:93 to SEQ ID NO:155, or a variant thereof, and encompasses an epitope of a 12q23-qter polypeptide such that an antibody raised against the peptide forms a specific immune complex with A 12q23-qter amino acid sequence.

An appropriate immunogenic preparation can contain, for example, recombinantly produced 12q23-qter polypeptide or a chemically synthesized 12q23-qter polypeptide, or portions thereof. The preparation can further include an adjuvant, such as Freund's complete or incomplete adjuvant, or similar immunostimulatory agent. A number of adjuvants are known and used by those skilled in the art. Non-limiting examples of suitable adjuvants include incomplete Freund's adjuvant, mineral gels such as alum, aluminum phosphate, aluminum hydroxide, aluminum silica, and surface-active substances such as lysolecithin, pluronic polyols, polyanions, peptides, oil emulsions, keyhole limpet hemocyanin, and dinitrophenol. Further examples of adjuvants include N-acetyl-muramyl-L-threonyl-D-isoglutamine (thr-MDP), N-acetyl-normuramyl-L-alanyl-D-isoglutamine (CGP 11637, referred to as nor-MDP), N-acetylmuramyl-Lalanyl-D-isoglutaminyl-L-alanine-2-(1'-2'-dipalmitoyl-sn-glycero-3 hydroxyphosphoryloxy)-ethylamine (CGP 19835A, referred to as MTP-PE), and RIBI, which contains three components extracted from bacteria, monophosphoryl lipid A, trehalose dimycolate and cell wall skeleton (MPL+TDM+CWS) in a 2% squalene/Tween 80 emulsion. A particularly useful adjuvant comprises 5% (wt/vol) squalene, 2.5% Pluronic L121 polymer and 0.2% polysorbate in phosphate buffered saline (Kwak et al., 1992, *New Eng. J. Med.* 327:1209-1215). Preferred adjuvants include complete BCG, Detox, (RIBI, Immunochem Research Inc.), ISCOMS, and aluminum hydroxide adjuvant (Superphos, Biosector). The effectiveness of an adjuvant may be determined by measuring the amount of antibodies directed against the immunogenic peptide.

Polyclonal antibodies to 12q23-qter polypeptides can be prepared as described above by immunizing a suitable subject with a 12q23-qter immunogen. The antibody titer in the immunized subject can be monitored over time by standard techniques, such as with an enzyme linked immunosorbent assay (ELISA) using immobilized 12q23-qter polypeptide or peptide. If desired, the antibody molecules can be isolated from the mammal (e.g., from the blood) and further purified by well-known techniques, such as protein A chromatography to obtain the IgG fraction.

At an appropriate time after immunization, e.g., when the antibody titers are highest, antibody-producing cells can be obtained from the subject and used to prepare monoclonal antibodies by standard techniques, such as the hybridoma technique (see Kohler and Milstein, 1975, *Nature* 256:495-497; Brown et al., 1981, *J. Immunol.* 127:539-46; Brown et al., 1980, *J. Biol. Chem.* 255:4980-83; Yeh et al., 1976, *PNAS* 76:2927-31; and Yeh et al., 1982, *Int. J. Cancer* 29:269-75), the human B cell hybridoma technique (Kozbor et al., 1983, *Immunol. Today* 4:72), the EBV-hybridoma technique (Cole et al., 1985, *Monoclonal Antibodies and Cancer Therapy*, Alan R. Liss, Inc., pp. 77-96) or trioma techniques.

The technology for producing hybridomas is well-known (see generally R. H. Kenneth, 1980, *Monoclonal Antibodies: A New Dimension In Biological Analyses*, Plenum Publishing Corp., New York, N.Y.; E. A. Lerner, 1981, *Yale J. Biol. Med.*, 54:387-402; M. L. Gefter et al., 1977, *Somatic Cell Genet.* 3:231-36). In general, an immortal cell line (typically a myeloma) is fused to lymphocytes (typically splenocytes) from a mammal immunized with a 12q23-qter immunogen as described above, and the culture supernatants of the resulting hybridoma cells are screened to identify a hybridoma producing a monoclonal antibody that binds 12q23-qter polypeptides or peptides.

Any of the many well known protocols used for fusing lymphocytes and immortalized cell lines can be applied for the purpose of generating an monoclonal antibody to a 12q23-qter polypeptide (see, e.g., G. Galfre et al., 1977, *Nature* 266:55052; Gefter et al., 1977; Lerner, 1981; Kenneth, 1980). Moreover, the ordinarily skilled worker will appreciate that there are many variations of such methods. Typically, the immortal cell line (e.g., a myeloma cell line) is derived from the same mammalian species as the lymphocytes. For example, murine hybridomas can be made by fusing lymphocytes from a mouse immunized with an immunogenic preparation of the present invention with an immortalized mouse cell line. Preferred immortal cell lines are mouse myeloma cell lines that are sensitive to culture medium containing hypoxanthine, aminopterin, and thymidine (HAT medium). Any of a number of myeloma cell lines can be used as a fusion partner according to standard techniques, e.g., the P3-NS1/1-Ag4-1, P3-x63-Ag8.653, or Sp2/O-Ag14 myeloma lines. These myeloma lines are available from ATCC (American Type Culture Collection, Manassas, Va.). Typically, HAT-sensitive mouse myeloma cells are fused to mouse splenocytes using polyethylene glycol (PEG). Hybridoma cells resulting from the fusion arc then selected using HAT medium, which kills unfused and unproductively fused myeloma cells (unfused splenocytes die after several days because they are not transformed). Hybridoma cells producing a monoclonal antibody of the invention are detected by screening the hybridoma culture supernatants for antibodies that bind 12q23-qter polypeptides or peptides, e.g., using a standard ELISA assay.

Alternative to preparing monoclonal antibody-secreting hybridomas, a monoclonal antibody can be identified and isolated by screening a recombinant combinatorial immunoglobulin library (e.g., an antibody phage display library) with the corresponding 12q23-qter polypeptide to thereby isolate immunoglobulin library members that bind the polypeptide. Kits for generating and screening phage display libraries are commercially available (e.g., the Pharmacia Recombinant Phage Antibody System, Catalog No. 27-9400-01; and the Stratagene SurfZAP™ Phage Display Kit, Catalog No. 240612).

Additionally, examples of methods and reagents particularly amenable for use in generating and screening antibody display library can be found in, for example, Ladner et al. U.S. Pat. No. 5,223,409; Kang et al. PCT International Publication No. WO 92/18619; Dower et al. PCT International Publication No. WO 91/17271; Winter et al. PCT International Publication WO 92/20791; Markland et al. PCT International Publication No. WO 92/15679; Breitling et al. PCT International Publication WO 93/01288; McCafferty et al. PCT International Publication No. WO 92/01047; Garrard et al. PCT International Publication No. WO 92/09690; Ladner et al. PCT International Publication No. WO 90/02809; Fuchs et al., 1991, *Bio/Technology* 9:1370-1372; Hay et al., 1992, *Hum. Antibod. Hybridomas* 3:81-85; Huse et al., 1989, *Science* 246:1275-1281; Griffiths et al., 1993, *EMBO J.* 12:725-734; Hawkins et al., 1992, *J. Mol. Biol.* 226:889-896; Clarkson et al., 1991, *Nature* 352:624-628; Gram et al., 1992, *PNAS* 89:3576-3580; Garrad et al., 1991, *Bio/Technology* 9:1373-1377; Hoogenboom et al., 1991, *Nuc. Acid Res.* 19:4133-4137; Barbas et al., 1991, *PNAS* 88:7978-7982; and McCafferty et al., 1990, *Nature* 348:552-55.

Additionally, recombinant antibodies to a 12q23-qter polypeptide, such as chimeric and humanized monoclonal antibodies, comprising both human and non-human portions, can be made using standard recombinant DNA techniques. Such chimeric and humanized monoclonal antibodies can be produced by recombinant DNA techniques known in the art, for example using methods described in Robinson et al. International Application No. PCT/US86/02269; Akira, et al. European Patent Application 184,187; Taniguchi, M., European Patent Application 171,496; Morrison et al. European Patent Application 173,494; Neuberger et al. PCT International Publication No. WO 86/01533; Cabilly et al. U.S. Pat. No. 4,816,567; Cabilly et al. European Patent Application 125,023; Better et al., 1988, *Science* 240:1041-1043; Liu et al., 1987, *PNAS* 84:3439-3443; Liu et al., 1987, *J. Immunol.* 139:3521-3526; Sun et al., 1987, *PNAS* 84:214-218; Nishimura et al., 1987, *Canc. Res.* 47:999-1005; Wood et al., 1985, *Nature* 314:446-449; and Shaw et al., 1988, *J. Natl. Cancer Inst.* 80:1553-1559; S. L. Morrison, 1985, *Science* 229:1202-1207; Oi et al., 1986, *BioTechniques* 4:214; Winter U.S. Pat. No. 5,225,539; Jones et al., 1986, *Nature* 321:552-525; Verhoeyan et al., 1988, *Science* 239:1534; and Bcidler et al., 1988, *J. Immunol.* 141:4053-4060.

An antibody against a 12q23-qter polypeptide (e.g., monoclonal antibody) can be used to isolate the corresponding polypeptide by standard techniques, such as affinity chromatography or immunoprecipitation. For example, antibodies can facilitate the purification of a natural 12q23-qter polypeptide from cells and of a recombinantly produced 12q23-qter polypeptide or peptide expressed in host cells. In addition, an antibody that binds to a 12q23-qter polypeptide can be used to detect the corresponding protein (e.g., in a cellular lysate or cell supernatant) in order to evaluate the abundance and pattern of expression of the protein. Such antibodies can also be used diagnostically to monitor 12q23-qter protein levels in tissue as part of a clinical testing procedure, e.g., to, for example, determine the efficacy of a given treatment regimen as described in detail herein. In addition, antibodies to a 12q23-qter polypeptide can be used as therapeutics for the treatment of diseases related to abnormal 12q23-qter gene expression or function, e.g., asthma.

Ligands

The 12q23-qter polypeptides (e.g., SEQ ID NO:93 to SEQ ID NO:155), polynucleotides (e.g., SEQ ID NO:1 to SEQ ID NO:92 and SEQ ID NO:156 to SEQ ID NO:4687), variants, or fragments or portions thereof, can be used to screen for ligands (e.g., agonists, antagonists, or inhibitors) that modulate the levels or activity of the 12q23-qter polypeptide. In addition, these 12q23-qter molecules can be used to identify endogenous ligands that bind to 12q23-qter polypeptides or polynucleotides in the cell. In one aspect of the present invention, the full-length 12q23-qter polypeptide (e.g., SEQ ID NO:93 to SEQ ID NO:155) is used to identify ligands. Alternatively, variants or portions of a 12q23-qter polypeptide are used. Such portions may comprise, for example, one or more domains of the 12q23-qter polypeptide (e.g., transmembrane, intracellular, extracellular, SH3, fibronectin III repeat, cysteine-rich, and Ser/Thr-XXX-Val domains) disclosed herein. Of particular interest are screening assays that identify agents that have relatively low levels of toxicity in human cells. A wide variety of assays may be used for this purpose, including in vitro protein-protein binding assays, electrophoretic mobility shift assays, immunoassays, and the like.

Ligands that bind to the 12q23-qter polypeptides or polynucleotides of the invention are potentially useful in diagnostic applications and/or pharmaceutical compositions, as described in detail herein. Ligands may encompass numerous chemical classes, though typically they are organic molecules, e.g., small molecules. Preferably, small molecules have a molecular weight of less than 5000 daltons, more preferably, small molecules have a molecular weight of more than 50 and less than 2,500 daltons. Such molecules can comprise functional groups necessary for structural interaction with proteins, particularly hydrogen bonding, and typically include at least an amine, carbonyl, hydroxyl or carboxyl group, preferably at least two of the functional chemical groups. Useful molecules often comprise cyclical carbon or heterocyclic structures and/or aromatic or polyaromatic structures substituted with one or more of the above functional groups. Such molecules can also comprise biomolecules including peptides, saccharides, fatty acids, steroids, purines, pyrimidines, derivatives, structural analogs, or combinations thereof.

Ligands may include, for example, 1) peptides such as soluble peptides, including Ig-tailed fusion peptides and members of random peptide libraries (see, e.g., Lam et al., 1991, *Nature* 354:82-84; Houghten et al., 1991, *Nature* 354:84-86) and combinatorial chemistry-derived molecular libraries made of D- and/or L-configuration amino acids; 2) phosphopeptides (e.g., members of random and partially degenerate, directed phosphopeptide libraries, see, e.g., Songyang et al, 1993, *Cell* 72:767-778); 3) antibodies (e.g., polyclonal, monoclonal, humanized, anti-idiotypic, chimeric, and single chain antibodies as well as Fab, F(ab')$_2$, Fab expression library fragments, and epitope-binding fragments of antibodies); and 4) small organic and inorganic molecules.

Test agents useful for identifying 12q23-qter ligands can be obtained from a wide variety of sources including libraries of synthetic or natural compounds. Synthetic compound libraries are commercially available from, for example, Maybridge Chemical Co. (Trevillet, Cornwall, UK), Comgenex (Princeton, N.J.), Brandon Associates (Merrimack, N.H.), and Microsource (New Milford, Conn.). A rare chemical library is available from Aldrich Chemical Company, Inc. (Milwaukee, Wis.). Natural compound libraries comprising bacterial, fungal, plant or animal extracts are available from, for example, Pan Laboratories (Bothell, Wash.). In addition, numerous means are available for random and directed synthesis of a wide variety of organic compounds and biomolecules, including expression of randomized oligonucleotides.

Alternatively, libraries of natural compounds in the form of bacterial, fungal, plant and animal extracts can be readily produced. Methods for the synthesis of molecular libraries are readily available (see, e.g., DeWitt et al., 1993, *Proc. Natl. Acad. Sci. USA* 90:6909; Erb et al., 1994, *Proc. Natl. Acad. Sci. USA* 91:11422; Zuckermann et al., 1994, *J. Med. Chem.* 37:2678; Cho et al., 1993, *Science* 261:1303; Carell et al., 1994, *Angew. Chem. Int. Ed. Engl.* 33:2059; Carell et al., 1994, *Angew. Chem. Int. Ed. Engl.* 33:2061; and in Gallop et al., 1994, *J. Med. Chem.* 37:1233). In addition, natural or synthetic compound libraries and compounds can be readily modified through conventional chemical, physical and biochemical means (see, e.g., Blondelle et al., 1996, *Trends in Biotech.* 14:60), and may be used to produce combinatorial libraries. In another approach, previously identified pharmacological agents can be subjected to directed or random chemical modifications, such as acylation, alkylation, esterification, amidification, and the analogs can be screened for 12q23-qter gene-modulating activity.

Numerous methods for producing combinatorial libraries are known in the art, including those involving biological libraries; spatially addressable parallel solid phase or solution phase libraries; synthetic library methods requiring deconvolution; the 'one-bead one-compound' library method; and synthetic library methods using affinity chromatography selection. The biological library approach is limited to polypeptide libraries, while the other four approaches are applicable to polypeptide, non-peptide oligomer, or small molecule libraries of compounds (K. S. Lam, 1997, *Anticancer Drug Des.* 12:145).

Non-limiting examples of small molecules, small molecule libraries, combinatorial libraries, and screening methods are described in B. Seligmann, 1995, "Synthesis, Screening, Identification of Positive Compounds and Optimization of Leads from Combinatorial Libraries: Validation of Success" p. 69-70. *Symposium: Exploiting Molecular Diversity: Small Molecule Libraries for Drug Discovery*, La Jolla, Calif., Jan. 23-25, 1995 (conference summary available from Wendy Warr & Associates, 6 Berwick Court, Cheshire, UK CW4 7HZ); E. Martin et al., 1995, *J. Med. Chem.* 38:1431-1436; E. Martin et al., 1995, "Measuring diversity: Experimental design of combinatorial libraries for drug discovery" Abstract, ACS Meeting, Anaheim, Calif., COMP 32; and E. Martin, 1995, "Measuring Chemical Diversity: Random Screening or Rationale Library Design" p. 27-30, *Symposium: Exploiting Molecular Diversity: Small Molecule Libraries for Drug Discovery*, La Jolla, Calif. Jan. 23-25, 1995 (conference summary available from Wendy Warr & Associates, 6 Berwick Court, Cheshire, UK CW4 7HZ).

Libraries may be screened in solution (e.g., Houghten, 1992, *Biotechniques* 13:412-421), or on beads (Lam, 1991, *Nature* 354:82-84), chips (Fodor, 1993, *Nature* 364:555-556), bacteria or spores (Ladner U.S. Pat. No. 5,223,409), plasmids (Cull et al., 1992, *Proc. Natl. Acad. Sci. USA* 89:1865-1869), or on phage (Scott and Smith, 1990, *Science* 249:386-390; Devlin, 1990, *Science* 249:404-406; Cwirla et al., 1990, *Proc. Natl. Acad. Sci. USA* 97:6378-6382; Felici, 1991, *J. Mol. Biol.* 222:301-310; Ladner, supra).

Where the screening assay is a binding assay, a 12q23-qter polypeptide, polynucleotide, analog, or fragment thereof, may be joined to a label, where the label can directly or indirectly provide a detectable signal. Various labels include radioisotopes, fluorescers, chemiluminescers, enzymes, specific binding molecules, particles, e.g., magnetic particles, and the like. Specific binding molecules include pairs, such as biotin and streptavidin, digoxin and antidigoxin, etc. For the specific binding members, the complementary member would normally be labeled with a molecule that provides for detection, in accordance with known procedures.

A variety of other reagents may be included in the screening assay. These include reagents like salts, neutral proteins, e.g., albumin, detergents, etc., that are used to facilitate optimal protein-protein binding and/or reduce non-specific or background interactions. Reagents that improve the efficiency of the assay, such as protease inhibitors, nuclease inhibitors, anti-microbial agents, etc., may be used. The components are added in any order that produces the requisite binding. Incubations are performed at any temperature that facilitates optimal activity, typically between 4° and 40° C. Incubation periods are selected for optimum activity, but may also be optimized to facilitate rapid high-throughput screening. Normally, between 0.1 and 1 hr will be sufficient. In general, a plurality of assay mixtures is run in parallel with different agent concentrations to obtain a differential response to these concentrations. Typically, one of these concentrations serves as a negative control, i.e., at zero concentration or below the level of detection.

To perform cell-free ligand screening assays, it may be desirable to immobilize either a 12q23-qter polypeptide, polynucleotide, or fragment to a surface to facilitate identification of ligands that bind to these molecules, as well as to accommodate automation of the assay. For example, a fusion protein comprising a 12q23-qter polypeptide and an affinity tag can be produced. In one embodiment, a glutathione-S-transferase/phosphodiesterase fusion protein comprising a 12q23-qter polypeptide is adsorbed onto glutathione sepharose beads (Sigma Chemical, St. Louis, Mo.) or glutathione-derivatized microtiter plates. Cell lysates (e.g., containing $^{35}$S-labeled polypeptides) are added to the coated beads under conditions to allow complex formation (e.g., at physiological conditions for salt and pH). Following incubation, the coated beads are washed to remove any unbound polypeptides, and the amount of immobilized radiolabel is determined. Alternatively, the complex is dissociated and the radiolabel present in the supernatant is determined. In another approach, the beads are analyzed by SDS-PAGE to identify the bound polypeptides.

Ligand-binding assays can be used to identify agonist or antagonists that alter the function or levels of a 12q23-qter polypeptide. Such assays are designed to detect the interaction of test agents (e.g., small molecules) with 12q23-qter polypeptides, polynucleotides, analogs, or fragments or portions thereof. Interactions may be detected by direct measurement of binding. Alternatively, interactions may be detected by indirect indicators of binding, such as stabilization/destabilization of protein structure, or activation/inhibition of biological function. Non-limiting examples of useful ligand-binding assays are detailed below.

Ligands that bind to 12q23-qter polypeptides, polynucleotides, analogs, or fragments or portions thereof, can be identified using real-time Bimolecular Interaction Analysis (BIA; Sjolander et al., 1991, *Anal. Chem.* 63:2338-2345; Szabo et al., 1995, *Curr. Opin. Struct. Biol.* 5:699-705). BIA-based technology (e.g., BIAcore™; LKB Pharmacia, Sweden) allows study of biospecific interactions in real time, without labeling. In BIA, changes in the optical phenomenon surface plasmon resonance (SPR) is used determine real-time interactions of biological molecules.

Ligands can also be identified by scintillation proximity assays (SPA, described in U.S. Pat. No. 4,568,649). In a modification of this assay that is currently undergoing development, chaperoning are used to distinguish folded and unfolded proteins. A tagged protein is attached to SPA beads, and test agents are added. The bead is then subjected to mild denaturing conditions (such as, e.g., heat, exposure to SDS, etc.) and a purified labeled chaperonin is added. If a test agent binds to a target, the labeled chaperonin will not bind; conversely, if no test agent binds, the protein will undergo some degree of denaturation and the chaperonin will bind.

Ligands can also be identified using a binding assay based on mitochondrial targeting signals (Hurt et al., 1985, *EMBO J.* 4:2061-2068; Eilers and Schatz, 1986, *Nature* 322:228-231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

The ligand-binding assay described in Fodor et al., 1991, *Science* 251:767-773, which involves testing the binding affinity of test compounds for a plurality of defined polymers synthesized on a solid substrate, can also be used.

Ligands that bind to 12q23-qter polypeptides or peptides can be identified using two-hybrid assays (see, e.g., U.S. Pat. No. 5,283,317; Zervos et al., 1993, *Cell* 72:223-232; Madura et al., 1993, *J. Biol. Chem.* 268:12046-12054; Bartel et al., 1993, *Biotechniques* 14:920-924; Iwabuchi et al., 1993, *Oncogene* 8:1693-1696; and Brent WO 94/10300). The two-hybrid system relies on the reconstitution of transcription activation activity by association of the DNA-binding and transcription activation domains of a transcriptional activator through protein-protein interaction. The yeast GAL4 transcriptional activator may be used in this way, although other transcription factors have been used and are well known in the art. To carryout the two-hybrid assay, the GAL4 DNA-binding domain, and the GAL4 transcription activation domain are expressed, separately, as fusions to potential interacting polypeptides.

In one embodiment, the "bait" protein comprises a 12q23-qter polypeptide fused to the GAL4 DNA-binding domain. The "fish" protein comprises, for example, a human cDNA library encoded polypeptide fused to the GAL4 transcription activation domain. If the two, coexpressed fusion proteins interact in the nucleus of a host cell, a reporter gene (e.g., LacZ) is activated to produce a detectable phenotype. The host cells that show two-hybrid interactions can be used to isolate the containing plasmids containing the cDNA library sequences. These plasmids can be analyzed to determine the nucleic acid sequence and predicted polypeptide sequence of the candidate ligand. Alternatively, methods such as the three-hybrid (Licitra et al., 1996, *Proc. Natl. Acad. Sci. USA* 93:12817-12821), and reverse two-hybrid (Vidal et al., 1996, *Proc. Natl. Acad. Sci. USA* 93:10315-10320) systems may be used. Commercially available two-hybrid systems such as the CLONTECH Matchmaker™ systems and protocols (CLONTECH Laboratories, Inc., Palo Alto, Calif.) may be also be used (see also, A. R. Mendelsohn et al., 1994, *Curr. Op. Biotech.* 5:482; E. M. Phizicky et al., 1995, *Microbiological Rev.* 59:94; M. Yang et al., 1995, *Nucleic Acids Res.* 23:1152; S. Fields et al., 1994, *Trends Genet.* 10:286; and U.S. Pat. Nos. 6,283,173 and 5,468,614).

Several methods of automated assays have been developed in recent years so as to permit screening of tens of thousands of test agents in a short period of time. High-throughput screening methods are particularly preferred for use with the present invention. The ligand-binding assays described herein can be adapted for high-throughput screens, or alternative screens may be employed. For example, continuous format high throughput screens (CF-HTS) using at least one porous matrix allows the researcher to test large numbers of test agents for a wide range of biological or biochemical activity (see U.S. Pat. No. 5,976,813 to Beutel et al.). Moreover, CF-HTS can be used to perform multi-step assays.

Diagnostics

As discussed herein, 12q23-qter genes are associated with various diseases and disorders, including but not limited to, asthma, atopy, obesity, male germ cell tumors, histidinemia, growth retardation with deafness and mental retardation, deficiency of Acyl-CoA dehydrogenase, spinal muscular atrophy, Darier disease, cardiomyopathy, Spinocerebellar ataxia-2, brachydactyl), Mevalonicaciduria, Hyperimmunoglobulinemia D, Noonan syndrome-1, Cardiofaciocutaneous syndrome, spinal muscular atrophy-4, tyrosinemia, phenylketonuria, B-cell non-Hodgkin lymphoma, Ulnar-mammary syndrome, Holt-Oram syndrome, Scapuloperoneal spinal muscular atrophy, alcohol intolerance, MODY, diabetes mellitus, non-insulin-dependent type 2, diabetes mellitus insulin-dependent (See National Center for Biotechnology Information; Bethesda, Md.), and inflammatory bowel disease (B. Wallaert et al., 1995, *J. Exp. Med.* 182:1897-1904). The present invention therefore provides nucleic acids and antibodies that can be useful in diagnosing individuals with disorders associated with aberrant 12q23-qter gene expression and/or mutated 12q23-qter genes. In particular, nucleic acids comprising 12q23-qter SNPs can be used to identify chromosomal abnormalities linked to these diseases. Additionally, antibodies directed against the amino acid variants encoded by the 12q23-qter SNPs can be used to identify disease-associated polypeptides.

Antibody-based diagnostic methods: In a further embodiment of the present invention, antibodies which specifically bind to a 12q23-qter polypeptide (e.g., SEQ ID NO:93 to SEQ ID NO:155) may be used for the diagnosis of conditions or diseases characterized by underexpression or overexpression of the 12q23-qter polynucleotide or polypeptide, or in assays to monitor patients being treated with a 12q23-qter polypeptide, polynucleotide, or antibody, or a 12q23-qter agonist, antagonist, or inhibitor.

The antibodies useful for diagnostic purposes may be prepared in the same manner as those for use in therapeutic methods, described herein. Antibodies may be raised to a full-length 12q23-qter polypeptide sequence (e.g., SEQ ID NO:93 to SEQ ID NO:155). Alternatively, the antibodies may be raised to portions or variants of the 12q23-qter polypeptide. Such variants include polypeptides encoded by the disclosed 12q23-qter SNPs or alternate splice variants. In one aspect of the invention, antibodies are prepared to bind to a 12q23-qter polypeptide fragment comprising one or more domains of the 12q23-qter polypeptide (e.g., transmembrane, intracellular, extracellular, SH3, fibronectin III repeat, cysteine-rich, and Ser/Thr-XXX-Val domains), as described in detail herein.

Diagnostic assays for a 12q23-qter polypeptide include methods that utilize the antibody and a label to detect the protein in biological samples (e.g., human body fluids, cells, tissues, or extracts of cells or tissues). The antibodies may be used with or without modification, and may be labeled by joining them, either covalently or non-covalently, with a reporter molecule. A wide variety of reporter molecules that are known in the art may be used, several of which are described herein.

The invention provides methods for detecting disease-associated antigenic components in a biological sample, which methods comprise the steps of: 1) contacting a sample suspected to contain a disease-associated antigenic component with an antibody specific for an disease-associated antigen, extracellular or intracellular, under conditions in which an antigen-antibody complex can form between the antibody and disease-associated antigenic components in the sample; and 2) detecting any antigen-antibody complex formed in step (1) using any suitable means known in the art, wherein the detection of a complex indicates the presence of disease-associated antigenic components in the sample. It will be understood that assays that utilize antibodies directed against altered 12q23-qter amino acid sequences (i.e., epitopes encoded by SNPs, modifications, mutations, or variants) are within the scope of the invention.

Many immunoassay formats are known in the art, and the particular format used is determined by the desired application. An immunoassay can use, for example, a monoclonal antibody directed against a single disease-associated epitope, a combination of monoclonal antibodies directed against different epitopes of a single disease-associated antigenic component, monoclonal antibodies directed towards epitopes of different disease-associated antigens, polyclonal antibodies directed towards the same disease-associated antigen, or polyclonal antibodies directed towards different disease-associated antigens. Protocols can also, for example, use solid supports, or may involve immunoprecipitation.

In accordance with the present invention, "competitive" (U.S. Pat. Nos. 3,654,090 and 3,850,752), "sandwich" (U.S. Pat. No. 4,016,043), and "double antibody," or "DASP" assays may be used. Several procedures for measuring the amount of a 12q23-qter polypeptide in a sample (e.g., ELISA, RIA, and FACS) are known in the art and provide a basis for diagnosing altered or abnormal levels of 12q23-qter polypeptide expression. Normal or standard values for a 12q23-qter polypeptide expression are established by incubating biological samples taken from normal subjects, preferably human, with antibody to a 12q23-qter polypeptide under conditions suitable for complex formation. The amount of standard complex formation may be quantified by various methods; photometric means are preferred. Levels of the 12q23-qter polypeptide expressed in the subject sample, negative control (normal) sample, and positive control (disease) sample are compared with the standard values. Deviation between standard and subject values establishes the parameters for diagnosing disease.

Typically, immunoassays use either a labeled antibody or a labeled antigenic component (i.e., to compete with the antigen in the sample for binding to the antibody). A number of fluorescent materials are known and can be utilized as labels for antibodies or polypeptides. These include, for example, Cy3, Cy5, GFP (e.g., EGFP, DsRed, dEFP, etc. (CLONTECH, Palo Alto, Calif.)), Alexa, BODIPY, fluorescein (e.g., Fluor X, DTAF, and FITC), rhodamine (e.g., TRITC), auramine, Texas Red, AMCA blue, and Lucifer Yellow. Antibodies or polypeptides can also be labeled with a radioactive element or with an enzyme. Preferred isotopes include $^{3}$H, $^{14}$C, 32 P, $^{35}$S, $^{36}$Cl, $^{51}$Cr, $^{57}$Co, $^{58}$Co, $^{59}$Fe, $^{90}$Y, $^{125}$I, $^{131}$I, and $^{186}$Re.

Preferred enzymes include peroxidase, β-glucuronidase, β-D-glucosidase, β-D-galactosidase, urease, glucose oxidase plus peroxidase, and alkaline phosphatase (see, e.g., U.S. Pat. Nos. 3,654,090; 3,850,752 and 4,016,043). Enzymes can be conjugated by reaction with bridging molecules such as carbodiimides, diisocyanates, glutaraldehyde, and the like. Enzyme labels can be detected visually, or measured by calorimetric, spectrophotometric, fluorospectrophotometric, amperometric, or gasometric techniques. Other labeling systems, such as avidin/biotin, Tyramide Signal Amplification (TSA™), are known in the art, and are commercially available (see, e.g., ABC kit, Vector Laboratories, Inc., Burlingame, Calif.; NEN® Life Science Products, Inc., Boston, Mass.).

Kits suitable for antibody-based diagnostic applications typically include one or more of the following components:

(1) Antibodies: The antibodies may be pre-labeled; alternatively, the antibody may be unlabeled and the ingredients for labeling may be included in the kit in separate containers, or a secondary, labeled antibody is provided; and (2) Reaction components: The kit may also contain other suitably packaged reagents and materials needed for the particular immunoassay protocol, including solid-phase matrices, if applicable, and standards.

The kits referred to above may include instructions for conducting the test. Furthermore, in preferred embodiments, the diagnostic kits are adaptable to high-throughput and/or automated operation.

Nucleic-acid-based diagnostic methods: The invention provides methods for detecting altered levels or sequences of 12q23-qter nucleic acids (e.g., SEQ ID NO:1 to SEQ ID NO:92 and SEQ ID NO:156 to SEQ ID NO:4687) in a sample, such as in a biological sample, comprising the steps of: 1) contacting a sample suspected to contain a disease-associated nucleic acid with one or more disease-associated nucleic acid probes under conditions in which hybrids can form between any of the probes and disease-associated nucleic acid in the sample; and 2) detecting any hybrids formed in step (1) using any suitable means known in the art, wherein the detection of hybrids indicates the presence of the disease-associated nucleic acid in the sample. Exemplary methods are described in Examples 9 and 10, herein below. To detect disease-associated nucleic acids present in low levels in biological samples, it may be necessary to amplify the disease-associated sequences or the hybridization signal as part of the diagnostic assay. Techniques for amplification are known to those of skill in the art.

The presence of a 12q23-qter polynucleotide sequences can be detected by DNA-DNA or DNA-RNA hybridization, or by amplification using probes or primers comprising at least a portion of a 12q23-qter polynucleotide, or a sequence complementary thereto. In particular, nucleic acid amplification-based assays can use 12q23-qter oligonucleotides or oligomers to detect transformants containing 12q23-qter DNA or RNA. Preferably, 12q23-qter nucleic acids useful as probes in diagnostic methods include oligonucleotides at least 15 contiguous nucleotides in length, more preferably at least 20 contiguous nucleotides in length, and most preferably at least 25-55 contiguous nucleotides in length, that hybridize specifically with 12q23-qter nucleic acids. As non-limiting examples, probes or primers useful for diagnostics may comprise any of the 12q23-qter DNA nucleotide sequences shown in Tables 8, 9, 11A, and 11B.

Several methods can be used to produce specific probes for 12q23-qter polynucleotides. For example, labeled probes can be produced by oligo-labeling, nick translation, end-labeling, or PCR amplification using a labeled nucleotide. Alternatively, 12q23-qter polynucleotide sequences (e.g., SEQ ID NO:1 to SEQ ID NO:92 and SEQ ID NO:156 to SEQ ID NO:4687), or any portions or fragments thereof, may be cloned into a vector for the production of an mRNA probe. Such vectors are known in the art, are commercially available, and may be used to synthesize RNA probes in vitro by addition of an appropriate RNA polymerase, such as T7, T3, or SP(6) and labeled nucleotides. These procedures may be conducted using a variety of commercially available kits (e.g., from Amersham-Pharmacia; Promega Corp.; and U.S. Biochemical Corp., Cleveland, Ohio). Suitable reporter molecules or labels which may be used include radionucleotides, enzymes, fluorescent, chemiluminescent, or chromogenic agents, as well as substrates, cofactors, inhibitors, magnetic particles, and the like.

A sample to be analyzed, such as, for example, a tissue sample (e.g., hair or buccal cavity) or body fluid sample (e.g., blood or saliva), may be contacted directly with the nucleic acid probes. Alternatively, the sample may be treated to extract the nucleic acids contained therein. It will be understood that the particular method used to extract DNA will depend on the nature of the biological sample. The resulting nucleic acid from the sample may be subjected to gel electrophoresis or other size separation techniques, or, the nucleic acid sample may be immobilized on an appropriate solid matrix without size separation.

Kits suitable for nucleic acid-based diagnostic applications typically include the following components:

(1) Probe DNA: The probe DNA may be prelabeled; alternatively, the probe DNA may be unlabeled and the ingredients for labeling may be included in the kit in separate containers; and (2) Hybridization reagents: The kit may also contain other suitably packaged reagents and materials needed for the particular hybridization protocol, including solid-phase matrices, if applicable, and standards.

In cases where a disease condition is suspected to involve an alteration of a 12q23-qter nucleotide sequence, specific oligonucleotides may be constructed and used to assess the level of disease mRNA in cells affected or other tissue affected by the disease. For example, PCR can be used to test whether a person has a disease-related polymorphism (i.e., mutation). Specific methods of polymorphism identification are described herein, but are not intended to limit the present invention. The detection of polymorphisms in DNA sequences can be accomplished by a variety of methods including, but not limited to, RFLP detection based on allele-specific restriction-endonuclease cleavage (Kan and Dozy, 1978, Lancet ii:910-912), hybridization with allele-specific oligonucleotide probes (Wallace et al., 1978, *Nucl Acids Res.* 6:3543-3557), including immobilized oligonucleotides (Saiki et al., 1969, *Proc. Natl. Acad. Sci. USA* 86:6230-6234) or oligonucleotide arrays (Maskos and Southern, 1993, *Nucl. Acids Res.* 21:2269-2270), allele-specific PCR (Newton et al., 1989, *Nucl. Acids Res.* 17:2503-2516), mismatch-repair detection (MRD) (Faham and Cox, 1995, *Genome Res.* 5:474-482), binding of MutS protein (Wagner et al., 1995, *Nucl. Acids Res.* 23:3944-3948), denaturing-gradient gel electrophoresis (DGGE) (Fisher and Lerman et al., 1983, *Proc. Natl. Acad. Sci. USA.* 80:1579-1583), single-strand-conformation-polymorphism detection (Orita et al., 1983, *Genomics* 5:874-879), RNAase cleavage at mismatched base-pairs (Myers et al., 1985, *Science* 230:1242), chemical (Cotton et al., 1988, *Proc. Natl. Acad. Sci. USA* 8:4397-4401) or enzymatic (Youil et al., 1995, *Proc. Natl. Acad. Sci. USA* 92:87-91) cleavage of heteroduplex DNA, methods based on allele specific primer extension (Syvanen et al., 1990, *Genomics* 8:684-692), genetic bit analysis (GBA) Nikiforov et al., 1994, *Nucl. Acids* 22:4167-4175), the oligonucleotide-ligation assay (OLA) (Landegren et al., 1988, Science 241: 1077), the allele-specific ligation chain reaction (LCR) (Barrany, 1991, *Proc. Natl. Acad. Sci. USA* 88:189-193), gap-LCR (Abravaya et al., 1995, *Nucl. Acids Res.* 23:675-682), radioactive and/or fluorescent DNA sequencing using standard procedures well known in the art, and peptide nucleic acid (PNA) assays (Orum et al., 1993, *Nucl. Acids Res.* 21:5332-5356).

For PCR analysis, 12q23-qter oligonucleotides may be chemically synthesized, generated enzymatically, or produced from a recombinant source. Oligomers will preferably comprise two nucleotide sequences, one with a sense orientation (5'→3') and another with an antisense orientation (3'→5'), employed under optimized conditions for identification of a specific gene or condition. The same two oligomers, nested sets of oligomers, or even a degenerate pool of oligomers may be employed under less stringent conditions for detection and/or quantification of closely related DNA or RNA sequences.

In accordance with PCR analysis, two oligonucleotides are synthesized by standard methods or are obtained from a commercial supplier of custom-made oligonucleotides. The length and base composition are determined by standard criteria using the Oligo 4.0 primer Picking program (W. Rychlik, 1992; available from Molecular Biology Insights, Inc., Cascade, Colo.). One of the oligonucleotides is designed so that it will hybridize only to the disease gene DNA under the PCR conditions used. The other oligonucleotide is designed to hybridize a segment of genomic DNA such that amplification of DNA using these oligonucleotide primers produces a conveniently identified DNA fragment. Samples may be obtained from hair follicles, whole blood, or the buccal cavity. The DNA fragment generated by this procedure is sequenced by standard techniques.

In one particular aspect, 12q23-qter oligonucleotides can be used to perform Genetic Bit Analysis (GBA) of 12q23-qter genes in accordance with published methods (T. T. Nikiforov et al., 1994, *Nucleic Acids Res.* 22(20):4167-75; T. T. Nikiforov T T et al., 1994, *PCR Methods Appl.* 3(5):285-91). In PCR-based GBA, specific fragments of genomic DNA containing the polymorphic site(s) are first amplified by PCR using one unmodified and one phosphorothioate-modified primer. The double-stranded PCR product is rendered single-stranded and then hybridized to immobilized oligonucleotide primer in wells of a multi-well plate. The primer is designed to anneal immediately adjacent to the polymorphic site of interest. The 3' end of the primer is extended using a mixture of individually labeled dideoxynucleoside triphosphates. The label on the extended base is then determined. Preferably, GBA is performed using semi-automated ELISA or biochip formats (see, e.g., S. R. Head et al., 1997, *Nucleic Acids Res.* 25(24):5065-71; T. T. Nikiforov et al., 1994, *Nucleic Acids Res.* 22(20):4167-75).

Other amplification techniques besides PCR may be used as alternatives, such as ligation-mediated PCR or techniques involving Q-beta replicase (Cahill et al., 1991, *Clin. Chem.*, 37(9):1482-5). Products of amplification can be detected by agarose gel electrophoresis, quantitative hybridization, or equivalent techniques for nucleic acid detection known to one skilled in the art of molecular biology (Sambrook et al., 1989). Other alterations in the disease gene may be diagnosed by the same type of amplification-detection procedures, by using oligonucleotides designed to contain and specifically identify those alterations.

In accordance with the present invention, 12q23-qter polynucleotides may also be used to detect and quantify levels of 12q23-qter mRNA in biological samples in which altered expression of 12q23-qter polynucleotide may be correlated with disease. These diagnostic assays may be used to distinguish between the absence, presence, increase, and decrease of 12q23-qter mRNA levels, and to monitor regulation of 12q23-qter polynucleotide levels during therapeutic treatment or intervention. For example, 12q23-qter polynucleotide sequences, or fragments, or complementary sequences thereof, can be used in Southern or Northern analysis, dot blot, or other membrane-based technologies; in PCR technologies; or in dip stick, pin, ELISA or biochip assays utilizing fluids or tissues from patient biopsies to detect the status of, e.g., levels or overexpression of 12q23-qter genes, or to detect altered 12q23-qter gene expression. Such qualitative or quantitative methods are well known in the art (G. H. Keller and M. M. Manak, 1993, *DNA Probes*, $2^{nd}$ Ed, Macmillan Publishers Ltd., England; D. W. Dieffenbach and G. S. Dveksler, 1995, *PCR Primer: A Laboratory Manual*, Cold Spring Harbor Press, Plainview, N.Y.; B. D. Hames and S. J. Higgins, 1985, *Gene Probes* 1, 2, IRL Press at Oxford University Press, Oxford, England).

Methods suitable for quantifying the expression of 12q23-qter genes include radiolabeling or biotinylating nucleotides, co-amplification of a control nucleic acid, and standard curves onto which the experimental results are interpolated (P. C. Melby et al., 1993, *J. Immunol. Methods* 159:235-244; and C. Duplaa et al., 1993, *Anal. Biochem.* 212(1):229-36.). The speed of quantifying multiple samples may be accelerated by running the assay in an ELISA format where the oligomer of interest is presented in various dilutions and a spectrophotometric or calorimetric response gives rapid quantification.

In accordance with these methods, the specificity of the probe, i.e., whether it is made from a highly specific region (e.g., at least 8 to 10 or 12 or 15 contiguous nucleotides in the 5' regulatory region), or a less specific region (e.g., especially in the 3' coding region), and the stringency of the hybridization or amplification (e.g., high, moderate, or low) will determine whether the probe identifies naturally occurring sequences encoding the 12q23-qter polypeptide, or alleles, SNPs, mutants, or related sequences.

In a particular aspect, a 12q23-qter nucleic acid sequence (e.g., SEQ ID NO:1 to SEQ ID NO:92 and SEQ ID NO:156 to SEQ ID NO:4687), or a sequence complementary thereto, or fragment thereof, may be useful in assays that detect 12q23-qter-related diseases such as asthma. A 12q23-qter polynucleotide can be labeled by standard methods, and added to a biological sample from a subject under conditions suitable for the formation of hybridization complexes. After a suitable incubation period, the sample can be washed and the signal is quantified and compared with a standard value. If the amount of signal in the test sample is significantly altered from that of a comparable negative control (normal) sample, the altered levels of a 12q23-qter nucleotide sequence can be correlated with the presence of the associated disease. Such assays may also be used to evaluate the efficacy of a particular prophylactic or therapeutic regimen in animal studies, in clinical trials, or for an individual patient.

To provide a basis for the diagnosis of a disease associated with altered expression of a 12q23-qter gene, a normal or standard profile for expression is established. This may be accomplished by incubating biological samples taken from normal subjects, either animal or human, with a sequence complementary to the 12q23-qter polynucleotide, or a fragment thereof, under conditions suitable for hybridization or amplification. Standard hybridization may be quantified by comparing the values obtained from normal subjects with those from an experiment where a known amount of a substantially purified polynucleotide is used. Standard values obtained from normal samples may be compared with values obtained from samples from patients who are symptomatic for the disease. Deviation between standard and subject (patient) values is used to establish the presence of the condition.

Once the disease is diagnosed and a treatment protocol is initiated, hybridization assays may be repeated on a regular basis to evaluate whether the level of expression in the patient begins to approximate that which is observed in a normal individual. The results obtained from successive assays may be used to show the efficacy of treatment over a period ranging from several days to months.

With respect to diseases such as asthma, the presence of an abnormal amount of a 12q23-qter transcript in a biological sample (e.g., body fluid, cells, tissues, or cell or tissue extracts) from an individual may indicate a predisposition for the development of the disease, or may provide a means for detecting the disease prior to the appearance of actual clinical symptoms. A more definitive diagnosis of this type may allow health professionals to employ preventative measures or aggressive treatment earlier, thereby preventing the development or further progression of the disease.

Microarrays: In another embodiment of the present invention, oligonucleotides, or longer fragments derived from a 12q23-qter polynucleotide sequence described herein may be used as targets in a microarray (e.g., biochip) system. The microarray can be used to monitor the expression level of large numbers of genes simultaneously (to produce a transcript image), and to identify genetic variants, mutations, and polymorphisms. This information may be used to determine gene function, to understand the genetic basis of a disease, to diagnose disease, and to develop and monitor the activities of therapeutic or prophylactic agents. Preparation and use of microarrays have been described in WO 95/11995 to Chee et al.; D. J. Lockhart et al., 1996, *Nature Biotechnology* 14:1675-1680; M. Schena et al., 1996, *Proc. Natl. Acad. Sci. USA* 93:10614-10619; U.S. Pat. No. 6,015,702 to P. Lal et al; J. Worley et al., 2000, *Microarray Biochip Technology*, M. Schena, ed., Biotechniques Book, Natick, Mass. pp. 65-86; Y. H. Rogers et al., 1999, *Anal. Biochem.* 266(1):23-30; S. R. Head et al., 1999, *Mol. Cell. Probes.* 13(2):81-7; S. J. Watson et al., 2000, *Biol. Psychiatry* 48(12):1147-56.

In one application of the present invention, microarrays containing arrays of 12q23-qter polynucleotide sequences can be used to measure the expression levels of 12q23-qter nucleic acids in an individual. In particular, to diagnose an individual with a 12q23-qter-related condition or disease, a sample from a human or animal (containing nucleic acids, e.g., mRNA) can be used as a probe on a biochip containing an array of 12q23-qter polynucleotides (e.g., DNA) in decreasing concentrations (e.g., 1 ng, 0.1 ng, 0.01 ng, etc.). The test sample can be compared to samples from diseased and normal samples. Biochips can also be used to identify 12q23-qter mutations or polymorphisms in a population, including but not limited to, deletions, insertions, and mismatches. For example, mutations can be identified by: 1) placing 12q23-qter polynucleotides of this invention onto a biochip; 2) taking a test sample (containing, e.g., mRNA) and adding the sample to the biochip; 3) determining if the test samples hybridize to the 12q23-qter polynucleotides attached to the chip under various hybridization conditions (see, e.g., V. R. Chechetkin et al., 2000, *J. Biomol. Struct. Dyn.* 18(1): 83-101). Alternatively microarray sequencing can be performed (see, e.g., E. P. Diamandis, 2000, *Clin. Chem.* 46(10): 1523-5).

Chromosome mapping: In another application of this invention, 12q23-qter nucleic acid sequences (e.g., SEQ ID NO:1 to SEQ ID NO:92 and SEQ ID NO: 156 to SEQ ID NO:4687), or complementary sequences, or fragments thereof, can be used as probes to map genomic sequences. The sequences may be mapped to a particular chromosome, to a specific region of a chromosome, or to human artificial chromosome constructions (HACs), yeast artificial chromosomes (YACs), bacterial artificial chromosomes (BACs), bacterial PI constructions, or single chromosome cDNA libraries (see, e.g., C. M. Price, 1993, *Blood Rev.*, 7:127-134; B. J. Trask, 1991, *Trends Genet.* 7:149-154).

In another of its aspects, the invention relates to a diagnostic kit for detecting a 12q23-qter polynucleotide or polypeptide as it relates to a disease or susceptibility to a disease, particularly asthma. Also related is a diagnostic kit that can be used to detect or assess asthma conditions. Such kits comprise one or more of the following:

(a) a 12q23-qter polynucleotide, preferably the nucleotide sequence of any one of SEQ ID NO:1 to SEQ ID NO:92 and SEQ ID NO:156 to SEQ ID NO:4687, or a fragment thereof; or (b) a nucleotide sequence complementary to that of (a); or (c) a 12q23-qter polypeptide, preferably the polypeptide of any one of SEQ ID NO:93 to SEQ ID NO:155, or a fragment thereof; or (d) an antibody to a 12q23-qter polypeptide, preferably to the polypeptide of any one of SEQ ID NO:93 to SEQ ID NO:155, or an antibody bindable fragment thereof. It will be appreciated that in any such kits, (a), (b), (c), or (d) may comprise a substantial component and that instructions for use can be included. The kits may also contain peripheral reagents such as buffers, stabilizers, etc.

The present invention also includes a test kit for genetic screening that can be utilized to identify mutations in 12q23-qter genes. By identifying patients with mutated 12q23-qter DNA and comparing the mutation to a database that contains known mutations in 12q23-qter and a particular condition or disease, identification and/or confirmation of, a particular condition or disease can be made. Accordingly, such a kit would comprise a PCR-based test that would involve transcribing the patients mRNA with a specific primer, and amplifying the resulting cDNA using another set of primers. The amplified product would be detectable by gel electrophoresis and could be compared with known standards for 12q23-qter genes. Preferably, this kit would utilize a patient's blood, serum, or saliva sample, and the DNA would be extracted using standard techniques. Primers flanking a known mutation would then be used to amplify a fragment of a 12q23-qter gene. The amplified piece would then be sequenced to determine the presence of a mutation.

Genomic Screening: Polymorphic genetic markers linked to a 12q23-qter gene can be used to predict susceptibility to the diseases genetically linked to that chromosomal region. Similarly, the identification of polymorphic genetic markers within 12q23-qter genes will allow the identification of specific allelic variants that are in linkage disequilibrium with other genetic lesions that affect one of the disease states discussed herein including respiratory disorders, obesity, and inflammatory bowel disease. SSCP (see below) allows the identification of polymorphisms within the genomic and coding region of the disclosed genes.

The present invention provides sequences for primers that can be used identify exons that contain SNPs, as well as sequences for primers that can be used to identify the sequence changes of the SNPs. In particular, Table 10 shows polymorphic genetic markers within the chromosome 12q23-qter genes, which can be used to identify specific allelic variants that are in linkage disequilibrium with other genetic lesions that affect one of the disease states discussed herein, including respiratory disorders, obesity, and inflammatory bowel disease. Such markers can be used in conjunction with SSCP to identify polymorphisms within the genomic and coding region of the disclosed gene. Table 8 shows primers that can be used to identify exons containing SNPs. Table 9 shows primers that can be used to identify the sequence changes of the SNPs.

This information can be used to identify additional SNPs in accordance with the methods disclosed herein. Suitable methods for genomic screening have also been described by, e.g., Sheffield et al., 1995, *Genet.* 4:1837-1844; LeBlanc-Straceski et al., 1994, *Genomics* 19:341-9; Chen et al., 1995, *Genomics* 25:1-8. In employing these methods, the disclosed reagents can be used to predict the risk for disease (e.g., respiratory disorders, obesity, and inflammatory bowel disease) in a population or individual.

Therapeutics

As discussed herein, 12q23-qter genes are associated with various diseases and disorders, including but not limited to, asthma, atopy, obesity, male germ cell tumors, histidinemia, growth retardation with deafness and mental retardation, deficiency of Acyl-CoA dehydrogenase, spinal muscular atrophy, Darier disease, cardiomyopathy, Spinocerebellar ataxia-2, brachydactyl), Mevalonicaciduria, Hyperimmunoglobulinemia D, Noonan syndrome-1, Cardiofaciocutaneous syndrome, spinal muscular atrophy-4, tyrosinemia, phenylketonuria, B-cell non-Hodgkin lymphoma, Ulnar-mammary syndrome, Holt-Oram syndrome, Scapuloperoneal spinal muscular atrophy, alcohol intolerance, MODY, diabetes mellitus, non-insulin-dependent type 2, diabetes mellitus insulin-dependent (See National Center for Biotechnology Information; Bethesda, Md.), and inflammatory bowel disease (B. Wallaert et al., 1995, *J. Exp. Med.* 182:1897-1904). The present invention therefore provides compositions (e.g., pharmaceutical compositions) comprising 12q23-qter nucleic acids, polypeptides, antibodies, ligands, or variants, portions, or fragments thereof that can be useful in treating individuals with these disorders. Also provided are methods employing 12q23-qter nucleic acids, polypeptides, antibodies, ligands, or variants, portions, or fragments thereof to identify drug candidates that can be used to prevent, treat, or ameliorate such disorders.

Drug screening and design: The present invention provides methods of screening for drugs using a 12q23-qter polypeptide (e.g., SEQ ID NO:93 to SEQ ID NO:155), or portion thereof, in competitive binding assays, according to methods well-known in the art. For example, competitive drug screening assays can be employed using neutralizing antibodies capable of specifically binding a 12q23-qter polypeptide compete with a test compound for binding to the 12q23-qter polypeptide or fragments thereof.

The present invention further provides methods of rational drug design employing a 12q23-qter polypeptide, antibody, or portion or functional equivalent thereof. The goal of rational drug design is to produce structural analogs of biologically active polypeptides of interest or of small molecules with which they interact (e.g., agonists, antagonists, or inhibitors). In turn, these analogs can be used to fashion drugs which are, for example, more active or stable forms of the polypeptide, or which, e.g., enhance or interfere with the function of the polypeptide in vivo (see, e.g., Hodgson, 1991, *Bio/Technology,* 9:19-21). An example of rational drug design is the development of HIV protease inhibitors (Erickson et al., 1990, *Science,* 249:527-533).

In one approach, one first determines the three-dimensional structure of a protein of interest or, for example, of a 12q23-qter polypeptide or ligand complex, by x-ray crystallography, computer modeling, or a combination thereof. Useful information regarding the structure of a polypeptide can also be gained by computer modeling based on the structure of homologous proteins. In addition, 12q23-qter polypeptides (e.g., SEQ ID NO:93 to SEQ ID NO:155), or portions thereof, can be analyzed by an alanine scan (Wells, 1991, *Methods in Enzymol.,* 202:390-411). In this technique, each amino acid residue in a 12q23-qter polypeptide is replaced by alanine, and its effect on the activity of the polypeptide is determined.

In another approach, an antibody specific to a 12q23-qter polypeptide can be isolated, selected by a functional assay, and then analyzed to solve its crystal structure. In principle, this approach can yield a pharmacore upon which subsequent drug design can be based. Alternatively, it is possible to bypass protein crystallography altogether by generating anti-idiotypic antibodies (anti-ids) to a functional, pharmacologically active antibody. As a mirror image of a mirror image, the binding site of the anti-ids is predicted to be an analog of the corresponding 12q23-qter polypeptide. The anti-id can then be used to identify and isolate peptides from banks of chemically or biologically produced banks of peptides. Selected peptides can subsequently be used as pharmacores.

Non-limiting examples of methods and computer tools for drug design are described in R. Cramer et al., 1974, *J. Med. Chem.* 17:533; H. Kubinyi (ed) 1993, 3*D QSAR in Drug Design, Theory, Methods, and Applications*, ESCOM, Leiden, Holland; P. Dean (ed) 1995, *Molecular Similarity in Drug Design*, K. Kim "Comparative molecular field analysis (ComFA)" p. 291-324, Chapman & Hill, London, UK; Y. et al., 1993, *J. Comp.-Aid. Mol. Des.* 7:83-102; G. Lauri and P. A. Bartlett, 1994, *J. Comp.-Aid. Mol. Des.* 8:51-66; P. J. Gane and P. M. Dean, 2000, *Curr. Opin. Struct. Biol.* 10(4):401-4; H. O. Kim and M. Kahn, 2000, *Comb. Chem. High Throughput Screen.* 3(3):167-83; G. K. Farber, 1999, *Pharmacol Ther.* 84(3):327-32; and H. van de Waterbeemd (ed) 1996, *Structure-Property Correlations in Drug Research*, Academic Press, San Diego, Calif.

In another aspect of the present invention, cells and animals that carry a 12q23-qter gene or an analog thereof can be used as model systems to study and test for substances that have potential as therapeutic agents. After a test agent is administered to animals or applied to the cells, the phenotype of the animals/cells can be determined.

In accordance with these methods, one may design drugs that result in, for example, altered 12q23-qter polypeptide activity or stability. Such drugs may act as inhibitors, agonists, or antagonists of a 12q23-qter polypeptide. By virtue of the availability of cloned 12q23-qter gene sequences, sufficient amounts of the 12q23-qter polypeptide may be produced to perform such analytical studies as x-ray crystallography. In addition, the knowledge of the 12q23-qter polypeptide sequence will guide those employing computer-modeling techniques in place of, or in addition to x-ray crystallography.

Pharmaceutical compositions: The present invention contemplates compositions comprising a 12q23-qter polynucleotide (e.g., SEQ ID NO:1 to SEQ ID NO:92 and SEQ ID NO:156 to SEQ ID NO:4687), polypeptide (e.g., SEQ ID NO:93 to SEQ ID NO:155), antibody, ligand (e.g., agonist, antagonist, or inhibitor), or fragments, variants, or analogs thereof, and a physiologically acceptable carrier, excipient, or diluent as described in detail herein. The present invention further contemplates pharmaceutical compositions useful in practicing the therapeutic methods of this invention. Preferably, a pharmaceutical composition includes, in admixture, a pharmaceutically acceptable excipient (carrier) and one or more of a 12q23-qter polypeptide, polynucleotide, ligand, antibody, or fragment, portion, or variant thereof, as described herein, as an active ingredient. The preparation of pharmaceutical compositions that contain 12q23-qter molecules as active ingredients is well understood in the art. Typically, such compositions are prepared as injectables, either as liquid solutions or suspensions, however, solid forms suitable for solution in, or suspension in, liquid prior to injection can also be prepared. The preparation can also be emulsified. The active therapeutic ingredient is often mixed with excipients that are pharmaceutically acceptable and compatible with the active ingredient. Suitable excipients are, for example, water, saline, dextrose, glycerol, ethanol, or the like and combinations thereof. In addition, if desired, the composition can contain minor amounts of auxiliary substances such as wetting or emulsifying agents, pH-buffering agents, which enhance the effectiveness of the active ingredient.

A 12q23-qter polypeptide, polynucleotide, ligand, antibody, or fragment, portion, or variant thereof can be formulated into the pharmaceutical composition as neutralized physiologically acceptable salt forms. Suitable salts include the acid addition salts (i.e., formed with the free amino groups of the polypeptide or antibody molecule) and which are formed with inorganic acids such as, for example, hydrochloric or phosphoric acids, or such organic acids as acetic, oxalic, tartaric, mandelic, and the like. Salts formed from the free carboxyl groups can also be derived from inorganic bases such as, for example, sodium, potassium, ammonium, calcium, or ferric hydroxides, and such organic bases as isopropylamine, trimethylamine, 2-ethylamino ethanol, histidine, procaine, and the like.

The pharmaceutical compositions can be administered systemically by oral or parenteral routes. Non-limiting parenteral routes of administration include subcutaneous, intramuscular, intraperitoneal, intravenous, transdermal, inhalation, intranasal, intra-arterial, intrathecal, enteral, sublingual, or rectal. Intravenous administration, for example, can be performed by injection of a unit dose. The term "unit dose" when used in reference to a pharmaceutical composition of the present invention refers to physically discrete units suitable as unitary dosage for humans, each unit containing a predetermined quantity of active material calculated to produce the desired therapeutic effect in association with the required diluent; i.e., carrier, or vehicle.

In one particular embodiment of the present invention, the disclosed pharmaceutical compositions are administered via mucoactive aerosol therapy (see, e.g., M. Fuloria and B. K. Rubin, 2000, *Respir. Care* 45:868-873; I. Gonda, 2000, *J. Pharm. Sci.* 89:940-945; R. Dhand, 2000, *Curr. Opin. Pulm. Med.* 6(1):59-70; B. K. Rubin, 2000, *Respir. Care* 45(6):684-94; S. Suarez and A. J. Hickey, 2000, *Respir. Care.* 45(6):652-66).

Pharmaceutical compositions are administered in a manner compatible with the dosage formulation, and in a therapeutically effective amount. The quantity to be administered depends on the subject to be treated, capacity of the subject's immune system to utilize the active ingredient, and degree of modulation of 12q23-qter gene activity desired. Precise amounts of active ingredient required to be administered depend on the judgment of the practitioner and are specific for each individual. However, suitable dosages may range from about 0.1 to 20, preferably about 0.5 to about 10, and more preferably one to several, milligrams of active ingredient per kilogram body weight of individual per day and depend on the route of administration. Suitable regimes for initial administration and booster shots are also variable, but are typified by an initial administration followed by repeated doses at one or more hour intervals by a subsequent injection or other administration. Alternatively, continuous intravenous infusions sufficient to maintain concentrations of 10 nM to 10 μM in the blood are contemplated. An exemplary pharmaceutical formulation comprises: 12q23-qter antagonist or inhibitor (5.0 mg/ml); sodium bisulfite USP (3.2 mg/ml); disodium edetate USP (0.1 mg/ml); and water for injection q.s.a.d. (1.0 ml). As used herein, "pg" means picogram, "ng" means nanogram, "μg" means microgram, "mg" means milligram, "μl" means microliter, "ml" means milliliter, and "l" means L.

For further guidance in preparing pharmaceutical formulations, see, e.g., Gilman et al. (eds), 1990, *Goodman and Gilman's: The Pharmacological Basis of Therapeutics,* 8th ed., Pergamon Press; and *Remington's Pharmaceutical Sci-*

*ences,* 17th ed., 1990, Mack Publishing Co., Easton, Pa.; Avis et al. (eds), 1993, *Pharmaceutical Dosage Forms: Parenteral Medications,* Dekker, New York; Lieberman et al. (eds), 1990, *Pharmaceutical Dosage Forms: Disperse Systems,* Dekker, New York.

In yet another aspect of this invention, antibodies that specifically react with a 12q23-qter polypeptide or peptides derived therefrom can be used as therapeutics. In particular, such antibodies can be used to block the activity of a 12q23-qter polypeptide. Antibodies or fragments thereof can be formulated as pharmaceutical compositions and administered to a subject. It is noted that antibody-based therapeutics produced from non-human sources can cause an undesired immune response in human subjects. To minimize this problem, chimeric antibody derivatives can be produced. Chimeric antibodies combine a non-human animal variable region with a human constant region. Chimeric antibodies can be constructed according to methods known in the art (see Morrison et al., 1985, *Proc. Natl. Acad. Sci. USA* 81:6851; Takeda et al., 1985, *Nature* 314:452; U.S. Pat. No. 4,816,567 of Cabilly et al.; U.S. Pat. No. 4,816,397 of Boss et al.; European Patent Publication EP 171496; EP 0173494; United Kingdom Patent GB 2177096B).

In addition, antibodies can be further "humanized" by any of the techniques known in the art, (e.g., Teng et al., 1983, *Proc. Natl. Acad. Sci. USA* 80:7308-7312; Kozbor et al., 1983, *Immunology Today* 4: 7279; Olsson et al., 1982, *Meth. Enzymol.* 92:3-16; International Patent Application WO92/06193; EP 0239400). Humanized antibodies can also be obtained from commercial sources (e.g., Scotgen Limited, Middlesex, England). Immunotherapy with a humanized antibody may result in increased long-term effectiveness for the treatment of chronic disease situations or situations requiring repeated antibody treatments.

Pharmacogenetics: The 12q23-qter polynucleotides (e.g., SEQ ID NO:1 to SEQ ID NO:92 and SEQ ID NO:156 to SEQ ID NO:4687) and polypeptides (e.g., SEQ ID NO:93 to SEQ ID NO:155) of the invention are also useful in pharmacogenetic analysis (i.e., the study of the relationship between an individual's genotype and that individual's response to a therapeutic composition or drug). See, e.g., M. Eichelbaum, 1996, *Clin. Exp. Pharmacol. Physiol.* 23(10-11):983-985, and M. W. Linder, 1997, *Clin. Chem.* 43(2):254-266. The genotype of the individual can determine the way a therapeutic acts on the body or the way the body metabolizes the therapeutic. Further, the activity of drug metabolizing enzymes affects both the intensity and duration of therapeutic activity. Differences in the activity or metabolism of therapeutics can lead to severe toxicity or therapeutic failure. Accordingly, a physician or clinician may consider applying knowledge obtained in relevant pharmacogenetic studies in determining whether to administer a 12q23-qter polypeptide, polynucleotide, analog, antagonist, inhibitor, or modulator, as well as tailoring the dosage and/or therapeutic or prophylactic treatment regimen.

In general, two types of pharmacogenetic conditions can be differentiated. Genetic conditions can be due to a single factor that alters the way the drug act on the body (altered drug action), or a factor that alters the way the body metabolizes the drug (altered drug metabolism). These conditions can occur either as rare genetic defects or as naturally-occurring polymorphisms. For example, glucose-6-phosphate dehydrogenase deficiency (G6PD) is a common inherited enzymopathy which results in haemolysis after ingestion of oxidant drugs (anti-malarials, sulfonamides, analgesics, nitrofurans) and consumption of fava beans.

The discovery of genetic polymorphisms of drug metabolizing enzymes (e.g., N-acetyltransferase 2 (NAT 2) and cytochrome P450 enzymes CYP2D6 and CYP2C19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. The gene coding for CYP2D6 is highly polymorphic and several mutations have been identified in PM, which all lead to the absence of functional CYP2D6. Poor metabolizers quite frequently experience exaggerated drug response and side effects when they receive standard doses. If a metabolite is the active therapeutic moiety, PM show no therapeutic response. This has been demonstrated for the analgesic effect of codeine mediated by its CYP2D6-formed metabolite morphine. At the other extreme, ultra-rapid metabolizers fail to respond to standard doses. Recent studies have determined that ultra-rapid metabolism is attributable to CYP2D6 gene amplification.

By analogy, genetic polymorphism or mutation may lead to allelic variants of 12q23-qter genes in the population which have different levels of activity. The 12q23-qter polypeptides or polynucleotides thereby allow a clinician to ascertain a genetic predisposition that can affect treatment modality. In addition, genetic mutation or variants at other genes may potentiate or diminish the activity of 12q23-qter-targeted drugs. Thus, in a 12q23-qter gene-based treatment, a polymorphism or mutation may give rise to individuals that are more or less responsive to treatment. Accordingly, dosage would necessarily be modified to maximize the therapeutic effect within a given population containing the polymorphism. As an alternative to genotyping, specific polymorphic polypeptides or polynucleotides can be identified.

To identify genes that modify 12q23-qter-targeted drug response, several pharmacogenetic methods can be used. One pharmacogenomics approach, "genome-wide association", relies primarily on a high-resolution map of the human genome. This high-resolution map shows previously identified gene-related markers (e.g., a "bi-allelic" gene marker map which consists of 60,000-100,000 polymorphic or variable sites on the human genome, each of which has two variants). A high-resolution genetic map can then be compared to a map of the genome of each of a statistically significant number of patients taking part in a Phase II/III drug trial to identify markers associated with a particular observed drug response or side effect. Alternatively, a high-resolution map can be generated from a combination of some ten million known single nucleotide polymorphisms (SNPs) in the human genome. Given a genetic map based on the occurrence of such SNPs, individuals can be grouped into genetic categories depending on a particular pattern of SNPs in their individual genome. In this way, treatment regimens can be tailored to groups of genetically similar individuals, taking into account traits that may be common among such genetically similar individuals (see, e.g., D. R. Pfost et al., 2000, *Trends Biotechnol.* 18(8):334-8).

As another example, the "candidate gene approach", can be used. According to this method, if a gene that encodes a drug target is known, all common variants of that gene can be fairly easily identified in the population and it can be determined if having one version of the gene versus another is associated with a particular drug response.

As yet another example, a "gene expression profiling approach", can be used. This method involves testing the gene expression of an animal treated with a drug (e.g., a 12q23-qter polypeptide, polynucleotide, analog, or modulator) to determine whether gene pathways related to toxicity have been turned on.

Information obtained from one of the approaches described herein can be used to establish a pharmacogenetic profile, which can be used to determine appropriate dosage and treatment regimens for prophylactic or therapeutic treatment an individual. A pharmacogenetic profile, when applied to dosing or drug selection, can be used to avoid adverse reactions or therapeutic failure and thus enhance therapeutic or prophylactic efficiency when treating a subject with a 12q23-qter polypeptide, polynucleotide, analog, antagonist, inhibitor, or modulator.

The 12q23-qter polypeptides or polynucleotides of the invention are also useful for monitoring therapeutic effects during clinical trials and other treatment. Thus, the therapeutic effectiveness of an agent that is designed to increase or decrease gene expression, polypeptide levels, or activity can be monitored over the course of treatment using the 12q23-qter compositions or modulators. For example, monitoring can be performed by: 1) obtaining a pre-administration sample from a subject prior to administration of the agent; 2) detecting the level of expression or activity of the protein in the pre-administration sample; 3) obtaining one or more post-administration samples from the subject; 4) detecting the level of expression or activity of the polypeptide in the post-administration samples; 5) comparing the level of expression or activity of the polypeptide in the pre-administration sample with the polypeptide in the post-administration sample or samples; and 6) increasing or decreasing the administration of the agent to the subject accordingly.

Gene Therapy: The 12q23-qter polynucleotides (e.g., SEQ ID NO:1 to SEQ ID NO:92 and SEQ ID NO:156 to SEQ ID NO:4687) and polypeptides (e.g., SEQ ID NO:93 to SEQ ID NO:155) of the invention also find use as gene therapy reagents. In recent years, significant technological advances have been made in the area of gene therapy for both genetic and acquired diseases (Kay et al., 1997, *Proc. Natl. Acad. Sci. USA*, 94:12744-12746). Gene therapy can be defined as the transfer of DNA for therapeutic purposes. Improvement in gene transfer methods has allowed for development of gene therapy protocols for the treatment of diverse types of diseases. Gene therapy has also taken advantage of recent advances in the identification of new therapeutic genes, improvement in both viral and non-viral gene delivery systems, better understanding of gene regulation, and improvement in cell isolation and transplantation. Gene therapy would be carried out according to generally accepted methods as described by, for example, Friedman, 1991, *Therapy for Genetic Diseases*, Friedman, Ed., Oxford University Press, pages 105-121.

Vectors for introduction of genes both for recombination and for extrachromosomal maintenance are known in the art, and any suitable vector may be used. Methods for introducing DNA into cells such as electroporation, calcium phosphate co-precipitation, and viral transduction are known in the art, and the choice of method is within the competence of one skilled in the art (Robbins (ed) 1997, *Gene Therapy Protocols*, Human Press, NJ). Cells transformed with a 12q23-qter gene can be used as model systems to study chromosome 12 disorders and to identify drug treatments for the treatment of such disorders.

Gene transfer systems known in the art may be useful in the practice of the gene therapy methods of the present invention. These include viral and non-viral transfer methods. A number of viruses have been used as gene transfer vectors, including polyoma, i.e., SV40 (Madzak et al., 1992, *J. Gen. Virol.*, 73:1533-1536), adenovirus (Berkner, 1992, *Curr. Top. Microbiol. Immunol.*, 158:39-6; Berkner et al., 1988, *Bio Techniques*, 6:616-629; Gorziglia et al., 1992, *J. Virol.*, 66:4407-4412; Quantin et al., 1992, *Proc. Natl. Acad. Sci. USA*, 89:2581-2584; Rosenfeld et al., 1992, *Cell*, 68:143-155; Wilkinson et al., 1992, *Nucl. Acids Res.*, 20:2233-2239; Stratford-Perricaudet et al., 1990, *Hum. Gene Ther.*, 1:241-256), vaccinia virus (Mackett et al., 1992, *Biotechnology*, 24:495-499), adeno-associated virus (Muzyczka, 1992, *Curr. Top. Microbiol. Immunol.*, 158:91-123; Ohi et al., 1990, *Gene*, 89:279-282), herpes viruses including HSV and EBV (Margolskee, 1992, *Curr. Top. Microbiol. Immunol.*, 158:67-90; Johnson et al., 1992, *J. Virol.*, 66:2952-2965; Fink et al., 1992, *Hum. Gene Ther.*, 3:11-19; Breakfield et al., 1987, *Mol. Neurobiol.*, 1:337-371; Fresse et al., 1990, *Biochem. Pharmacol.*, 40:2189-2199), and retroviruses of avian (Brandyopadhyay et al., 1984, *Mol. Cell. Biol.*, 4:749-754; Petropouplos et al., 1992, *J. Virol.*, 66:3391-3397), murine (Miller, 1992, *Curr. Top. Microbiol. Immunol.*, 158:1-24; Miller et al., 1985, *Mol. Cell. Biol.*, 5:431-437; Sorge et al., 1984, *Mol. Cell. Biol.*, 4:1730-1737; Mann et al., 1985, *J. Virol.*, 54:401-407), and human origin (Page et al., 1990, *J. Virol.*, 64:5370-5276; Buchschalcher et al., 1992, *J. Virol.*, 66:2731-2739). Most human gene therapy protocols have been based on disabled murine retroviruses.

Non-viral gene transfer methods known in the art include chemical techniques such as calcium phosphate coprecipitation (Graham et al., 1973, *Virology*, 52:456-467; Pellicer et al., 1980, *Science*, 209:1414-1422), mechanical techniques, for example microinjection (Anderson et al., 1980, *Proc. Natl. Acad. Sci. USA*, 77:5399-5403; Gordon et al., 1980, *Proc. Natl. Acad. Sci. USA*, 77:7380-7384; Brinster et al., 1981, *Cell*, 27:223-231; Constantini et al., 1981, *Nature*, 294:92-94), membrane fusion-mediated transfer via liposomes (Felgner et al., 1987, *Proc. Natl. Acad. Sci. USA*, 84:7413-7417; Wang et al., 1989, *Biochemistry*, 28:9508-9514; Kaneda et al., 1989, *J. Biol. Chem.*, 264:12126-12129; Stewart et al., 1992, *Hum. Gene Ther.*, 3:267-275; Nabel et al., 1990, *Science*, 249:1285-1288; Lim et al., 1992, *Circulation*, 83:2007-2011), and direct DNA uptake and receptor-mediated DNA transfer (Wolff et al., 1990, *Science*, 247:1465-1468; Wu et al., 1991, *BioTechniques*, 11:474-485; Zenke et al., 1990, *Proc. Natl. Acad. Sci. USA*, 87:3655-3659; Wu et al., 1989, *J. Biol. Chem.*, 264:16985-16987; Wolff et al., 1991, *BioTechniques*, 11:474-485; Wagner et al., 1991, *Proc. Natl. Acad. Sci. USA*, 88:4255-4259; Cotten et al., 1990, *Proc. Natl. Acad. Sci. USA*, 87:4033-4037; Curiel et al., 1991, *Proc. Natl. Acad. Sci. USA*, 88:8850-8854; Curiel et al., 1991, *Hum. Gene Ther.*, 3:147-154).

In one approach, plasmid DNA is complexed with a polylysine-conjugated antibody specific to the adenovirus hexon protein, and the resulting complex is bound to an adenovirus vector. The trimolecular complex is then used to infect cells. The adenovirus vector permits efficient binding, internalization, and degradation of the endosome before the coupled DNA is damaged. In another approach, liposome/DNA is used to mediate direct in vivo gene transfer. While in standard liposome preparations the gene transfer process is non-specific, localized in vivo uptake and expression have been reported in tumor deposits, for example, following direct in situ administration (Nabel, 1992, *Hum. Gene Ther.*, 3:399-410).

Suitable gene transfer vectors possess a promoter sequence, preferably a promoter that is cell-specific and placed upstream of the sequence to be expressed. The vectors may also contain, optionally, one or more expressible marker genes for expression as an indication of successful transfection and expression of the nucleic acid sequences contained in the vector. In addition, vectors can be optimized to minimize undesired immunogenicity and maximize long-term expression of the desired gene product(s) (see Nabe, 1999, *Proc. Natl. Acad. Sci. USA* 96:324-326). Moreover, vectors can be chosen based on cell-type that is targeted for treatment. Notably, gene transfer therapies have been initiated for the treatment of various pulmonary diseases (see, e.g., M. J. Welsh, 1999, *J. Clin. Invest.* 104(9):1165-6; D. L. Ennist, 1999, *Trends Pharmacol. Sci.* 20:260-266; S. M. Albelda et al., 2000, *Ann. Intern. Med.* 132:649-660; E. Alton and C. Kitson C., 2000, *Expert Opin. Investig. Drugs.* 9(7):1523-35).

Illustrative examples of vehicles or vector constructs for transfection or infection of the host cells include replication-defective viral vectors, DNA virus or RNA virus (retrovirus) vectors, such as adenovirus, herpes simplex virus and adeno-associated viral vectors. Adeno-associated virus vectors are single stranded and allow the efficient delivery of multiple copies of nucleic acid to the cell's nucleus. Preferred are adenovirus vectors. The vectors will normally be substantially free of any prokaryotic DNA and may comprise a number of different functional nucleic acid sequences. An example of such functional sequences may be a DNA region comprising transcriptional and translational initiation and termination regulatory sequences, including promoters (e.g., strong promoters, inducible promoters, and the like) and enhancers which are active in the host cells. Also included as part of the functional sequences is an open reading frame (polynucleotide sequence) encoding a protein of interest. Flanking sequences may also be included for site-directed integration. In some situations, the 5'-flanking sequence will allow homologous recombination, thus changing the nature of the transcriptional initiation region, so as to provide for inducible or non-inducible transcription to increase or decrease the level of transcription, as an example.

In general, the encoded and expressed 12q23-qter polypeptide may be intracellular, i.e., retained in the cytoplasm, nucleus, or in an organelle, or may be secreted by the cell. For secretion, the natural signal sequence present in a 12q23-qter polypeptide may be retained. When the polypeptide or peptide is a fragment of a 12q23-qter protein, a signal sequence may be provided so that, upon secretion and processing at the processing site, the desired protein will have the natural sequence. Specific examples of coding sequences of interest for use in accordance with the present invention include the 12q23-qter polypeptide-coding sequences disclosed herein.

As previously mentioned, a marker may be present for selection of cells containing the vector construct. The marker may be an inducible or non-inducible gene and will generally allow for positive selection under induction, or without induction, respectively. Examples of marker genes include neomycin, dihydrofolate reductase, glutamine synthetase, and the like. The vector employed will generally also include an origin of replication and other genes that are necessary for replication in the host cells, as routinely employed by those having skill in the art. As an example, the replication system comprising the origin of replication and any proteins associated with replication encoded by a particular virus may be included as part of the construct. The replication system must be selected so that the genes encoding products necessary for replication do not ultimately transform the cells. Such replication systems are represented by replication-defective adenovirus (see G. Acsadi et al., 1994, *Hum. Mol. Genet.* 3:579-584) and by Epstein-Barr virus. Examples of replication defective vectors, particularly, retroviral vectors that are replication defective, are BAG, (see Price et al., 1987, *Proc. Natl. Acad. Sci. USA*, 84:156; Sanes et al., 1986, *EMBO J.*, 5:3133).

It will be understood that the final gene construct may contain one or more genes of interest, for example, a gene encoding a bioactive metabolic molecule. In addition, cDNA, synthetically produced DNA or chromosomal DNA may be employed utilizing methods and protocols known and practiced by those having skill in the art.

According to one approach for gene therapy, a vector encoding a 12q23-qter polypeptide is directly injected into the recipient cells (in vivo gene therapy). Alternatively, cells from the intended recipients are explanted, genetically modified to encode a 12q23-qter polypeptide, and reimplanted into the donor (ex vivo gene therapy). An ex vivo approach provides the advantage of efficient viral gene transfer, which is superior to in vivo gene transfer approaches. In accordance with ex vivo gene therapy, the host cells are first transfected with engineered vectors containing at least one gene encoding a 12q23-qter polypeptide, suspended in a physiologically acceptable carrier or excipient such as saline or phosphate buffered saline, and the like, and then administered to the host. The desired gene product is expressed by the injected cells, which thus introduce the gene product into the host. The introduced gene products can thereby be utilized to treat or ameliorate a disorder (e.g., asthma, obesity, or inflammatory bowel disease) that is related to altered levels of the 12q23-qter polypeptide.

Animal Models

In accordance with the present invention, 12q23-qter polynucleotides (e.g., SEQ ID NO:1 to SEQ ID NO:92 and SEQ ID NO:156 to SEQ ID NO:4687) can be used to generate genetically altered non-human animals or human cell lines. Any non-human animal can be used; however typical animals are rodents, such as mice, rats, or guinea pigs. Genetically engineered animals or cell lines can carry a gene that has been altered to contain deletions, substitutions, insertions, or modifications of the polynucleotide sequence (e.g., exon sequence). Such alterations may render the gene nonfunctional, (i.e., a null mutation) producing a "knockout" animal or cell line. In addition, genetically engineered animals can carry one or more exogenous or non-naturally occurring genes, i.e., "transgenes", that are derived from different organisms (e.g., humans), or produced by synthetic or recombinant methods. Genetically altered animals or cell lines can be used to study 12q23-qter gene function, regulation, and treatments for 12q23-qter-related diseases. In particular, knockout animals and cell lines can be used to establish animal models and in vitro models for 12q23-qter-related illnesses, respectively. In addition, transgenic animals expressing human 12q23-qter can be used in drug discovery efforts.

A "transgenic animal" is any animal containing one or more cells bearing genetic information altered or received, directly or indirectly, by deliberate genetic manipulation at a subcellular level, such as by targeted recombination or microinjection or infection with recombinant virus. The term "transgenic animal" is not intended to encompass classical cross-breeding or in vitro fertilization, but rather is meant to encompass animals in which one or more cells are altered by, or receive, a recombinant DNA molecule. This recombinant DNA molecule may be specifically targeted to a defined genetic locus, may be randomly integrated within a chromosome, or it may be extrachromosomally replicating DNA.

Transgenic animals can be selected after treatment of germline cells or zygotes. For example, expression of an exogenous 12q23-qter gene or a variant can be achieved by operably linking the gene to a promoter and optionally an enhancer, and then microinjecting the construct into a zygote (see, e.g., Hogan et al., *Manipulating the Mouse Embryo, A*

Laboratory Manual, Cold Spring Harbor Laboratory, Cold Spring Harbor, N.Y.). Such treatments include insertion of the exogenous gene and disrupted homologous genes. Alternatively, the gene(s) of the animals may be disrupted by insertion or deletion mutation of other genetic alterations using conventional techniques (see, e.g., Capecchi, 1989, *Science*, 244:1288; Valancuis et al., 1991, *Mol. Cell. Biol.*, 11:1402; Hasty et al., 1991, *Nature*, 350:243; Shinkai et al., 1992, *Cell*, 68:855; Mombaerts et al., 1992, *Cell*, 68:869; Philpott et al., 1992, *Science*, 256:1448; Snouwaert et al., 1992, *Science*, 257:1083; Donehower et al., 1992, *Nature*, 356:215).

In one aspect of the invention, 12q23-qter gene knockout mice can be produced in accordance with well-known methods (see, e.g., M. R. Capecchi, 1989, *Science*, 244:1288-1292; P. Li et al., 1995, *Cell* 80:401-411; L. A. Galli-Taliadoros et al., 1995, *J. Immunol. Methods* 181(1):1-15; C. H. Westphal et al., 1997, *Curr. Biol.* 7(7):530-3; S. S. Cheah et al., 2000, *Methods Mol. Biol.* 136:455-63). The disclosed murine 12q23-qter genomic clone can be used to prepare a 12q23-qter targeting construct that can disrupt 12q23-qter in the mouse by homologous recombination at the 12q23-qter chromosomal locus. The targeting construct can comprise a disrupted or deleted 12q23-qter gene sequence that inserts in place of the functioning portion of the native mouse gene. For example, the construct can contain an insertion in the 12q23-qter protein-coding region.

Preferably, the targeting construct contains markers for both positive and negative selection. The positive selection marker allows the selective elimination of cells that lack the marker, while the negative selection marker allows the elimination of cells that carry the marker. In particular, the positive selectable marker can be an antibiotic resistance gene, such as the neomycin resistance gene, which can be placed within the coding sequence of a 12q23-qter gene to render it non-functional, while at the same time rendering the construct selectable. The herpes simplex virus thymidine kinase (HSV tk) gene is an example of a negative selectable marker that can be used as a second marker to eliminate cells that carry it. Cells with the HSV tk gene are selectively killed in the presence of gangcyclovir. As an example, a positive selection marker can be positioned on a targeting construct within the region of the construct that integrates at the locus of the 12q23-qter gene. The negative selection marker can be positioned on the targeting construct outside the region that integrates at the locus of the 12q23-qter gene. Thus, if the entire construct is present in the cell, both positive and negative selection markers will be present. If the construct has integrated into the genome, the positive selection marker will be present, but the negative selection marker will be lost.

The targeting construct can be employed, for example, in embryonal stem cell (ES). ES cells may be obtained from pre-implantation embryos cultured in vitro (M. J. Evans et al., 1981, *Nature* 292:154-156; M. O. Bradley et al., 1984, *Nature* 309:255-258; Gossler et al., 1986, *Proc. Natl. Acad. Sci. USA* 83:9065-9069; Robertson et al., 1986, *Nature* 322:445-448; S. A. Wood et al., 1993, *Proc. Natl. Acad. Sci. USA* 90:4582-4584). Targeting constructs can be efficiently introduced into the ES cells by standard techniques such as DNA transfection or by retrovirus-mediated transduction. Following this, the transformed ES cells can be combined with blastocysts from a non-human animal. The introduced ES cells colonize the embryo and contribute to the germ line of the resulting chimeric animal (R. Jaenisch, 1988, *Science* 240:1468-1474). The use of gene-targeted ES cells in the generation of gene-targeted transgenic mice has been previously described (Thomas et al., 1987, *Cell* 51:503-512) and is reviewed elsewhere (Frohman et al., 1989, *Cell* 56:145-147; Capecchi, 1989, *Trends in Genet.* 5:70-76; Baribault et al., 1989, *Mol. Biol. Med.* 6:481-492; Wagner, 1990, *EMBO J.* 9:3025-3032; Bradley et al., 1992, *Bio/Technology* 10: 534-539).

Several methods can be used to select homologously recombined murine ES cells. One method employs PCR to screen pools of transformant cells for homologous insertion, followed by screening individual clones (Kim et al., 1988, *Nucleic Acids Res.* 16:8887-8903; Kim et al., 1991, *Gene* 103:227-233). Another method employs a marker gene is constructed which will only be active if homologous insertion occurs, allowing these recombinants to be selected directly (Sedivy et al., 1989, *Proc. Natl. Acad. Sci. USA* 86:227-231). For example, the positive-negative selection (PNS) method can be used as described above (see, e.g., Mansour et al., 1988, *Nature* 336:348-352; Capecchi, 1989, *Science* 244: 1288-1292; Capecchi, 1989, *Trends in Genet.* 5:70-76). In particular, the PNS method is useful for targeting genes that are expressed at low levels.

The absence of functional 12q23-qter gene in the knockout mice can be confirmed, for example, by RNA analysis, protein expression analysis, and functional studies. For RNA analysis, RNA samples are prepared from different organs of the knockout mice and the 12q23-qter transcript is detected in Northern blots using oligonucleotide probes specific for the transcript. For protein expression detection, antibodies that are specific for the 12q23-qter polypeptide are used, for example, in flow cytometric analysis, immunohistochemical staining, and activity assays. Alternatively, functional assays are performed using preparations of different cell types collected from the knockout mice.

Several approaches can be used to produce transgenic mice. In one approach, a targeting vector is integrated into ES cell by homologous recombination, an intrachromosomal recombination event is used to eliminate the selectable markers, and only the transgene is left behind (A. L. Joyner et al., 1989, *Nature* 338(6211):153-6; P. Hasty et al., 1991, *Nature* 350(6315):243-6; V. Valancius and O, Smithies, 1991, *Mol. Cell. Biol.* 11(3):1402-8; S. Fiering et al., 1993, *Proc. Natl. Acad. Sci. USA* 90(18):8469-73). In an alternative approach, two or more strains are created; one strain contains the gene knocked-out by homologous recombination, while one or more strains contain transgenes. The knockout strain is crossed with the transgenic strain to produce new line of animals in which the original wild-type allele has been replaced (although not at the same site) with a transgene. Notably, knockout and transgenic animals can be produced by commercial facilities (e.g., The Lerner Research Institute, Cleveland, Ohio; B&K Universal, Inc., Fremont, Calif.; DNX Transgenic Sciences, Cranbury, N.J.; Incyte Genomics, Inc., St. Louis, Mo.).

Transgenic animals (e.g., mice) containing a nucleic acid molecule which encodes a human 12q23-qter polypeptide, may be used as in vivo models to study the overexpression of a 12q23-qter gene. Such animals can also be used in drug evaluation and discovery efforts to find compounds effective to inhibit or modulate the activity of a 12q23-qter gene, such as for example compounds for treating respiratory disorders, diseases, or conditions. One having ordinary skill in the art can use standard techniques to produce transgenic animals which produce a human 12q23-qter polypeptide, and use the animals in drug evaluation and discovery projects (see, e.g., U.S. Pat. No. 4,873,191 to Wagner; U.S. Pat. No. 4,736,866 to Leder).

In another embodiment of the present invention, the transgenic animal can comprise a recombinant expression vector in which the nucleotide sequence that encodes a human 12q23-qter polypeptide is operably linked to a tissue specific promoter whereby the coding sequence is only expressed in that specific tissue. For example, the tissue specific promoter can be a mammary cell specific promoter and the recombinant protein so expressed is recovered from the animal's milk.

In yet another embodiment of the present invention, a 12q23-qter gene "knockout" can be produced by administering to the animal antibodies (e.g., neutralizing antibodies) that specifically recognize an endogenous 12q23-qter polypeptide. The antibodies can act to disrupt function of the endogenous 12q23-qter polypeptide, and thereby produce a null phenotype. In one specific example, an orthologous mouse 12q23-qter polypeptide or peptide can be used to generate antibodies. These antibodies can be given to a mouse to knockout the function of the mouse 12q23-qter ortholog.

In another embodiment of the present invention, non-mammalian organisms may be used to study 12q23-qter genes and 12q23-qter-related diseases. In particular, model organisms such as C. elegans, D. melanogaster, and S. cerevisiae may be used. Orthologs of 12q23-qter genes can be identified in these model organisms, and mutated or deleted to produce strains deficient for 12q23-qter genes. Human 12q23-qter genes can then be tested for the ability to "complement" the deficient strains. Such strains can also be used for drug screening. The 12q23-qter orthologs can be used to facilitate the understanding of the biological function of the human 12q23-qter genes, and assist in the identification of binding factors (e.g., agonists, antagonists, and inhibitors).

Gene Identification

To identify genes in the region on 12q23-qter, a set of bacterial artificial chromosome (BAC) clones containing this chromosomal region was identified. The BAC clones served as a template for genomic DNA sequencing and as reagents for identifying coding sequences by direct cDNA selection. Genomic sequencing and direct cDNA selection were used to characterize DNA from 12q23-qter in accordance with the methods described in detail herein.

When a gene has been genetically localized to a specific chromosomal region, the genes in this region can be characterized at the molecular level by a series of steps that include: (1) cloning the entire region of DNA in a set of overlapping genomic clones (physical mapping); (2) characterizing the genes encoded by these clones by a combination of direct cDNA selection, exon trapping and DNA sequencing (gene identification); and (3) identifying mutations in these genes by comparative DNA sequencing of affected and unaffected members of the kindreds and/or in unrelated affected individuals and unrelated unaffected controls (mutation analysis).

Physical mapping is accomplished by screening libraries of human DNA cloned in vectors that are propagated in a host such as E. coli, using hybridization or PCR assays from unique molecular landmarks in the chromosomal region of interest. To generate a physical map of the disorder region, a library of human DNA cloned in BACs was screened with a set overgo markers that had been previously mapped to chromosome 12q23-qter by the efforts of the Human Genome Project. Overgos are unique molecular landmarks in the human genome that can be assayed by hybridization. Through the combined efforts of the Human Genome Project, the location of thousands of overgos on the twenty-two autosomes and two sex chromosomes has been determined. For a positional cloning effort, the physical map is tied to the genetic map because the markers used for genetic mapping can also be used as overgos for physical mapping. By screening a BAC library with a combination of overgos derived from genetic markers, genes, and random DNA fragments, a physical map comprised of overlapping clones representing all of the DNA in a chromosomal region of interest can be assembled.

BACs are cloning vectors for large (80 kilobase to 200 kilobase) segments of human or other DNA that are propagated in E. coli. To construct a physical map using BACs, a library of BAC clones is screened so that individual clones harboring the DNA sequence corresponding to a given overgo or set of overgos are identified. Throughout most of the human genome, the overgo markers are spaced approximately 20 to 50 kilobases apart, so that an individual BAC clone typically contains at least two overgo markers. In addition, the BAC libraries that were screened contain enough cloned DNA to cover the human genome twelve times over. Accordingly, an individual overgo typically identifies more than one BAC clone. By screening a twelve-fold coverage BAC library with a series of overgo markers spaced approximately 50 kilobases apart, a physical map consisting of a series of overlapping contiguous BAC clones, i.e., BAC "contigs," can be assembled for any region of the human genome. This map is closely tied to the genetic map because many of the overgo markers used to prepare the physical map are also genetic markers.

When constructing a physical map, it often happens that there are gaps in the overgo map of the genome that result in the inability to identify BAC clones that are overlapping in a given location. Typically, the physical map is first constructed from a set of overgos identified through the publicly available literature and World Wide Web resources. The initial map consists of several separate BAC contigs that are separated by gaps of unknown molecular distance. To identify BAC clones that fill these gaps, it is necessary to develop new overgo markers from the ends of the clones on either side of the gap. This is done by sequencing the terminal 200 to 300 base pairs of the BACs flanking the gap, and developing a PCR or hybridization based assay. If the terminal sequences are demonstrated to be unique within the human genome, then the new overgo can be used to screen the BAC library to identify additional BACs that contain the DNA from the gap in the physical map. To assemble a BAC contig that covers a region the size of the disorder region (6,000,000 or more base pairs), it is necessary to develop new overgo markers from the ends of a number of clones.

After building a BAC contig, this set of overlapping clones serves as a template for identifying the genes encoded in the chromosomal region. Gene identification can be accomplished by many methods. Three methods are commonly used: (1) a set of BACs selected from the BAC contig to represent the entire chromosomal region can be sequenced, and computational methods can be used to identify all of the genes, (2) the BACs from the BAC contig can be used as a reagent to clone cDNAs corresponding to the genes encoded in the region by a method termed direct cDNA selection, or (3) the BACs from the BAC contig can be used to identify coding sequences by selecting for specific DNA sequence motifs in a procedure called exon trapping. The present invention includes chromosome 12q23-qter genes identified by the first two methods.

To sequence the entire BAC contig representing the disorder region, a set of BACs can be chosen for subcloning into plasmid vectors and subsequent DNA sequencing of these subclones. Since the DNA cloned in the BACs represents genomic DNA, this sequencing is referred to as genomic sequencing to distinguish it from cDNA sequencing. To initiate the genomic sequencing for a chromosomal region of interest, several non-overlapping BAC clones are chosen. DNA for each BAC clone is prepared, and the clones are sheared into random small fragments, which are subsequently cloned into standard plasmid vectors such as pUC18. The plasmid clones are then grown to propagate the smaller fragments, and these are the templates for sequencing. To ensure adequate coverage and sequence quality for the BAC DNA sequence, sufficient plasmid clones are sequenced to yield three-fold coverage of the BAC clone. For example, if the BAC is 100 kilobases long, then phagemids are sequenced to yield 300 kilobases of sequence. Since the BAC DNA was randomly sheared prior to cloning in the phagemid vector, the 300 kilobases of raw DNA sequence can be assembled by computational methods into overlapping DNA sequences termed sequence contigs. For the purposes of initial gene identification by computational methods, three-fold coverage of each BAC is sufficient to yield twenty to forty sequence contigs of 1000 base pairs to 20,000 base pairs.

The sequencing strategy employed in this invention was to initially sequence "seed" BACs from the BAC contig in the disorder region. The sequence of the "seed" BACs was then used to identify minimally overlapping BACs from the contig, and these were subsequently sequenced. In this manner, the entire candidate region can be sequenced, with several small sequence gaps left in each BAC. This sequence serves as the template for computational gene identification.

In one approach, genes can be identified by comparing the sequence of BAC contig to publicly available databases of cDNA and genomic sequences, e.g., UniGene, dbEST, EMBL nucleotide database, GenBank, and the DNA Database of Japan (DDBJ). The BAC DNA sequence can also be translated into protein sequence, and the protein sequence can be used to search publicly available protein databases, e.g., GenPept, EMBL protein database, Protein Information Resource (PIR), Protein Data Bank (PDB), and SWISS-PROT. These comparisons are typically done using the BLAST family of computer algorithms and programs (Altschul et al., 1990, *J. Mol. Biol.*, 215:403-410; Altschul et al, 1997, *Nucl. Acids Res.*, 25:3389-3402). For nucleotide queries, BLASTN, BLASTX, and TBLASTX can be used. BLASTN compares a nucleotide query sequence with a nucleotide sequence database; BLASTX compares a nucleotide query sequence translated in all reading frames against a protein sequence database; TBLASTX compares the six-frame translations of a nucleotide query sequence against the six-frame translations of a nucleotide sequence database. For protein queries, BLASTP and TBLASTN can be used. BLASTP compares a protein query sequence with a protein sequence database; TBLASTN compares a protein query sequence against a nucleotide sequence database dynamically translated in all reading frames.

Additionally, computer algorithms such as MZEF (Zhang, 1997, *Proc. Natl. Acad. Sci. USA* 94:565-568), GRAIL (Uberbacher et al., 1996, *Methods Enzymol.* 266:259-281), and Genscan (Burge and Karlin, 1997, *J. Mol. Biol.*, 268:78-94) can be used to predict the location of exons in the sequence based on the presence of specific DNA sequence motifs that are common to all exons, as well as the presence of codon usage typical of human protein encoding sequences.

In addition to identifying genes by computational methods, genes can be identified by direct cDNA selection (Del Mastro and Lovett, 1996, *Methods in Molecular Biology*, Humana Press Inc., NJ). In direct cDNA selection, cDNA pools from tissues of interest are prepared, and BACs from the candidate region are used in a liquid hybridization assay to capture the cDNAs which base pair to coding regions in the BAC. In the methods described herein, the cDNA pools were created from several different tissues by random priming and oligo dT priming the first strand cDNA from poly $A^+$ RNA, synthesizing the second-strand cDNA by standard methods, and adding linkers to the ends of the cDNA fragments. In this approach, the linkers are used to amplify the cDNA pools of BAC clones from the disorder region identified by screening a BAC library. The amplified products are then used as a template for initiating DNA synthesis to create a biotin labeled copy of BAC DNA. Following this, the biotin labeled copy of the BAC DNA is denatured and incubated with an excess of the PCR amplified, linkered cDNA pools which have also been denatured. The BAC DNA and cDNA are allowed to anneal in solution, and heteroduplexes between the BAC and the cDNA are isolated using streptavidin coated magnetic beads. The cDNAs that are captured by the BAC are then amplified using primers complimentary to the linker sequences, and the hybridization/selection process is repeated for a second round. After two rounds of direct cDNA selection, the cDNA fragments are cloned, and a library of these direct selected fragments is created.

The cDNA clones isolated by direct selection are analyzed by two methods. Since a pool of BACs from the disorder region is used to provide the genomic target DNA sequence, the cDNAs must be mapped to BAC genomic clones to verify their chromosomal location. This is accomplished by arraying the cDNAs in microtiter dishes, and replicating their DNA in high-density grids. Individual genomic clones known to map to the region are then hybridized to the grid to identify direct selected cDNAs mapping to that region. cDNA clones that are confirmed to correspond to individual BACs are sequenced. To determine whether the cDNA clones isolated by direct selection share sequence identity or similarity to previously identified genes, the DNA and protein coding sequences are compared to publicly available databases using the BLAST family of programs.

The combination of genomic DNA sequence and cDNA sequence provided by BAC sequencing and by direct cDNA selection yields an initial list of putative genes in the region. The genes in the region were all candidates for the asthma locus. To further characterize each gene, Northern blots were performed to determine the size of the transcript corresponding to each gene, and to determine which putative exons were transcribed together to make an individual gene. For Northern blot analysis of each gene, probes were prepared from direct selected cDNA clones or by PCR amplifying specific fragments from genomic DNA, cDNA or from the BAC encoding the putative gene of interest. The Northern blots gave information on the size of the transcript and the tissues in which it was expressed. For transcripts that were not highly expressed, it was sometimes necessary to perform a reverse transcription PCR assay using RNA from the tissues of interest as a template for the reaction.

Gene identification by computational methods and by direct cDNA selection provides unique information about the genes in a region of a chromosome. When genes are identified, then it is possible to examine different individuals for mutations in each gene. Variants in gene sequences between individuals can be inherited allelic differences or can arise from mutations in the individuals. Gene sequence variants are clinically important in that they can affect drug action on such gene. Most drugs elicit a safe response in only a fraction of individuals, and drugs are commonly administered to patients with no certainty that they will be safe and effective. Many important drugs are effective in only 30-40% of patients for whom the drug is prescribed, and virtually all drugs cause adverse events in some individuals. Identification of mutations in disorder genes in different individuals will enable a correlation between the safety and efficacy of drug therapies used to treat lung diseases and the genotypes of the treated individuals. This correlation enables health care providers to prescribe a drug regimen that is most appropriate for the individual patient rather than trying different drug regimens in turn until a successful drug is identified. Identification of variants in disorder genes will also have a benefit during the development of new drugs for the treatment of lung diseases, as the ability to correlate genetic variation with the efficacy of new candidate drugs will enhance lead optimization and increase the efficiency and success rate of new drug approvals.

Gene identification by computational methods and by direct cDNA selection provides unique information about the genes in a region of a chromosome. Once genes are identified, it is possible to examine subjects for sequence variants. Variant sequences can be inherited as allelic differences or can arise from spontaneous mutations. Inherited alleles can be analyzed for linkage to a disease susceptibility locus. Linkage analysis is possible because of the nature of inheritance of chromosomes from parents to offspring. During meiosis, the two parental homologs pair to guide their proper separation to daughter cells. While they are paired, the two homologs exchange pieces of the chromosomes, in an event called "crossing over" or "recombination." The resulting chromosomes contain parts that originate from both parental homologs. The closer together two sequences are on the chromosome, the less likely that a recombination event will occur between them, and the more closely linked they are.

Data obtained from the different families can be combined and analyzed together by a computer using statistical methods described herein. The results can then be used as evidence for linkage between the genetic markers used and an asthma susceptibility locus. In general, a recombination frequency of 1% is equivalent to approximately 1 map unit, a relationship that holds up to frequencies of about 20% or 20 cM. One centimorgan (cM) is roughly equivalent to 1,000 Kb of DNA. The entire human genome is 3,300 cM long. In order to find an unknown disease gene within 5-10 cM of a marker locus, the whole human genome can be searched with roughly 330 informative marker loci spaced at approximately 10 cM intervals (Botstein et al., 1980, *Am. J. Hum. Genet.* 32:314-331).

The reliability of linkage results is established by using a number of statistical methods. The methods most commonly used for the detection by linkage analysis of oligogenes involved in the etiology of a complex trait are non-parametric or model-free methods which have been implemented into the computer programs MAPMAKER/SIBS (L. Kruglyak and E. S. Lander, 1995, *Am. J. Hum. Genet.* 57:439-454) and GENEHUNTER (L. Kruglyak et al., 1996, *Am. J. Hum. Genet.* 58:1347-1363). Typically, linkage analysis is performed by typing members of families with multiple affected individuals at a given marker locus and evaluating if the affected members (excluding parent-offspring pairs) share alleles at the marker locus that are identical by descent (IBD) more often than expected by chance alone.

As a result of the rapid advances in mapping the human genome over the last few years, and concomitant improvements in computer methodology, it has become feasible to carry out linkage analyses using multi-point data. Multi-point analysis provides a simultaneous analysis of linkage between the trait and several linked genetic markers, when the recombination distance among the markers is known. A LOD score statistic is computed at multiple locations along a chromosome to measure the evidence that a susceptibility locus is located nearby. A LOD score is the logarithm base 10 of the ratio of the likelihood that a susceptibility locus exists at a given location to the likelihood that no susceptibility locus is located there. By convention, when testing a single marker, a total LOD score greater than +3.0 (that is, odds of linkage being 1,000 times greater than odds of no linkage) is considered to be significant evidence for linkage.

Multi-point analysis is advantageous for two reasons. First, the informativeness of the pedigrees is usually increased. Each pedigree has a certain amount of potential information, dependent on the number of parents heterozygous for the marker loci and the number of affected individuals in the family. However, few markers are sufficiently polymorphic as to be informative in all those individuals. If multiple markers are considered simultaneously, then the probability of an individual being heterozygous for at least one of the markers is greatly increased. Second, an indication of the position of the disease gene among the markers may be determined. This allows identification of flanking markers, and thus eventually allows identification of a small region in which the disease gene resides.

EXAMPLES

The examples as set forth herein are meant to exemplify the various aspects of the present invention and are not intended to limit the invention in any way.

Example 1

Family Collection

Asthma is a complex disorder that is influenced by a variety of factors, including both genetic and environmental effects. Complex disorders are typically caused by multiple interacting genes, some contributing to disease development and some conferring a protective effect. The success of linkage analyses in identifying chromosomes with significant LOD scores is achieved in part as a result of an experimental design tailored to the detection of susceptibility genes in complex diseases, even in the presence of epistasis and genetic heterogeneity. Also important are rigorous efforts in ascertaining asthmatic families that meet strict guidelines, and collecting accurate clinical information.

Given the complex nature of the asthma phenotype, non-parametric affected sib pair analyses were used to analyze the genetic data. This approach does not require parameter specifications such as mode of inheritance, disease allele frequency, penetrance of the disorder, or phenocopy rates. Instead, it determines whether the inheritance pattern of a chromosomal region is consistent with random segregation. If it is not, affected siblings inherit identical copies of alleles more often than expected by chance. Because no models for inheritance are assumed, allele-sharing methods tend to be more robust than parametric methods when analyzing complex disorders. They do, however, require larger sample sizes to reach statistically significant results.

At the outset of the program, the goal was to collect 400 affected sib-pair families for the linkage analyses. Based on a genome scan with markers spaced ~10 cM apart, this number of families was predicted to provide >95% power to detect an asthma susceptibility gene that caused an increased risk to first-degree relatives of 3-fold or greater. The assumed relative risk of 3-fold was consistent with epidemiological studies in the literature that suggest an increased risk ranging from 3- to 7-fold. The relative risk was based on gender, different classifications of the asthma phenotype (i.e., bronchial hyper-responsiveness versus physician's diagnosis) and, in the case of offspring, whether one or both parents were asthmatic.

The family collection efforts exceeded the initial goal of 400, and resulted in a total of 444 affected sibling pair (ASP)

families, with 342 families from the UK and 102 families from the US. The ASP families in the US collection were Caucasian with a minimum of two affected siblings that were identified through both private practice and community physicians as well as through advertising. A total of 102 families were collected in Kansas, Nebraska, and Southern California. In the UK collection, Caucasian families with a minimum of two affected siblings were identified through physicians' registers in a region surrounding Southampton and including the Isle of Wight. In both the US and UK collections, additional affected and unaffected sibs were collected whenever possible.

An additional 63 families from the United Kingdom were utilized from an earlier collection effort with different ascertainment criteria. These families were recruited either: 1) without reference to asthma and atopy; or 2) by having at least one family member or at least two family members affected with asthma. The randomly ascertained samples were identified from general practitioner registers in the Southampton area. For families with affected members, the probands were recruited from hospital based clinics in Southampton. Seven pedigrees extended beyond a single nuclear family. The phenotypic and genotypic data information for 17 markers for 21 of these 63 families was obtained from the website http://cedar.genetics.soton.ac.uk/pub/PROGRAMS/BETA/data/bet12.ped.

Families were included in the study if they met all of the following criteria: 1) the biological mother and biological father were Caucasian and agreed to participate in the study; 2) at least two biological siblings were alive, each with a current physician diagnosis of asthma, and were 5 to 21 years of age; and 3) the two siblings were currently taking asthma medications on a regular basis. This included regular, intermittent use of inhaled or oral bronchodilators and regular use of cromolyn, theophylline, or steroids.

Families were excluded from the study if they met any one of the following criteria: 1) both parents were affected (i.e., with a current diagnosis of asthma, having asthma symptoms, or on asthma medications at the time of the study); 2) any of the siblings to be included in the study was less than 5 years of age; 3) any asthmatic family member to be included in the study was taking beta-blockers at the time of the study, 4) any family member to be included in the study had congenital or acquired pulmonary disease at birth (e.g., cystic fibrosis), a history of serious cardiac disease (myocardial infarction), or any history of serious pulmonary disease (e.g., emphysema); or 5) any family member to be included in the study was pregnant.

An extensive clinical instrument was designed and data from all participating family members were collected. The case report form (CRF) included questions on demographics, medical history including medications, a health survey on the incidence and frequency of asthma, wheeze, eczema, hay fever, nasal problems, smoking, and questions on home environment. Data from a video questionnaire designed to show various examples of wheeze and asthmatic attacks were also included in the CRF. Clinical data, including skin prick tests to 8 common allergens, total and specific IgE levels, and bronchial hyper-responsiveness following a methacholine challenge, were also collected from all participating family members. All data were entered into a SAS dataset by IMTCI, a CRO; either by double data entry or scanning followed by on-screen visual validation. An extensive automated review of the data was performed on a routine basis and a full audit at the conclusion of the data entry was completed to verify the accuracy of the dataset.

Example 2

Genome Scan

In order to identify chromosomal regions linked to asthma, the inheritance pattern of alleles from genetic markers spanning the genome was assessed on the collected family resources. As described above, combining these results with the segregation of the asthma phenotype in these families allows the identification of genetic markers that are tightly linked to asthma. In turn, this provides an indication of the location of genes predisposing affected individuals to asthma. The genotyping strategy was twofold: 1) to conduct a genome wide scan using markers spaced at approximately 10 cM intervals; and 2) to target ten chromosomal regions for high density genetic mapping. The initial candidate regions for high-density mapping were chosen based on suggestions of linkage to these regions by other investigators.

Genotypes of PCR amplified simple sequence microsatellite genetic linkage markers were determined using ABI model 377 Automated Sequencers (PE Applied Biosystems). Microsatellite markers were obtained from Research Genetics Inc. (Huntsville, Ala.) in the fluorescent dye-conjugated form (see Dubovsky et al., 1995, *Hum. Mol. Genet.* 4(3):449-452). The markers comprised a variation of a human linkage mapping panel as released from the Cooperative Human Linkage Center (CHLC), also known as the Weber lab screening set version 8. The variation of the Weber 8 screening set consisted of 529 markers with an average spacing of 6.9 cM (autosomes only) and 7.0 cM (all chromosomes). Eighty-nine percent of the markers consisted of either tri- or tetra-nucleotide microsatellites. There were no gaps present in chromosomal coverage greater than 17.5 cM.

Study subject genomic DNA (5 µl; 4.5 ng/µl) was amplified in a 10 µl PCR reaction using AmpliTaq Gold DNA polymerase (0.225 U); 1×PCR buffer (80 mM $(NH_4)_2SO_4$; 30 mM Tris-HCl (pH 8.8); 0.5% Tween-20); 200 µM each dATP, dCTP, dGTP and dTTP; 1.5-3.5 µM $MgCl_2$; and 250 µM forward and reverse PCR primers. PCR reactions were set up in 192 well plates (Costar) using a Tecan Genesis 150 robotic workstation equipped with a refrigerated deck. PCR reactions were overlaid with 20 µl mineral oil, and thermocycled on an MJ Research Tetrad DNA Engine equipped with four 192 well heads using the following conditions: 92° C. for 3 min; 6 cycles of 92° C. for 30 sec, 56° C. for 1 min, 72° C. for 45 sec; followed by 20 cycles of 92° C. for 30 sec, 55° C. for 1 min, 72° C. for 45 sec; and a 6 min incubation at 72° C.

PCR products of 8-12 microsatellite markers were subsequently pooled into two 96-well microtitre plates (2.0 µl PCR product from TET and FAM labeled markers, 3.0 µl HEX labeled markers) using a Tecan Genesis 200 robotic workstation and brought to a final volume of 25 µl with $H_2O$. Following this, 1.9 µl of pooled PCR product was transferred to a loading plate and combined with 3.0 µl loading buffer (2.5 µl formamide/blue dextran (9.0 mg/ml), 0.5 µl GS-500 TAMRA labeled size standard, ABI). Samples were denatured in the loading plate for 4 min at 95° C., placed on ice for 2 min, and electrophoresed on a 5% denaturing polyacrylamide gel (FMC on the ABI 377XL). Samples (0.8 µl) were loaded onto the gel using an 8 channel Hamilton Syringe pipettor.

Each gel consisted of 62 study subjects and 2 control subjects (CEPH parents ID #1331-01 and 1331-02, Coriell Cell Repository, Camden, N.J.). Genotyping gels were scored in duplicate by investigators blind to patient identity and affection status using GENOTYPER analysis software V1.1.12 (ABI; PE Applied Biosystems). Nuclear families were loaded onto the gel with the parents flanking the siblings to facilitate error detection. The final tables obtained from the GENO-TYPER output for each gel analysed were imported into a SYBASE Database.

Allele calling (binning) was performed using the SYBASE version of the ABAS software (Ghosh et al., 1997, *Genome Research* 7:165-178). Offsize bins were checked manually and incorrect calls were corrected or blanked. The binned alleles were then imported into the program MENDEL (Lange et al., 1988, *Genetic Epidemiology,* 5:471) for inheritance checking using the USERM13 subroutine (Boehnke et al., 1991, *Am. J. Hum. Genet.* 48:22-25). Non-inheritance was investigated by examining the genotyping traces and, once all discrepancies were resolved, the subroutine USERM13 was used to estimate allele frequencies.

Example 3

Linkage Analysis

Chromosomal regions harboring asthma susceptibility genes were identified by linkage analysis of genotyping data and three separate phenotypes, asthma, bronchial hyper-responsiveness, and atopic status.

1. Asthma Phenotype: For the initial linkage analysis, the phenotype and asthma affection status were defined by a patient who answered the following questions in the affirmative: i) Have you ever had asthma? ii) Do you have a current physician's diagnosis of asthma? and iii) Are you currently taking asthma medications? Medications included inhaled or oral bronchodilators, cromolyn, theophylline, or steroids. Multipoint linkage analyses of allele sharing in affected individuals were performed using the MAPMAKER/SIBS analysis program (L. Kruglyak and E. S. Lander, 1995, *Am. J. Hum. Genet.* 57:439-454). The analyses were performed using 54 polymorphic markers spanning a 162 cM region on both arms of chromosome 12. The map location and distances between markers were obtained from the genetic maps published by the Marshfield medical research foundation; Marshfield, Mi. Ambiguous ordering of markers in the Marshfield map was resolved using the program MULTIMAP (T. C. Matise et al., 1994, *Nature Genet.* 6:384-390).

FIG. 1A shows the multipoint LOD score against the map location of markers along chromosome 12. A Maximum LOD Score (MLS) of 2.9, based on 484 nuclear families, was obtained at location 161.7 cM, 1.0 cM distal to markers D12S97 and D12S1045. An excess sharing by descent (Identity By Descent; IBD=2) of 0.31 was observed at the MLS. Table 1B shows the two-point and multipoint LOD scores at each marker.

TABLE 1B

CHROMOSOME 12 LINKAGE ANALYSIS

| Marker | Distance | Two-point | Multipoint |
|---|---|---|---|
| D12S372 | 6.4 | 0.0 | 0.0 |
| GATA49D12 | 17.7 | 0.0 | 0.0 |
| D12S77 | 20.3 | 0.0 | 0.0 |
| D12S391 | 26.2 | 0.0 | 0.0 |
| D12S358 | 26.2 | 0.0 | 0.0 |
| D12S364 | 30.6 | 0.2 | 0.0 |
| D12S373 | 36.1 | 0.0 | 0.0 |
| D12S1042 | 48.7 | 0.0 | 0.0 |
| GATA91H06 | 56.3 | 0.0 | 0.0 |
| D12S368 | 66.0 | 0.2 | 0.3 |
| D12S398 | 68.2 | 0.2 | 0.4 |
| D12S83 | 75.2 | 1.1 | 0.0 |
| D12S1294 | 78.1 | 0.0 | 0.0 |

TABLE 1B-continued

CHROMOSOME 12 LINKAGE ANALYSIS

| Marker | Distance | Two-point | Multipoint |
|---|---|---|---|
| IFNgama | 80.4 | 0.0 | 0.0 |
| D12S375 | 80.5 | 0.3 | 0.0 |
| D12S43 | 80.5 | 0.3 | 0.0 |
| D12S1052 | 83.2 | 0.0 | 0.0 |
| D12S92 | 83.2 | 1.0 | 0.0 |
| D12S326 | 86.4 | 0.1 | 0.1 |
| D12S64 | 89.4 | 0.0 | 0.2 |
| D12S379 | 93.7 | 0.0 | 0.1 |
| D12S311 | 94.5 | 0.1 | 0.0 |
| D12S82 | 95.0 | 0.1 | 0.1 |
| D12S819 | 95.0 | 0.0 | 0.1 |
| D12S1064 | 95.0 | 0.0 | 0.0 |
| D12S95 | 96.1 | 0.2 | 0.2 |
| D12S829 | 97.2 | 0.1 | 0.6 |
| D12S1706 | 104.1 | 0.6 | 0.4 |
| D12S1300 | 104.1 | 0.2 | 0.3 |
| D12S1727 | 107.2 | 0.0 | 0.1 |
| D12S1607 | 107.9 | 0.0 | 0.1 |
| IGF1 | 109.5 | 0.0 | 0.0 |
| PAH | 109.5 | 0.0 | 0.0 |
| D12S360 | 111.3 | 0.0 | 0.0 |
| D12S338 | 111.9 | 0.0 | 0.0 |
| D12S78 | 111.9 | 0.0 | 0.0 |
| D12S811 | 120.7 | 0.1 | 0.3 |
| D12S1341 | 123.0 | 0.0 | 0.5 |
| NOS1 | 123.1 | 0.1 | 0.4 |
| D12S2070 | 125.3 | 0.2 | 0.7 |
| D12S366 | 133.3 | 1.2 | 1.7 |
| D12S1619 | 134.5 | 0.8 | 1.8 |
| D12S385 | 135.1 | 2.0 | 1.6 |
| PLA2G1B | 136.8 | 0.9 | 1.4 |
| D12S395 | 136.8 | 2.1 | 1.5 |
| D12S300 | 140.2 | 0.9 | 1.7 |
| D12S342 | 144.8 | 1.6 | 2.2 |
| D12S324 | 147.2 | 1.3 | 1.4 |
| D12S2078 | 149.6 | 0.9 | 1.9 |
| D12S1659 | 155.9 | 0.3 | 1.6 |
| D12S97 | 160.7 | 0.9 | 2.7 |
| D12S1045 | 160.7 | 3.0 | 2.8 |
| D12S392 | 165.7 | 1.1 | 2.3 |
| D12S357 | 168.8 | 0.8 | 1.1 |

2. Phenotypic Subgroups: Nuclear families were ascertained by the presence of at least two affected siblings with a current physician's diagnosis of asthma, as well as the use of asthma medication. In the initial analysis (see above), the evidence was examined for linkage based on that dichotomous phenotype (asthma—yes/no). To further characterize the linkage signals, additional quantitative traits were measured in the clinical protocol. Since quantitative trait loci (QTL) analysis tools with correction for ascertainment were not available, the following approach was taken to refine the linkage and association analyses:

i. Phenotypic subgroups that could be indicative of an underlying genotypic heterogeneity were identified. Asthma subgroups were defined according to 1) bronchial hyper-responsiveness (BHR) to methacholine challenge; or 2) atopic status using quantitative measures like total serum IgE and specific IgE to common allergens.

ii. Non-parametric linkage analyses were performed on subgroups to test for the presence of a more homogeneous sub-sample. If genetic heterogeneity was present in the sample, the amount of allele sharing among phenotypically similar siblings was expected to increase in the appropriate subgroup in comparison to the full sample. A narrower region of significant increased allele sharing was also expected to result unless the overall LOD score decreased as a consequence of having a smaller sample size and of using an approximate partitioning of the data.

Figure 1B:
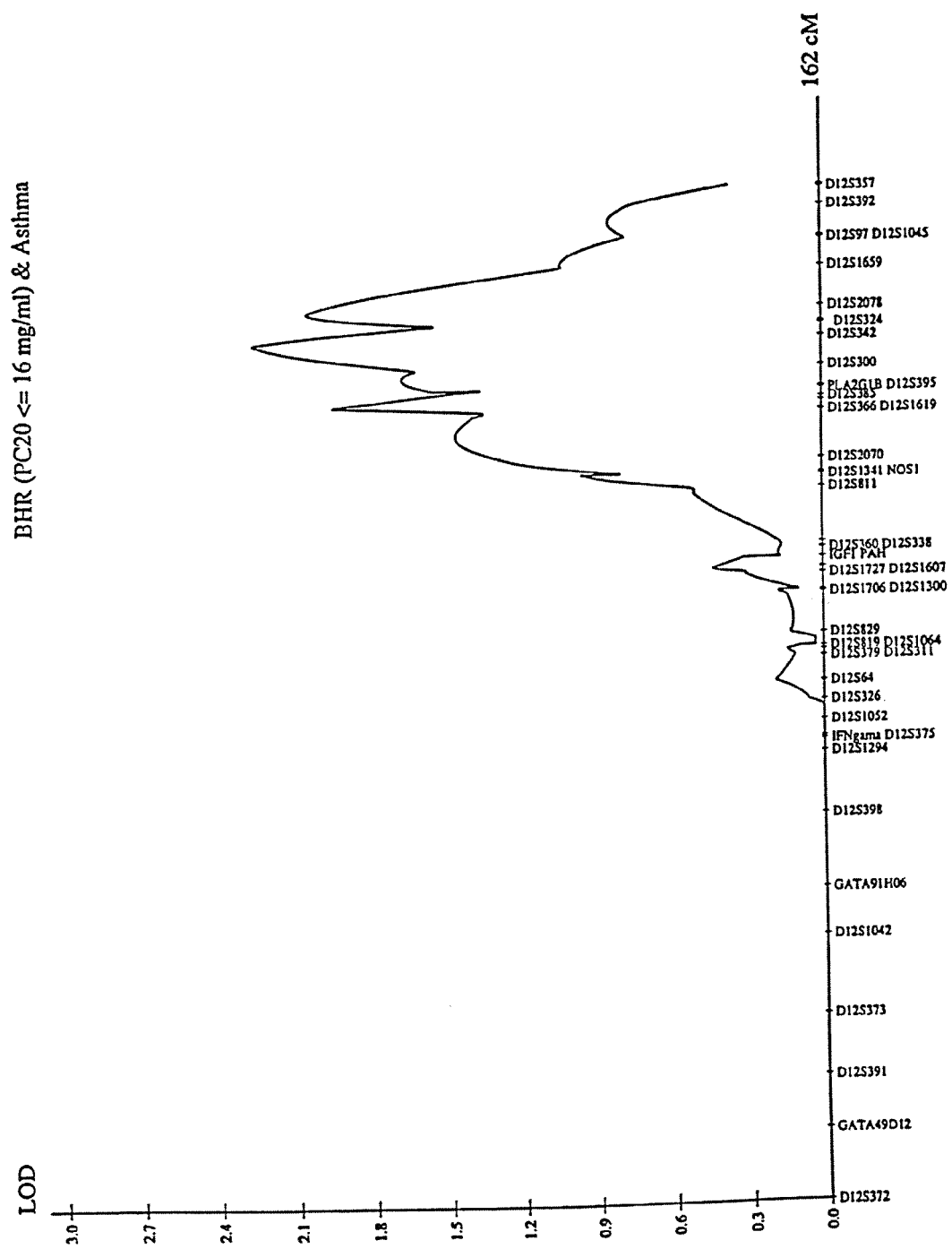

3. Results for BHR and IgE: $PC_{20}$, the concentration of methacholine resulting in a 20% drop in $FEV_1$ (forced expiratory volume), was polychotomized into four groups and analyses were performed on the subsets of asthmatic children with borderline to severe BHR($PC_{20} \leq 16$ mg/ml) or $PC_{20}$ (16). As shown in the LOD plot in FIG. 1B, the MLS for the subset of 218 nuclear families with at least two $PC_{20}$(16) affected sibs was 2.2 at D12S342 with an excess sharing of 0.33. The linkage results implicated a region of chromosome 12 centromeric to the region with the largest signal under the asthma phenotype (FIG. 1A), and indicated the presence of one or more genes with specific susceptibility toward BHR. Since the BHR sample represented a subset of the sample of asthmatics, it elucidated the presence of multiple peaks in the LOD plot of FIG. 1A.

Total IgE was dichotomized using an age specific cutoff for elevated levels (one standard deviation above the mean: 52 kU/L for age 5-9; 63 kU/L for age 10-14; 75 kU/L for age 15-18; and 81 kU/L for adults). Similarly, a dichotomous variable was created using specific IgE to common allergens. An individual was assigned a high specific IgE value if his/her level was positive (grass or tree) or elevated (>0.35 KU/L for cat, dog, mite A, mite B, *alternaria*, or ragweed) for at least one such measure.

Figure 1C:
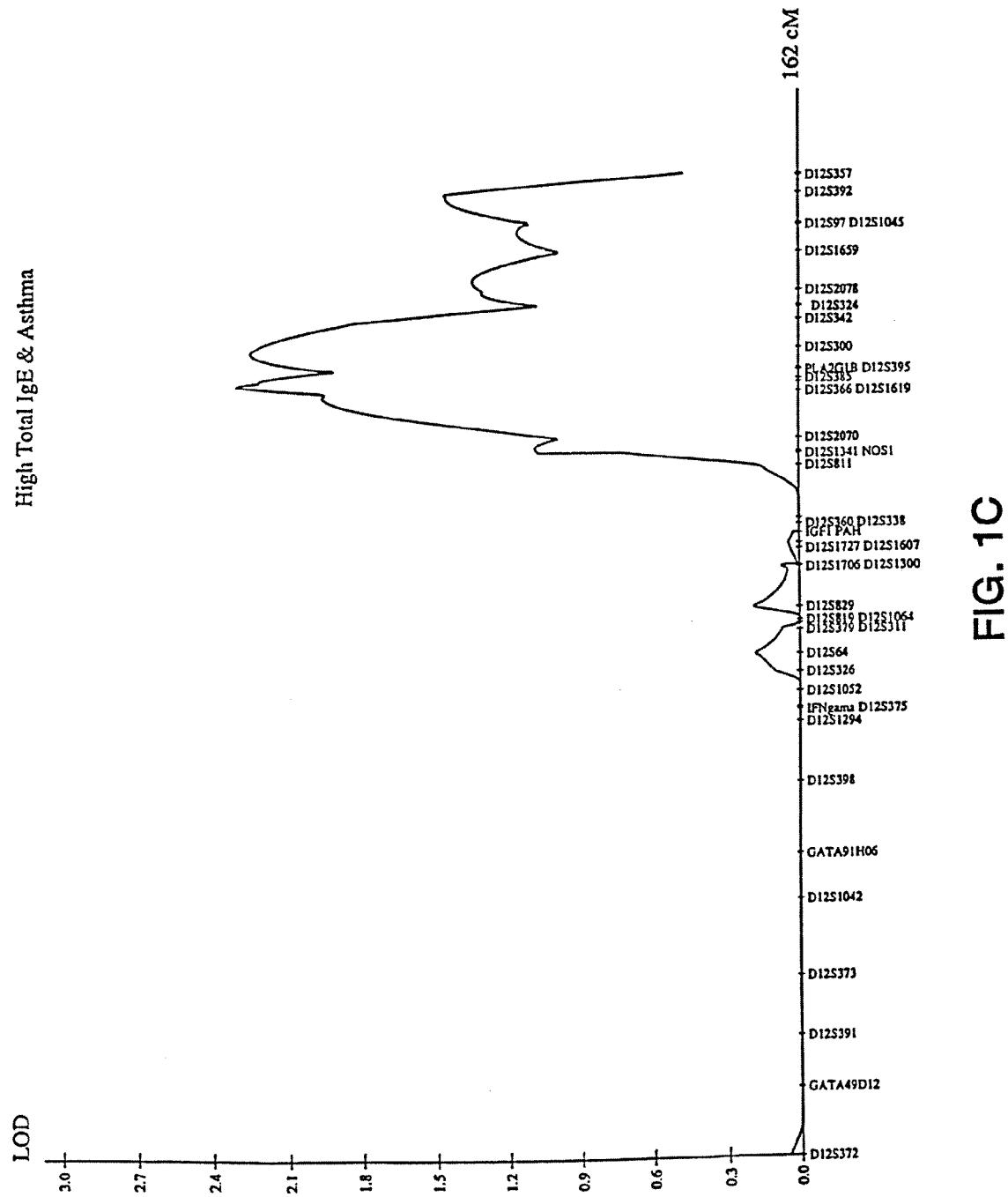
Figure 1D:
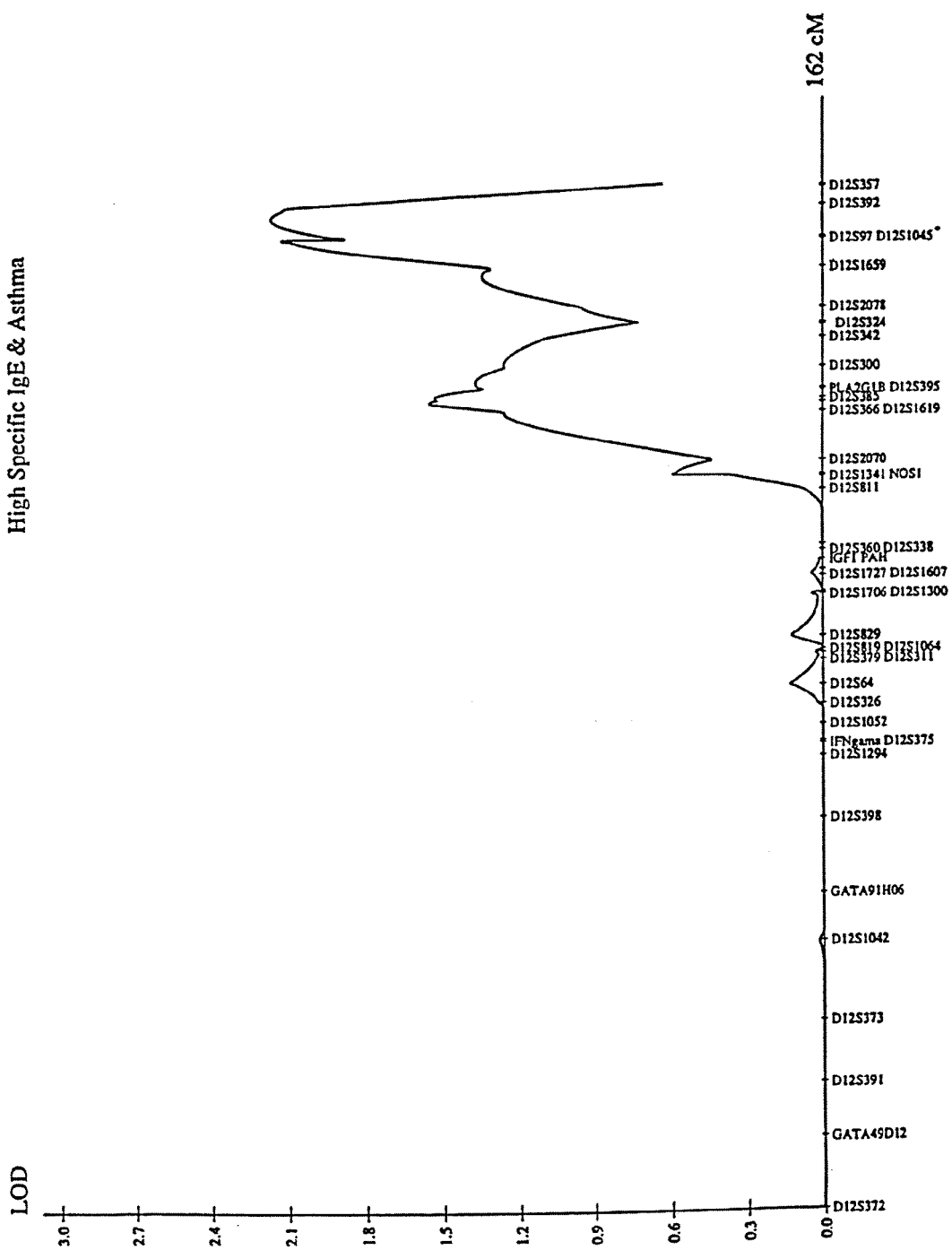

In linkage analyses, the subset of asthmatic children with high total IgE (274 families) gave a maximum LOD score of 2.3 at D12S1619 (FIG. 1C) with an excess sharing of 0.33. The subset with high specific IgE (288 families) gave a LOD score of 2.2 at 164.2 cM, 1.5 cM proximal to marker D12S392 with an excess sharing of 0.33 (FIG. 1D). The analysis with the subset of asthmatic sibs with elevated total IgE implicated a region similar to the one identified with the BHR subset. The region implicated by the subset of asthmatic with elevated specific IgE coincided with the location of the largest signal in the original asthma sample.

Accordingly, a pattern of evidence by linkage analysis pointed to the existence of several asthma susceptibility loci in the 12q23-ter region of chromosome 12. This was supported by the initial analysis of the asthma (yes/no) phenotype with further localization by analyses of BHR, total IgE, and specific IgE in asthmatic individuals. Thus, chromosome 12q23-ter encompassed genes involved in asthma and related diseases thereof.

Example 4

Physical Mapping

Figure 2:
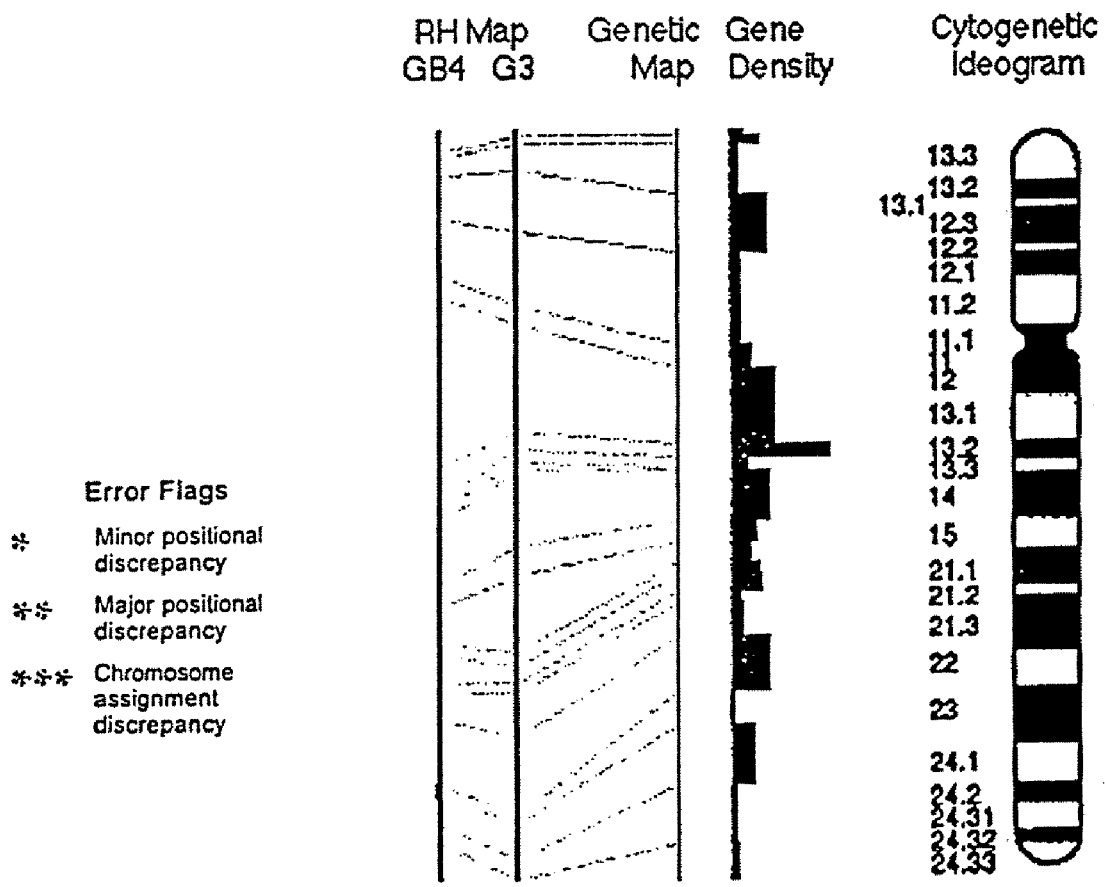
FIGS. 2A-2P show genes mapped to the 12q23-qter interval determined from information that is curated by the National Center for Biotechnology Information, "NCBI"; Bethesda, Md. This particular information contains genes mapped against the Gene Bridge (GB) 4 panel.
Figure 3:
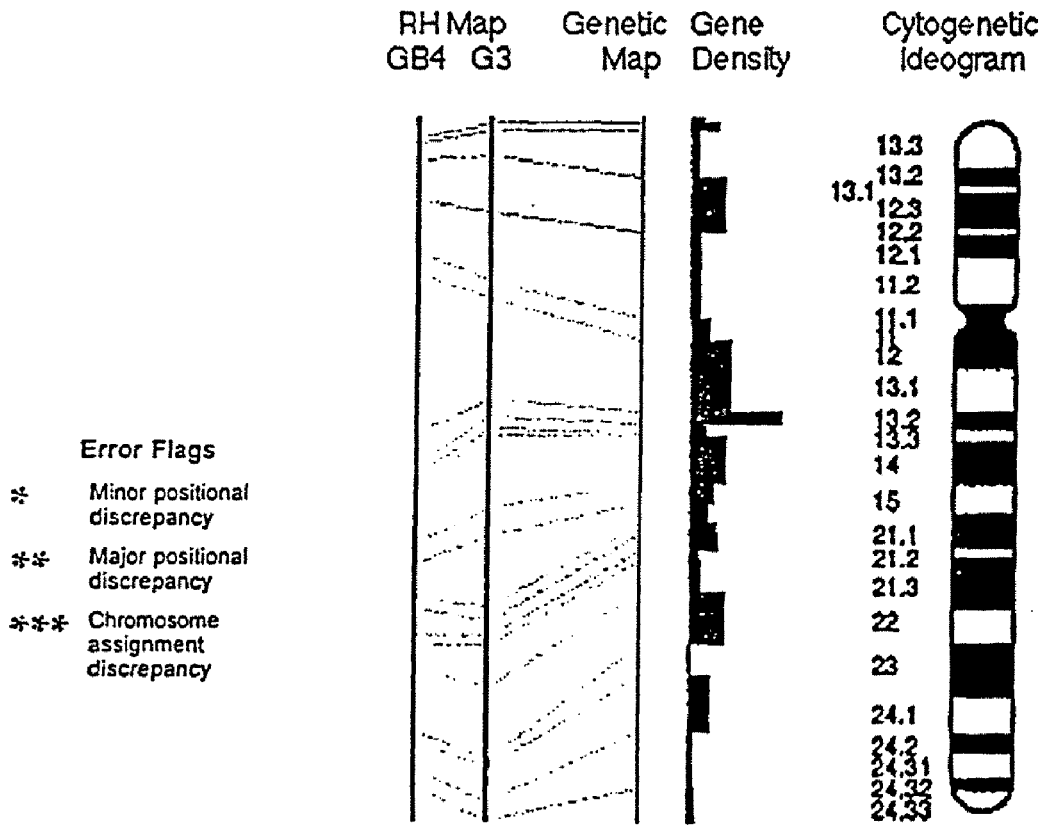
FIGS. 3A-3G show genes mapped to the 12q23-qter interval determined from information that is curated by NCBI (Bethesda, Md.). This particular information contains genes mapped against the Gene Bridge (GB) 3 panel.
Figure 3:
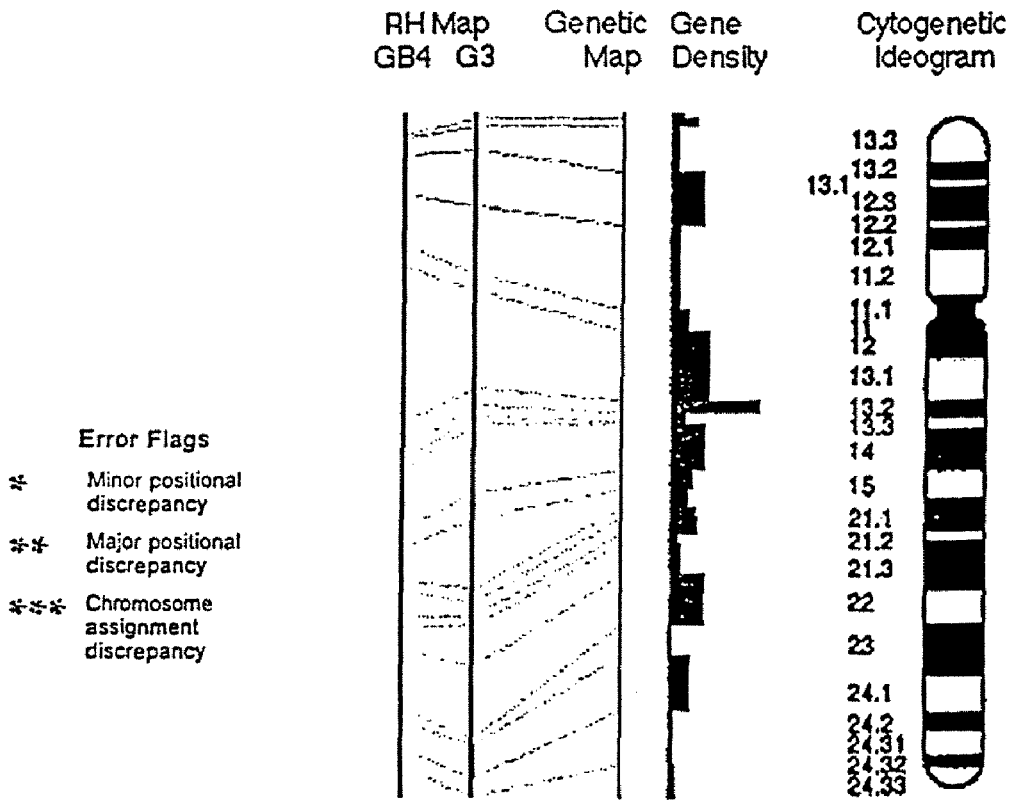
Figure 3:
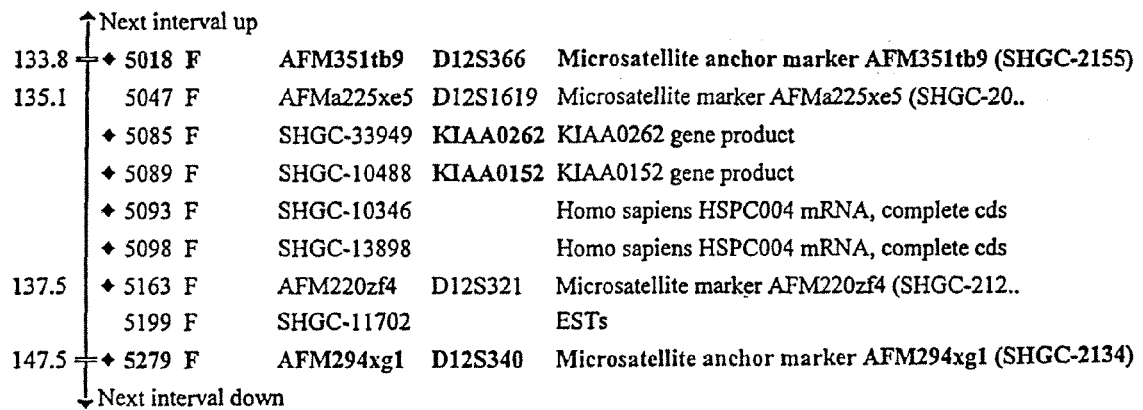
Figure 3:
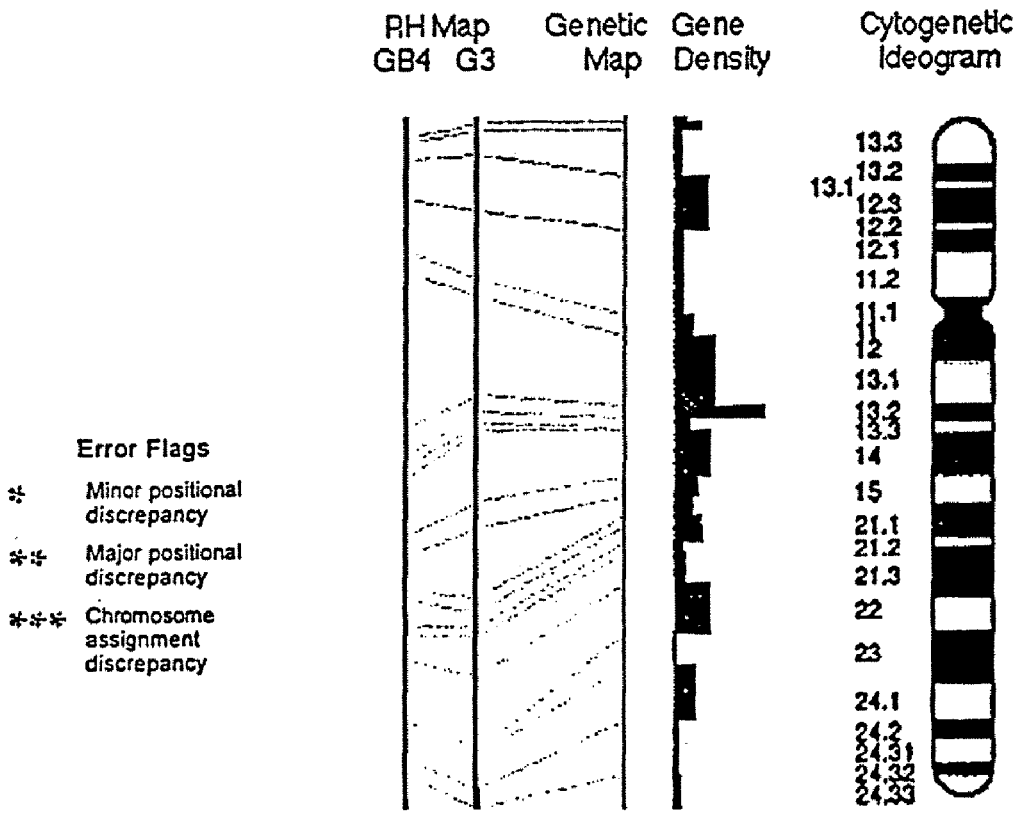
Figure 3:
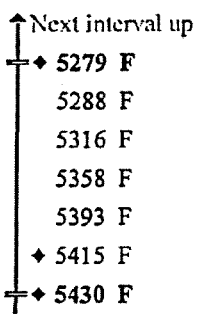

The linkage results for chromosome 12 described above were used to delineate a candidate region for disorder-associated gene(s) located on chromosome 12. Gene discovery efforts were initiated in a ~43 cM interval from marker D12S2070 to the 12 q telomere, representing a 99% confidence interval. All genes known to map to this interval were considered candidates. FIGS. 2A-2P show genes mapped against the GB4 panel and FIGS. 3A-3G show genes mapped against the Stanford G3 panel. The figures were obtained directly from the GeneMap99 web site.

Figure 4:
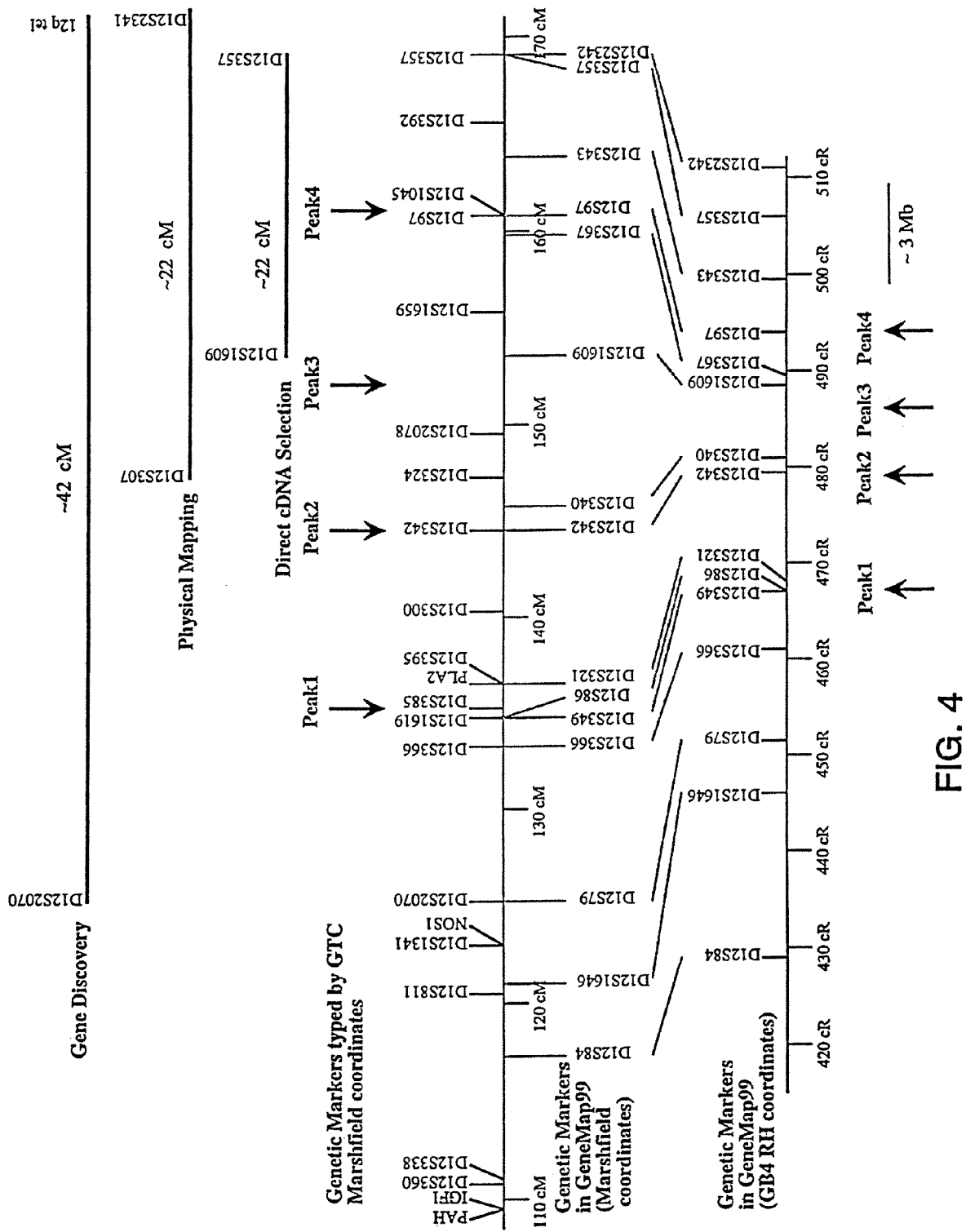
FIG. 4 shows the integration of the Marshfield Center for Medical Genetics (Marshfield, Mich.) genetic map with GeneMap99 from NCBI. The regions of study mentioned above are indicated at the top of the figure.
Figure 5A:
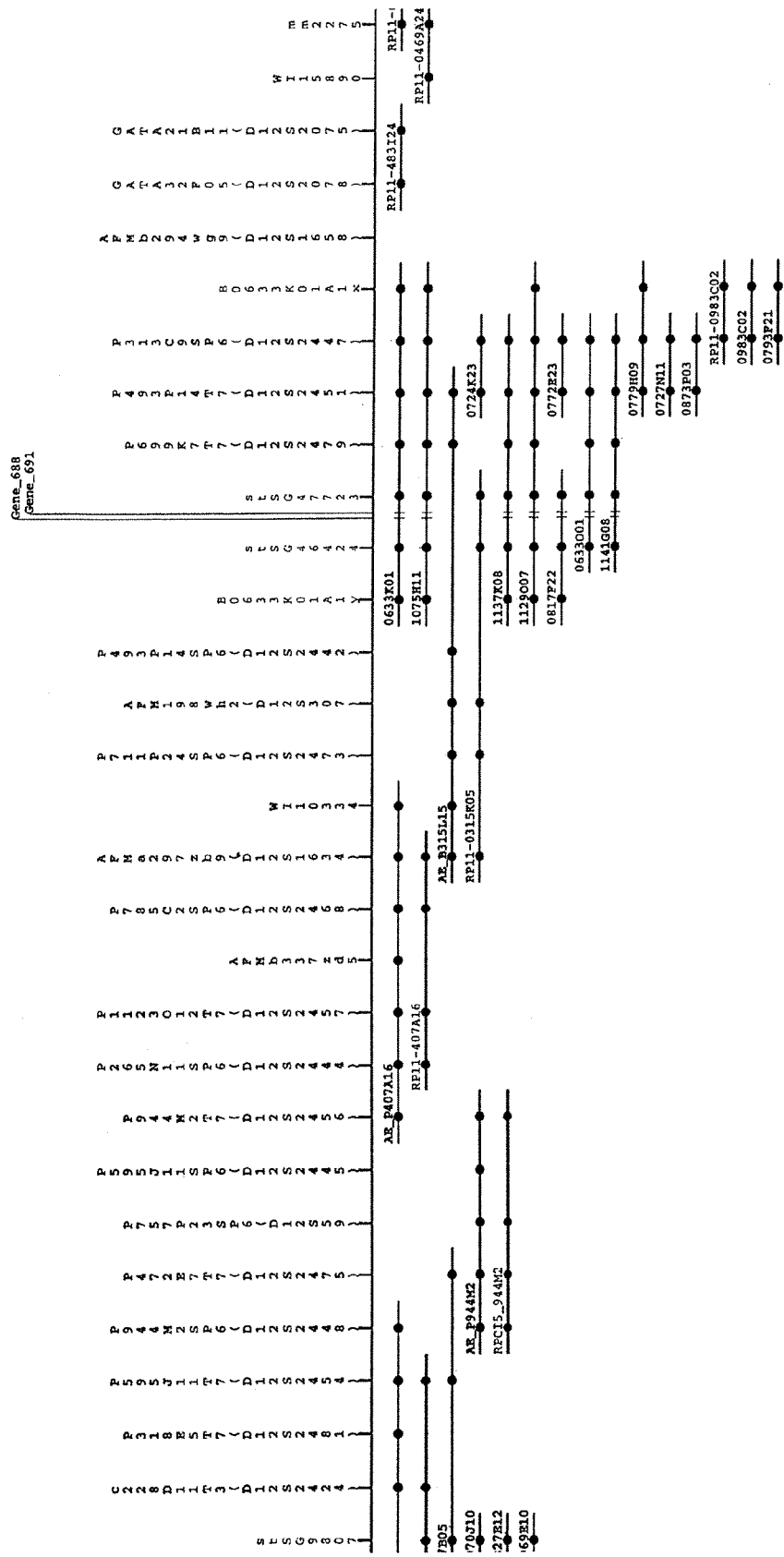
FIGS. 5A-5I show the BAC/STS content contig map for chromosome 12.
Figure 5B:
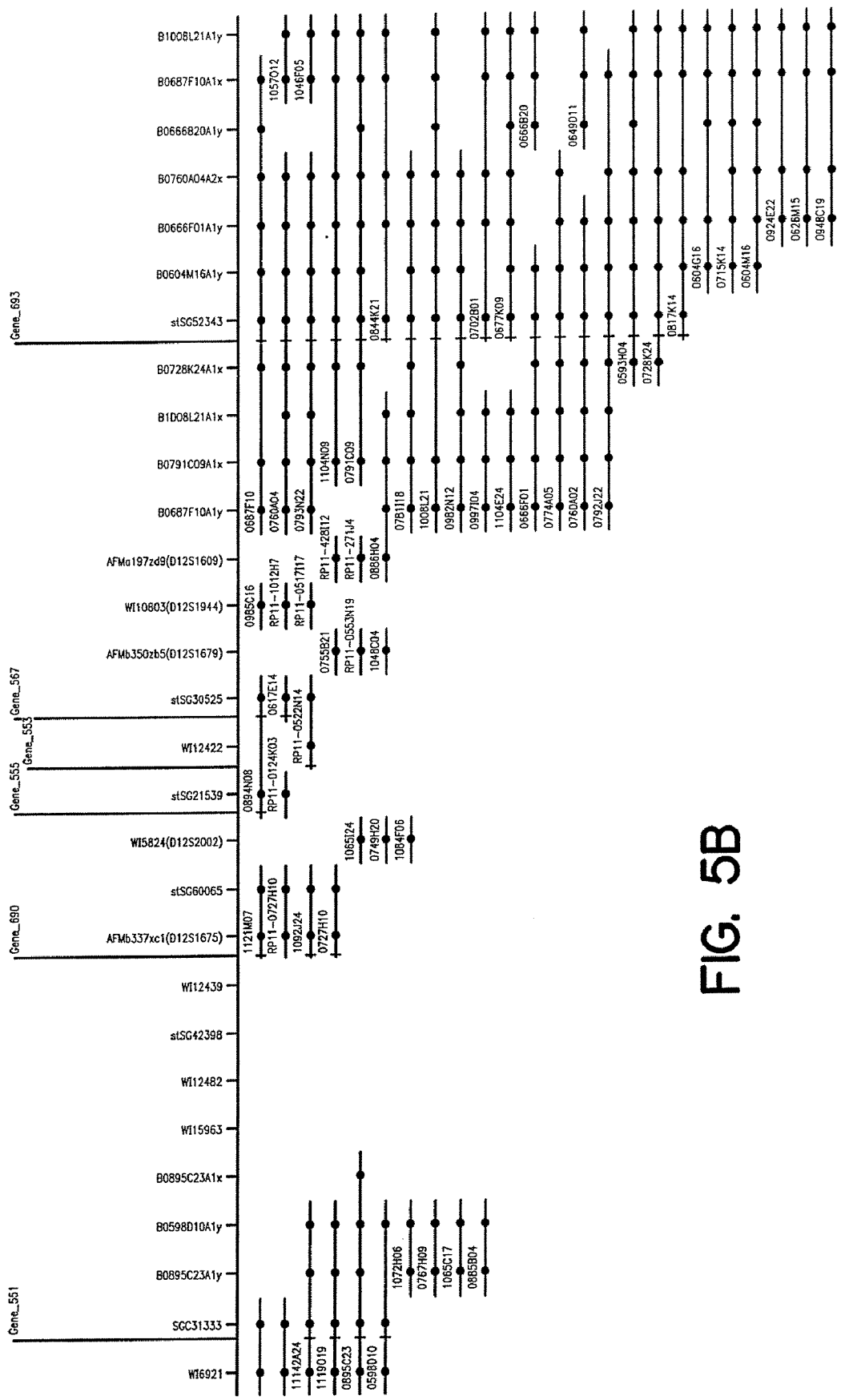
Figure 5C:
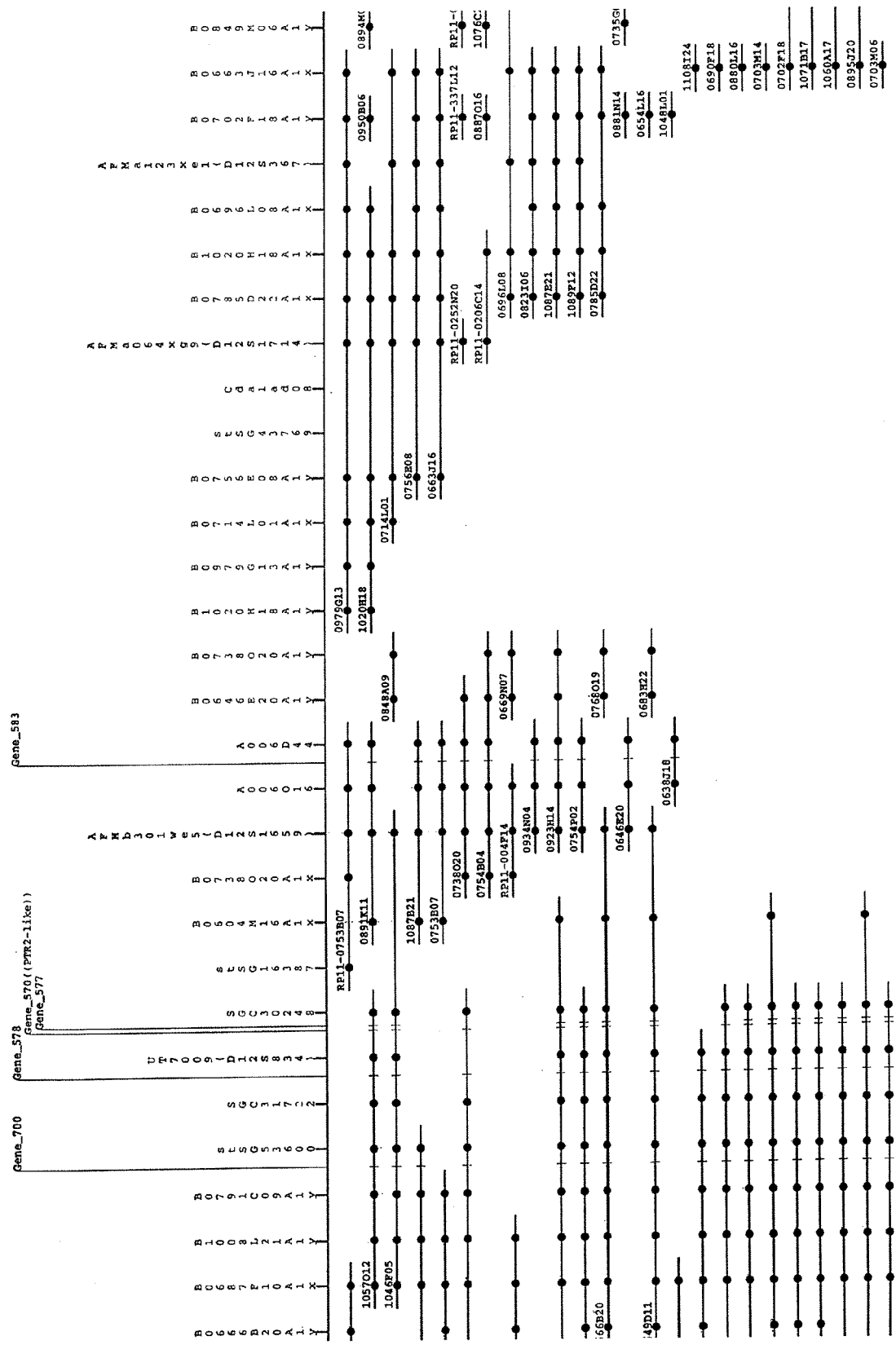
Figure 5D:
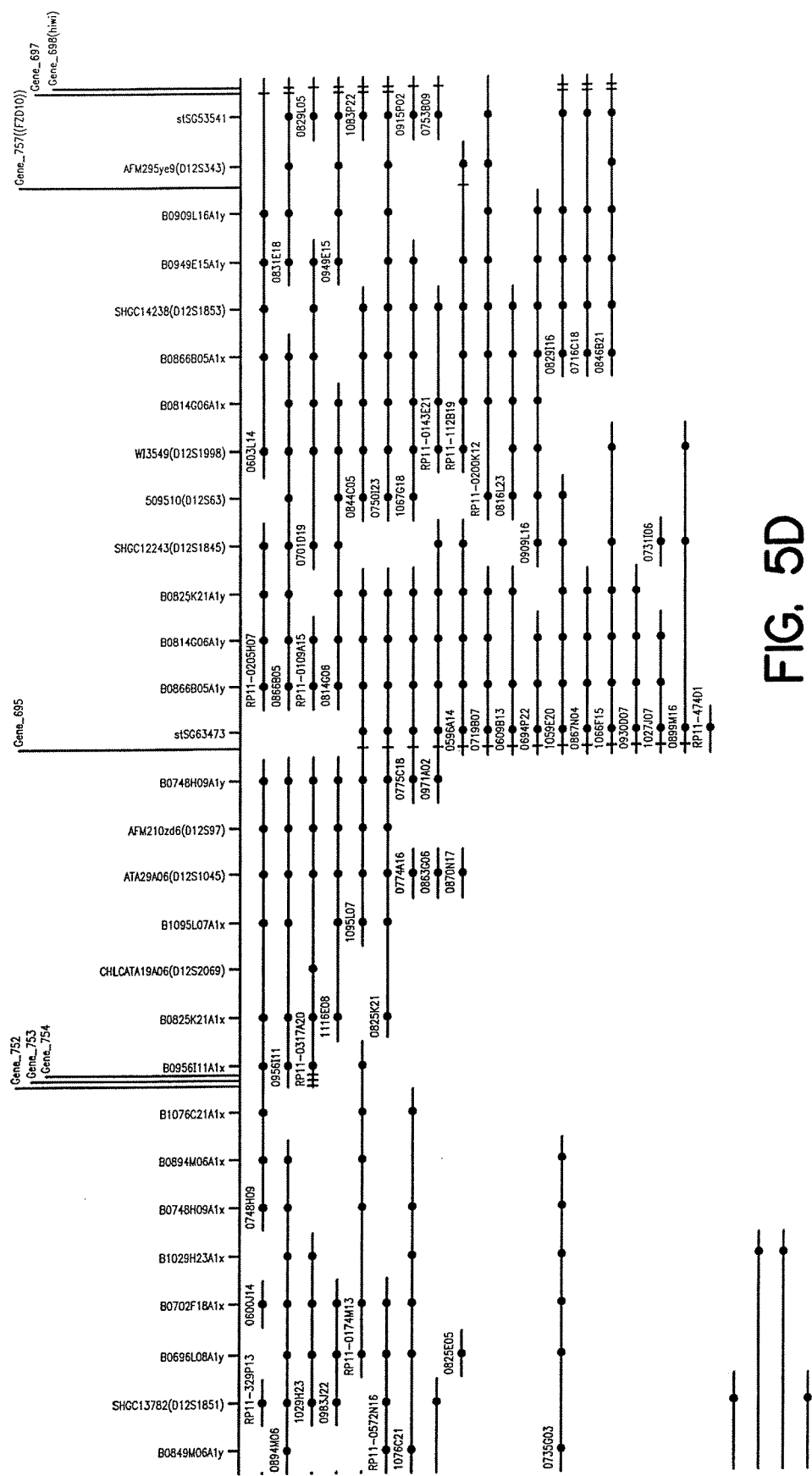
Figure 5E:
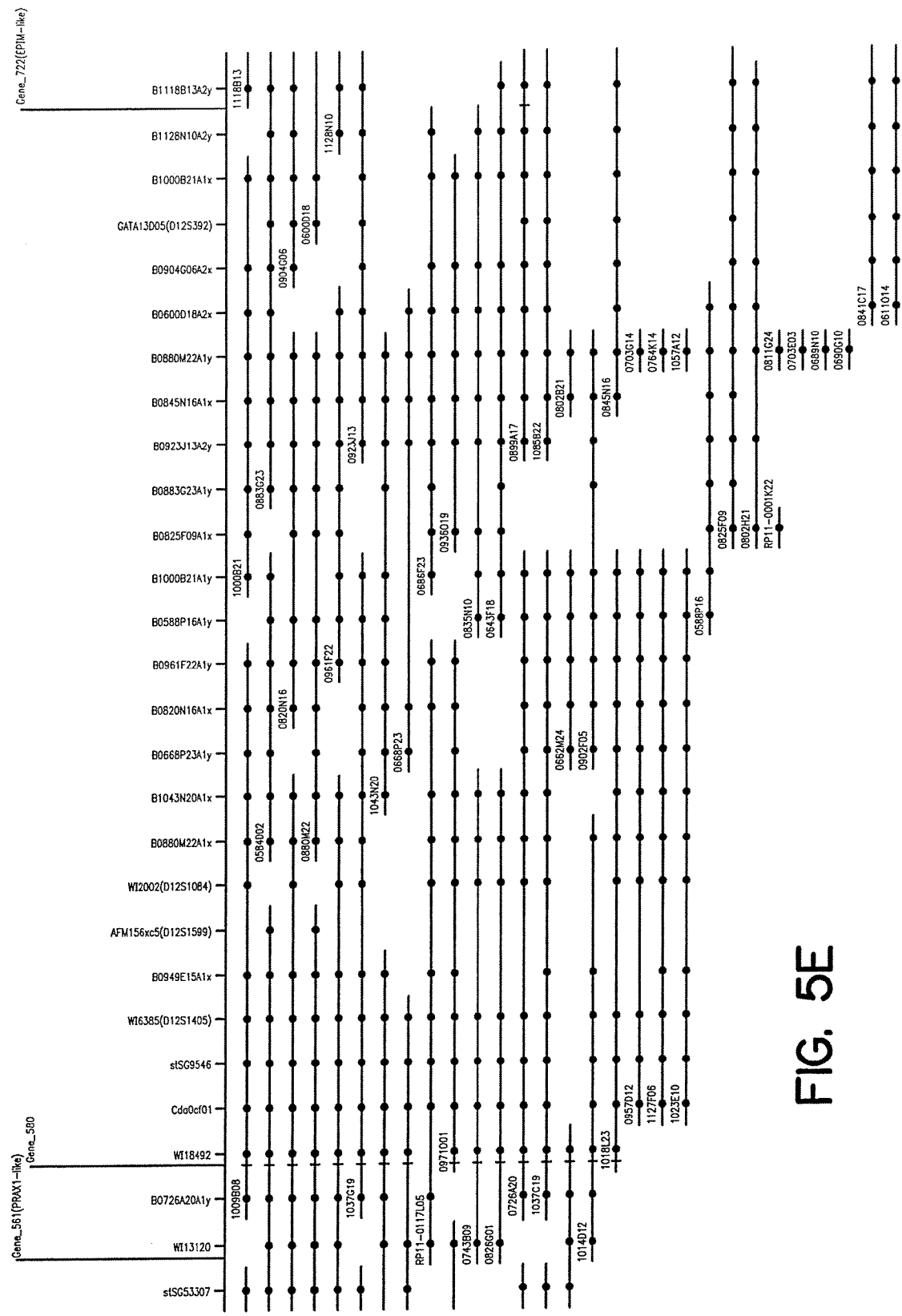
Figure 5F:
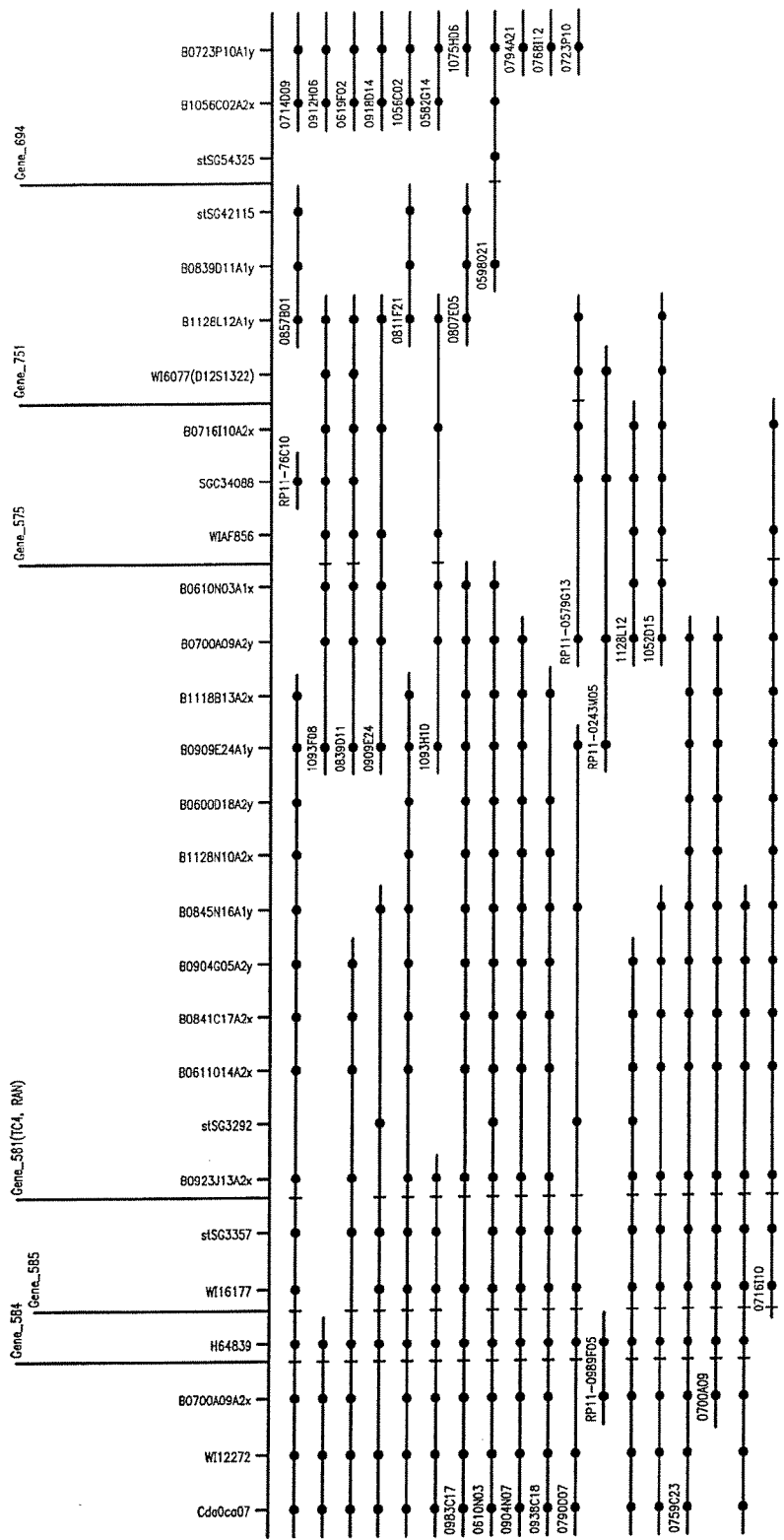
Figure 5G:
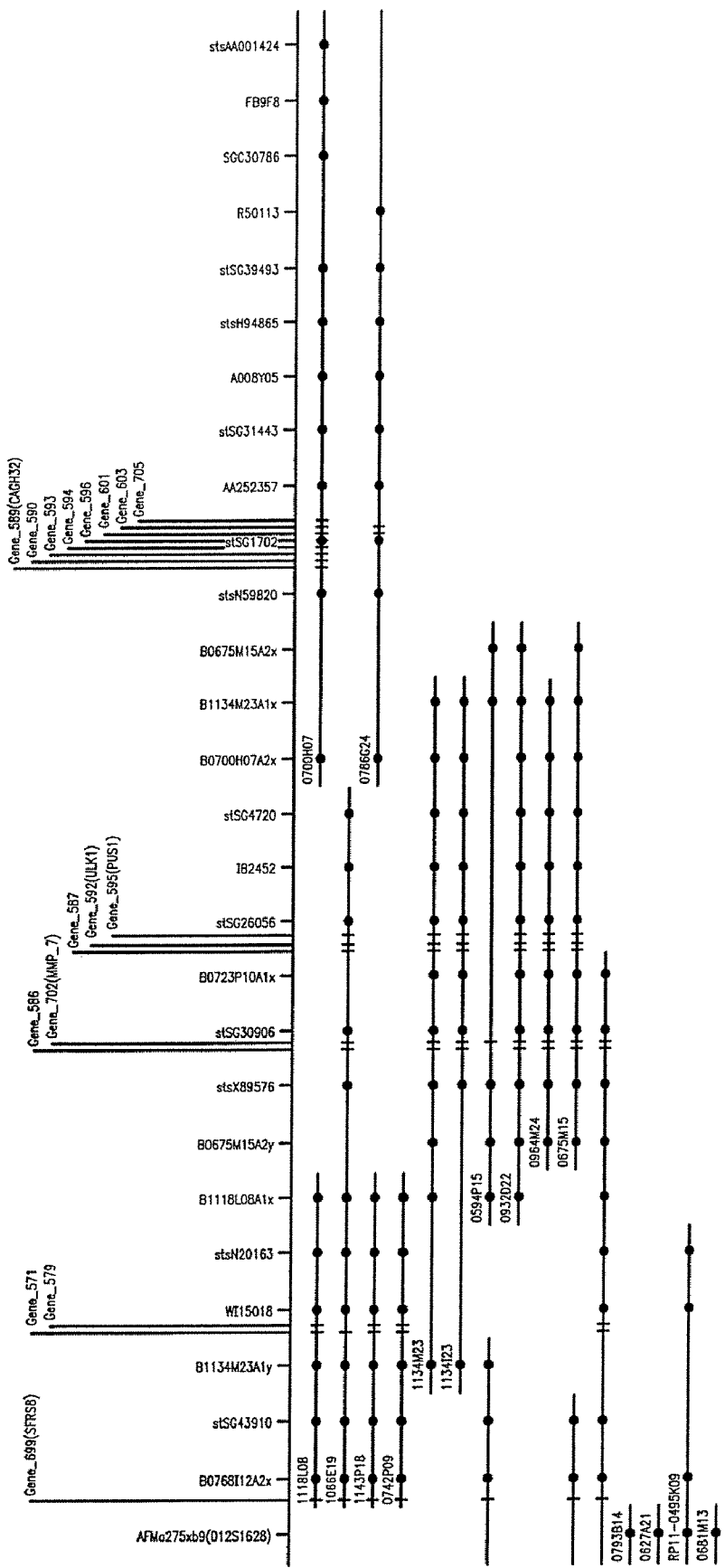
Figure 5H:
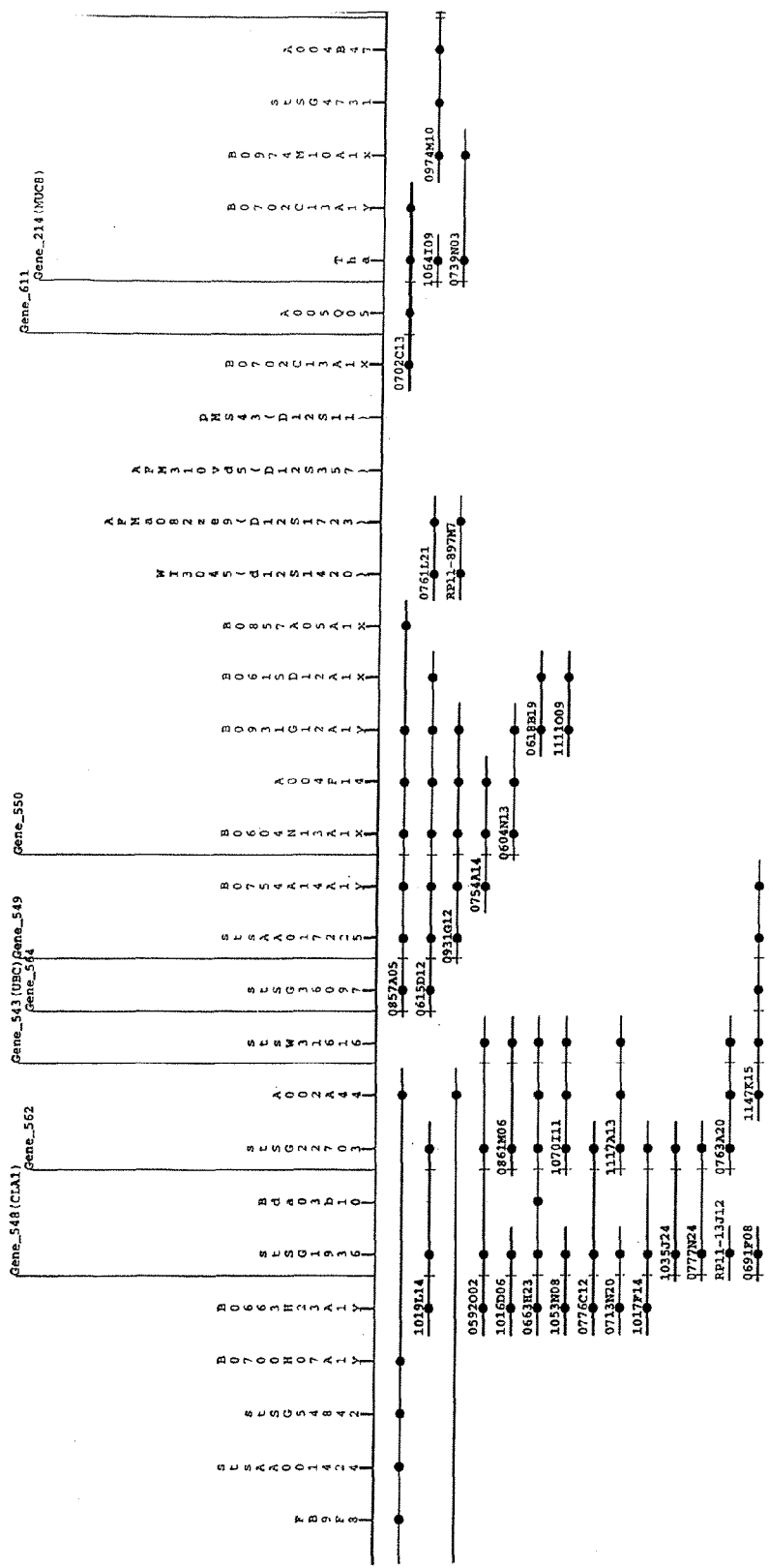
Figure 5I:
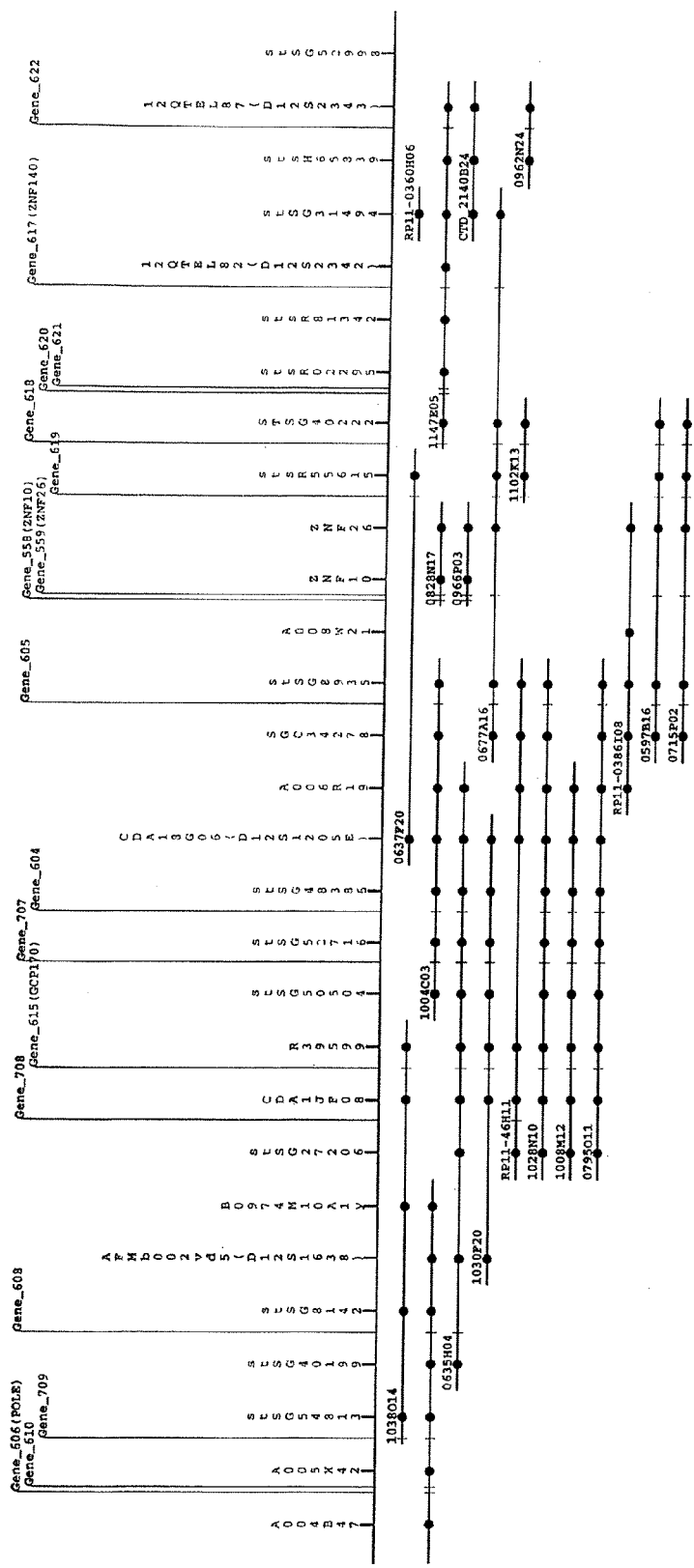

Physical mapping (BAC contig construction) focused on a ~22 cM interval approximately between markers D12S307 and D12S2341. The discovery of novel genes using direct cDNA selection focused on a ~15 cM region between markers D12S1609 and D12S357. FIG. 4 shows the integration of the Marshfield Center for Medical Genetics genetic map with GeneMap99 from NCBI. The relevant regions are indicated at the top of the figure.

The following section describes the construction of a BAC contig spanning the disorder gene region on chromosome 12. This approach was used: 1) to provide genomic clones for DNA sequencing (analysis of this sequence would provide information about the gene content of the region); and 2) to provide reagents for direct cDNA selection (and provide additional information about novel genes mapping to the interval). The physical map consisted of an ordered set of molecular landmarks, and a set of BACs (U.-J. Kim et al., 1996, *Genomics* 34:213-218; H. Shizuya et al., 1992, *Proc. Natl. Acad. Sci. USA* 89:8794-8797) that contained the disorder gene region from human chromosome 12q23-qter.

FIGS. 5A-5I show the BAC/STS content contig map of human chromosome 12q23-qter. Markers used to screen the RPCI-11 BAC library (P. dejong, Roswell Park Cancer Institute (RPCI)) are shown in the top row. Markers that were present in the Genome Database (GDB, Research Triangle Institute (RTI) International; Research Triangle, N.C.) are represented by GDB nomenclature. The BAC clones are shown below the markers as horizontal lines.

1. Map Integration. Various publicly available mapping resources were utilized to identify existing STS (sequence tagged site) markers in the 12q23-qter region (Olson et al., 1989, *Science*, 245:1434-1435). Resources included GDB, Genethon, the Marshfield Center for Medical Genetics, the Whitehead Institute Genome Center (Cambridge, Mass.), GeneMap98, dbSTS, and dbEST (NCBI), the Sanger Centre (United Kingdom), and the Stanford Human Genome Center (Stanford, Calif.). Maps were integrated manually to identify markers mapping to the disorder region. A list of markers is shown in Table 2.

2. Marker Development: Sequences for existing STSs were obtained from the GDB, Radiation Hybrid Database (RHDB; United Kingdom), or NCBI, and were used to pick primer pairs (overgos; see Table 2) for BAC library screening. Novel markers were developed from publicly available genomic sequences, proprietary cDNA sequences, or from sequences derived from BAC insert ends (described below). Primers were chosen using a script that automatically performs vector and repetitive sequence masking using CROSSMATCH (P. Green, University of Washington). Subsequent primer selection was performed using a customized Filemaker Pro database (Filemaker, Inc.; Santa Clara, Calif.). Primers for use in PCR-based clone confirmation or radiation hybrid mapping (described below) were chosen using the program Primer3 (Steve Rozen, Helen J. Skaletsky, 1996, 1997, Rozen, S., Skaletsky, H. "Primer3 on the WWW for general user and for biologist programmers." In S. Krawetz and S. Misener, eds. Bioinformatics Methods and Protocols in the series Methods in Molecular Biology. Humana Press, Totowa, N.J., 2000, pages 365-386).

TABLE 2

PRIMER PAIRS

| Marker name | Locus | DNA type | Gene | Forward primer | Seq ID NO: | Reverse primer | Seq ID NO: |
|---|---|---|---|---|---|---|---|
| B0610N03-A1.x | | BACend | | CAAGCGATAGTTCTAATTTTCT | 4689 | TATGTGTTGGAGCCAGAAAATT | 4714 |
| B0600D18-A2.x | | BACend | | TGGTGTTCTCTGAGCTTCCAGG | 4690 | ACCGAACCAAAGATCCTGGAAG | 4715 |

TABLE 2-continued

PRIMER PAIRS

| Marker name | Locus | DNA type | Gene | Forward primer | Seq ID NO: | Reverse primer | Seq ID NO: |
|---|---|---|---|---|---|---|---|
| B0611O14-A2.x | | BACend | | GTCTTGATTTTAAGGTTTGAGG | 4691 | CTGCCCTCACCTTGCCTCAAAC | 4716 |
| B0700A09-A2.x | | BACend | | GCTGCTTCCAGCATTTCAGCAT | 4692 | CAGTGTTATATGTGATGCTGAA | 4717 |
| B0716I10-A2.x | | BACend | | ATGATGCAGTGAGTGAGACCCA | 4693 | CTTACTCACTACACTGGGTCTC | 4718 |
| B1118B13-A2.x | | BACend | | GCACTGGGTCTTCTCATCTGCT | 4694 | ACTCTCGTGGATAGAGCAGATG | 4719 |
| B1128N10-A2.x | | BACend | | CACGAGAGTCTAGTGGGGGTTT | 4695 | TCACTTGGCAGATGAAACCCCC | 4720 |
| B0841C17-A2.x | | BACend | | TCCCCTGATATCCACTATCTTT | 4696 | CATTAGATGATGGTAAAGATAG | 4721 |
| B0904G06-A2.x | | BACend | | ACTGTCTCATTCTTTACAGAAA | 4697 | GGAACAGCAAACGTTTTCTGTA | 4722 |
| B0923J13-A2.x | | BACend | | CAGGTCTCTGCAGAGCATTTCT | 4698 | GACTCTTGTTAACGAGAAATGC | 4723 |
| B0675M15-A2.x | | BACend | | GCAGACAATATCAAGAGTTCTT | 4699 | CTGTAACACATCTCAAGAACTC | 4724 |
| B0600D18-A2.y | | BACend | | TCATCTGCCAAGTGAGCCCAGT | 4700 | GACCTCACCAAAGCACTGGGCT | 4725 |
| B0610N03-A2.y | | BACend | | GATACCAATGTGAAGTCCTTGA | 4701 | GTTTTCTTCCAGCCTCAAGGAC | 4726 |
| B0700A09-A2.y | | BACend | | TCTCGATCCCACTAACCACGAT | 4702 | ATGAAGTACATTGGATCGTGGT | 4727 |
| B1118B13-A2.y | | BACend | | ACTGGAATGCTCAGCTGGATGC | 4703 | TTCTCCAGGGTCAAGCATCCAG | 4728 |
| B1128N10-A2.y | | BACend | | TGCTGATCTCTCAGTTCACCCT | 4704 | GCAAGCCACCCATCAGGGTGAA | 4729 |
| B0904G06-A2.y | | BACend | | ATCTAATGCTGTGGCCGCTGCT | 4705 | GGTTGTTTGCTGCAGCAGCGG | 4730 |
| B0923J13-A2.y | | BACend | | GACAGCCAGAGGAAACCTCTTC | 4706 | AAAAGTTGTCTTGGGAAGAGGT | 4731 |
| B0675M15-A2.y | | BACend | | CACCTCTGGCTTTCCTACAACC | 4707 | AGCTGTGACATGAAGGTTGTAG | 4732 |
| B0635H04-A1.x | | BACend | | AGCTTCGTCTGACCAGTCTACC | 4708 | TTCAGGAACCACCAGGTAGACT | 4733 |
| B0666B20-A1.x | | BACend | | TGCCTGTGACTGAAGTCTTGAT | 4709 | GAGTGAGTAAGGAAATCAAGAC | 4734 |
| B0696D03-A1.x | | BACend | | AGGAAGAACAGAAGCAGTCTTT | 4710 | GTCATTATTTCCTCAAAGACTG | 4735 |
| B0700H07-A1.x | | BACend | | TCCTGGGAAGCAAGAATAGGAA | 4711 | TCGCAGTGGCTTTGTTCCTATT | 4736 |
| B0726A20-A1.x | | BACend | | ACTGTTGTCACCTCTGGGAAAG | 4712 | AGTCTTCCAGGTCTCTTTCCCA | 4737 |
| B0761L21-A1.x | | BACend | | GAGTAAAAGAATGTGTATAGGG | 4713 | TTTTTTGACCCACCCCCTATAC | 4738 |
| B0814G06-A1.x | | BACend | | CGAGGAAGATGTAAGAGACTGT | 4739 | ATTGAGGCCCCAGAACAGTCTC | 4768 |
| B0857A05-A1.x | | BACend | | TCTTTAGTCCTTTGGGAGAGCT | 4740 | ATTTTCCCACAGGAAGCTCTCC | 4769 |
| B0895C23-A1.x | | BACend | | AGGTGCTACCTCGCTCAATCTG | 4741 | GGGCTGGTTGCTCACAGATTGA | 4770 |
| B0949E15-A1.x | | BACend | | CTTTTGAAGACGTGGGTTCTGT | 4742 | GAATGCAAGCACTCACAGAACC | 4771 |
| B0604M16-A1.x | | BACend | | AGCCATAAACACACATTTCTAT | 4743 | GATGCTCTGTGCATATAGAAAT | 4772 |
| B0615D12-A1.x | | BACend | | TCCACTGAGAGTTACCAAACCC | 4744 | GGTATGAGAATTGTGGGTTTGG | 4773 |
| B0633K01-A1.x | | BACend | | GTTCAGATTTTATCTTGGGTAT | 4745 | ACTGATGACATTTGATACCCAA | 4774 |
| B0663H23-A1.x | | BACend | | GAGGTCCCTATTGCTGTGTTTT | 4746 | CAGCCAATGAAGTCAAAACACA | 4775 |
| B0696L08-A1.x | | BACend | | ATCTGTAGCCTATAGTGAACAG | 4747 | TTTACAGTGTTTGCCTGTTCAC | 4776 |
| B0702C13-A1.x | | BACend | | GTAGTAACAGAATGGACTTTGA | 4748 | AGAGAGGAACAGCATCAAAGTC | 4777 |
| B0702F18-A1.x | | BACend | | CTCTGCATTTCTTACTCCTTAC | 4749 | AAGCTTTACTACCAGTAAGGAG | 4778 |
| B0728K24-A1.x | | BACend | | TCGCAAATAGCACAAGGGACTT | 4750 | CACCGTTATGCAGAAAGTCCCT | 4779 |
| B0738O20-A1.x | | BACend | | TGAAGTTCGGAATCCCTGATAG | 4751 | AGGTTCCTACTGAGCTATCAGG | 4780 |
| B0866B05-A1.x | | BACend | | AGCAGAAGAGCAGACCCTTCAA | 4752 | GGAGCATCCAATCTTTGAAGGG | 4781 |

TABLE 2-continued

PRIMER PAIRS

| Marker name | Locus | DNA type | Gene | Forward primer | Seq ID NO: | Reverse primer | Seq ID NO: |
|---|---|---|---|---|---|---|---|
| B0598D10-A1.y | | BACend | | AGATGCTTATACTTGGTGTAAG | 4753 | TACTTACACAGTTGCTTACACC | 4782 |
| B0635H04-A1.y | | BACend | | AGTCACACCTTATGAGGCATCA | 4754 | CTGTATGAATCCTCTGATGCCT | 4783 |
| B0666B20-A1.y | | BACend | | ATCCTGCTTTGTGGGTAGCCAC | 4755 | AATGCCACGGTGCAGTGGCTAC | 4784 |
| B0700H07-A1.y | | BACend | | ACTCAAACCAACCTTCCATTCA | 4756 | GGTTAGGATTAGTGTGAATGGA | 4785 |
| B0726A20-A1.y | | BACend | | TCAGTTCTCAGTCCTAGGAGAC | 4757 | GGTCTTCTACTCCAGTCTCCTA | 4786 |
| B0761L21-A1.y | | BACend | | GCGAGGCCTGCTGTCTTTCTCA | 4758 | AAATTAGCCAGGCATGAGAAAG | 4787 |
| B0814G06-A1.y | | BACend | | GCAGAGAGGTGGTGAGTGCATC | 4759 | TGACAGTTTCCTTTGATGCACT | 4788 |
| B0857A05-A1.y | | BACend | | TGCTTATCAAGATGCCTTTGCC | 4760 | AATCAGGCCATGAGGGCAAAGG | 4789 |
| B0895C23-A1.y | | BACend | | CCATCCTTCATCCCCAGCAGTA | 4761 | CCCTGAATTTAGGTTACTGCTG | 4790 |
| B0931G12-A1.y | | BACend | | AGAACCAGGCAGAGCTACCTGG | 4762 | CTGGACCAGGAAATCCAGGTAG | 4791 |
| B0949E15-A1.y | | BACend | | ACTAGCTATTGAAGTGACTATC | 4763 | ATGGGCAAAGAATAGATAGTCA | 4792 |
| B0604M16-A1.y | | BACend | | GTTTCAGCTGTGGAAAATGTTA | 4764 | TGTCTTCCTCCCCTTAACATTT | 4793 |
| B0633K01-A1.y | | BACend | | ATGCTGCTTCATATAACACATT | 4765 | CGGGAAGCATTTGCAATGTGTT | 4794 |
| B0663H23-A1.y | | BACend | | CTCGCTCCATCTGCGATGCACA | 4766 | AGGTGATCACAGACTGTGCATC | 4795 |
| B0696L08-A1.y | | BACend | | TGTTGTGTCAGAAACTCAGGAA | 4767 | ACCCAGCTGAATCCTTCCTGAG | 4796 |
| B0702C13-A1.y | | BACend | | TCATGGGGTGCTTTGACCTTG | 4797 | TGGCCTCAAAGGCTCAAGGTCA | 4826 |
| B0702F18-A1.y | | BACend | | CATGGTCACCTGCAGCCTCTCA | 4798 | TGGCTAGAAGGAGGTGAGAGGC | 4827 |
| B0738O20-A1.y | | BACend | | AGAAGCGGGGTGAGCAGGACAT | 4799 | GTTACCCGGGAGTTATGTCCTG | 4828 |
| B0866B05-A1.y | | BACend | | GATGTTGTCCGACAGGCATGGG | 4800 | TTCCTGTGTAGATCCCCATGCC | 4829 |
| B0883G23-A1.y | | BACend | | GTGGTAGAATTGGCAAGCCTTG | 4801 | CTCCAATCAGTTGCCAAGGCTT | 4830 |
| B0909L16-A1.y | | BACend | | GGTAAGGACACCTTCAAGGGAC | 4802 | TGGAGTGCCCTGTTGTCCCTTG | 4831 |
| B0974M10-A1.x | | BACend | | ATGCAAAGGTCTCAGGACGAAA | 4803 | CCCTTCCTGGACAATTTCGTCC | 4832 |
| B1118L08-A1.x | | BACend | | GGCATGTAGATCAAATGAAATA | 4804 | TGCTCCAGCTGAATATTTCAT | 4833 |
| B0723P10-A1.x | | BACend | | GGTAGCAGTCTTACACTGCTGG | 4805 | CCTTTCCGATGACCCCAGCAGT | 4834 |
| B0748H09-A1.x | | BACend | | TGCCATGTAACGTTCATATTCC | 4806 | GTTTTCCTGTGCAGGGAATATG | 4835 |
| B0825F09-A1.x | | BACend | | ATACCCACAGGGTAGTAACAGT | 4807 | TTGTGGCTCAAATCACTGTTAC | 4836 |
| B0825K21-A1.x | | BACend | | CGTGAGCCCATTTCAACCACAC | 4808 | TCCCTGTCTTTGAAGTGTGGTT | 4837 |
| B0845N16-A1.x | | BACend | | ACATATGAAAAGACCGTAGAAA | 4809 | CAATTCACAGGCACTTTCTACG | 4838 |
| B0894N08-A1.x | | BACend | | ACGTGGAGAAGGCCGCTGTCTT | 4810 | CTGGACATTGAATAAAGACAGC | 4839 |
| B0956I11-A1.x | | BACend | | TGAATTTTAACAGGTGGCAAAG | 4811 | ATTCCATCTGACAGCTTTGCCA | 4840 |
| B0974M10-A1.y | | BACend | | CTCATAGTTGTTACACACTCTG | 4812 | AAGCACGTGTTGAACAGAGTGT | 4841 |
| B0646E20-A1.y | | BACend | | CTCCATAGGAAGCAGCCATCAG | 4813 | ACTGGACCCAGCAACTGATGGC | 4842 |
| B0723P10-A1.y | | BACend | | TGTACCAAACTGTTGACTATTA | 4814 | GTTTGCCTCATGCTTAATAGTC | 4843 |
| B0748H09-A1.y | | BACend | | GCCTGCACAGGACACAATTGCA | 4815 | TTCCGGGTTTGATGTGCAATTG | 4844 |
| B0825K21-A1.y | | BACend | | CAATAATTAGTTCCAATGGCGC | 4816 | CACAGTCAGAGTTGGCGCCATT | 4845 |
| B0845N16-A1.y | | BACend | | GAGTGCTCACCGGAAGAGAAGA | 4817 | TCCAGAGCCAACTGTCTTCTCT | 4846 |
| B0894N08-A1.y | | BACend | | TGCCTTTCTTCCTTAGAGCTCC | 4818 | CATCTGGATTAGCTGGAGCTCT | 4847 |

TABLE 2-continued

PRIMER PAIRS

| Marker name | Locus | DNA type | Gene | Forward primer | Seq ID NO: | Reverse primer | Seq ID NO: |
|---|---|---|---|---|---|---|---|
| B0956I11-A1.y | | BACend | | TGTGGGATGCTTCCAGTTTTGT | 4819 | GATGAGTAGATCCCACAAAACT | 4848 |
| B0961F22-A1.x | | BACend | | CATCCTGCCTCGGGTCTGAACT | 4820 | GGTCACTGCAGGAAAGTTCAGA | 4849 |
| B0588P16-A1.x | | BACend | | AAGAAGGACCTCAACCAAGAGC | 4821 | ACCCATGTGTGTCAGCTCTTGG | 4850 |
| B1000B21-A1.x | | BACend | | TATTACAGAGGCTGGTGATCAG | 4822 | TAGCCTGTCAGAAGCTGATCAC | 4851 |
| B0839D11-A1.x | | BACend | | GACAACTTGCTTCCTTTACCTG | 4823 | AGATGACCTATTGCCAGGTAAA | 4852 |
| B1052D15-A1.x | | BACend | | CAGAAGCATAGAAACAATCCAG | 4824 | GCACTGTTTTATAACTGGATTG | 4853 |
| B1093F08-A1.x | | BACend | | TGCTGCAACTGCCAAAGAATTC | 4825 | CCCTGGCGTTGCAGGAATTCTT | 4854 |
| B1134M23-A1.x | | BACend | | GAATGGGGAGAAAGGGCAAAGG | 4855 | GCTCGTTAAGAGTTCCTTTGCC | 4884 |
| B0894M06-A1.x | | BACend | | TCTTTCATCTCCTAATGGGCAC | 4856 | TGGGTACATGCACTGTGCCCAT | 4885 |
| B0895J20-A1.x | | BACend | | ACAGACACCTTGGGTCATGACT | 4857 | GGAACTGGATGTAAAGTCATGA | 4886 |
| B0961F22-A1.y | | BACend | | CAGTGGTCCCTCTCTCATGAGT | 4858 | CTGCTTCTAGAACAACTCATGA | 4887 |
| B0668P23-A1.y | | BACend | | ACATGATGCACCCCTTACCGTT | 4859 | CCGTCTGTGTCCAGAACGGTAA | 4888 |
| B0588P16-A1.y | | BACend | | ACATGGGCTCACAGGAAGATCT | 4860 | CACGACTTAGGAGGAGATCTTC | 4889 |
| B1000B21-A1.y | | BACend | | AAGAGAAGTCGGAGACTGTGTC | 4861 | TAGCAAGTCTTATCGACACAGT | 4890 |
| B0839D11-A1.y | | BACend | | CCACTCAACCCACAATCTAGTC | 4862 | GAATACAGGGATGGGACTAGAT | 4891 |
| B1052D15-A1.y | | BACend | | CCACCAAATGGATCTGTTGACT | 4863 | ATCAGAGGTCTGTAAGTCAACA | 4892 |
| B1093F08-A1.y | | BACend | | AGGCCGGTTTCTTACTACAGAA | 4864 | TCGAAACAGCTGCCTTCTGTAG | 4893 |
| B1134M23-A1.y | | BACend | | ACAGAAAGGCCGTGGGTAGAGA | 4865 | TTCCTCCATTCACGTCTCTACC | 4894 |
| B0894M06-A1.y | | BACend | | CACATCGCTGCTTGACAGAACT | 4866 | GGGTCATGTGACTGAGTTCTGT | 4895 |
| B0895J20-A1.y | | BACend | | CACATTTCTGAGACACTTGCTA | 4867 | TAATACCTGGCATGTAGCAAGT | 4896 |
| B0604N13-A1.x | | BACend | | ATGAGTCTCTCCACCGAATGTG | 4868 | GAACCTCAGTCCTGCACATTCG | 4897 |
| B0714L01-A1.x | | BACend | | TCATCAGTTCTAGGAGCTTTCA | 4869 | GTAAGTACTCCTCCTGAAAGCT | 4898 |
| B0754A14-A1.x | | BACend | | GGATCGCACAGTCACTCTTCAT | 4870 | TGCAAGGCGATATGATGAAGAG | 4899 |
| B0894M06-A1.x | | BACend | | GATTAGTGTATGGTAGAGGACA | 4871 | TGGTGCAGGATTGTTGTCCTCT | 4900 |
| B1128L12-A1.x | | BACend | | TTGGTGTGAATCAAGCATCAGG | 4872 | TGAGCACAGGAGTTCCTGATGC | 4901 |
| B0643F18-A1.y | | BACend | | GTGGATTAAACCGAGGTGGAAT | 4873 | CCTTTCCAGTTTGAATTCCACC | 4902 |
| B0714L01-A1.y | | BACend | | GGCATTCTTGCTGCTGCTTCTG | 4874 | GAATACTGCAGAAGCAGAAGCA | 4903 |
| B0754A14-A1.y | | BACend | | ATCCTGGGCAAGGGAGTTTCAG | 4875 | CTGAGCCACACCTTCTGAAACT | 4904 |
| B0894M06-A1.y | | BACend | | TTGTTCACATCGCTGCTTGACA | 4876 | ATGTGACTGAGTTCTGTCAAGC | 4905 |
| B1128L12-A1.y | | BACend | | GCTTGAACTGCACTCAGCAGGA | 4877 | GTGCTTCTAACTTCTCCTGCTG | 4906 |
| B0687F10-A1.x | | BACend | | TCTCTCAAGCCACTTTCTATGT | 4878 | ACGTGAATCACGGAACATAGAA | 4907 |
| B0791C09-A1.x | | BACend | | ACTGTGGCTGCACATAGGGATA | 4879 | AAAGCTTCCTGGGGTATCCCTA | 4908 |
| B0820N16-A1.x | | BACend | | GGACCCACCCTGTCAATTTCAT | 4880 | GGGGCGATGGGAATATGAAATT | 4909 |
| B0880M22-A1.x | | BACend | | TGTTTGGATATGGTGGCTACTA | 4881 | TGTGTGTTTTGAGTTAGTAGCC | 4910 |
| B1008L21-A1.x | | BACend | | ATCTCTGGGAAGCTCTACAGTG | 4882 | CTCAAATCCCCTCCCACTGTAG | 4911 |
| B1043N20-A1.x | | BACend | | AGATAATGGGTTGCTTGGGCTC | 4883 | GTTAAAGCAGTTATGAGCCCAA | 4912 |
| B0700H07-A2.x | | BACend | | CTTGGACTCAAGACATCCTCTG | 4913 | TGGGAGACTGAGACCAGAGGAT | 4942 |

TABLE 2-continued

PRIMER PAIRS

| Marker name | Locus | DNA type | Gene | Forward primer | Seq ID NO: | Reverse primer | Seq ID NO: |
|---|---|---|---|---|---|---|---|
| B0687F10-A1.y | | BACend | | TTTCAGTGACTGCTCTTCCGTT | 4914 | TGGCTGTAAGTGAAAACGGAAG | 4943 |
| B0791C09-A1.y | | BACend | | CATTAGAAGCCCAGGAGGAAAC | 4915 | CTCCTTCTTCCCGAGTTTCCTC | 4944 |
| B0880M22-A1.y | | BACend | | CTATGTTGCATAGGAGTAGTGA | 4916 | AAGGATACCCTCTCTCACTACT | 4945 |
| B0909E24-A1.y | | BACend | | CCCTCTATAACATTTTCTCCCA | 4917 | CTTAGGACAACCCCTGGGAGAA | 4946 |
| B1008L21-A1.y | | BACend | | GAGCCCTGCTCAGAATTTCATG | 4918 | GAGGCAAGGTCTTTCATGAAAT | 4947 |
| B0923H14-A1.y | | BACend | | GCAGCCTTACTGAGCTGACAGT | 4919 | CCGTCCATGGGAACACTGTCAG | 4948 |
| B0979G13-A1.y | | BACend | | CTCCACCTGGATGGGTCAACTT | 4920 | ATTAAGTTCCTTGAAAGTTGAC | 4949 |
| B1020H18-A1.y | | BACend | | CATGATCTCAATAATTGCAACT | 4921 | GAAGAAAACAGGAGAGTTGCAA | 4950 |
| B0756E08-A1.y | | BACend | | ATGGGTATCACTATGCATAGCA | 4922 | TTTAAAATTCCACTTGCTATGC | 4951 |
| B0666F01-A1.y | | BACend | | GTGTCCTGGTGAACGGCTCTGA | 4923 | AATCAGAGTTTCCTTCAGAGCC | 4952 |
| B0883G19-A1.y | | BACend | | ACATTCCCAGCTCTACATTCTA | 4924 | CTGAGTTTCCTCACTAGAATGT | 4953 |
| B0923H14-A1.x | | BACend | | GATTAAGAGAGGGTAGGAGGGT | 4925 | ACCTTCCAACCATCACCCTCCT | 4954 |
| B0781I18-A1.x | | BACend | | GGATTAATAGTACCACCCCCTG | 4926 | ATTTAACACAAAGGCAGGGGGT | 4955 |
| B0979G13-A1.x | | BACend | | GACATTCCATGCAAATGGACAC | 4927 | CCCGCTTGCTTTTGGTGTCCAT | 4956 |
| B1020H18-A1.x | | BACend | | CATATGGCTAAGGCTCTATCTA | 4928 | AATCAGCAGGTACATAGATAGA | 4957 |
| B1029H23-A1.x | | BACend | | CAGCTAGGGGAAGAGTGACAGG | 4929 | CGAAATGCCGACTGCCTGTCAC | 4958 |
| B1076C21-A1.x | | BACend | | CTAGAATTTCCATGTAGTAAGA | 4930 | ATACTTGCTCTTTCTCTTACTA | 4959 |
| B1104N09-A1.x | | BACend | | CCTGCCTGATGAGCAAAGAATA | 4931 | CACTGGGTACTTCTTATTCTTT | 4960 |
| B0663J16-A1.x | | BACend | | CAACCAACTATCTGCTGCCTTC | 4932 | TAGGTGAGTCTCTTGAAGGCAG | 4961 |
| B0656F13-A1.x | | BACend | | GGTGTGGAGAGAGTGGACTCTA | 4933 | TAATATAAAATCCTTAGAGTCC | 4962 |
| B0883G19-A1.x | | BACend | | CATGGCACAGGTGATAGAGTGA | 4934 | ATAATCCAGGAAGATCACTCTA | 4963 |
| B0760A04-A2.x | | BACend | | GCTCTCATGATTTGGGCATGCT | 4935 | GTTCAAATCTTGCAAGCATGCC | 4964 |
| B0785D22-A1.x | | BACend | | GTGAACAGGCTAACACTGTTAA | 4936 | ATGCGTGCTGGTGTTTAACAGT | 4965 |
| B0723P10-A1.y | | BACend | | TGGAAGCCACTTAGAGGTTGCA | 4937 | AACAGTTTGGTACATGCAACCT | 4966 |
| B1095L07-A1.x | | BACend | | TCTAAAGATGGGGCCTCACAGT | 4938 | ATGGCTTCAGTTTTACTGTGAG | 4967 |
| B0997I04-A1.x | | BACend | | TACTTTACTCTGTTTCCTGTAT | 4939 | AAGTGATATGAGACATACAGGA | 4968 |
| B0723P10-A1.x | | BACend | | AGGAAAGGGAAATAGAAGGGAA | 4940 | TATCTGCGTGGTGGTTCCCTTC | 4969 |
| B0997I04-A1.y | | BACend | | AGTGTTAGTGGGAATGAGGAGT | 4941 | CTCCATTATCAGTCACTCCTCA | 4970 |
| B0880L16-A2.x | | BACend | | GAAACCCACATCAGCACAAAGG | 4971 | TTTGTGCTGGCTGGCCTTTGTG | 5000 |
| B0598O21-A2.x | | BACend | | CGCCGAATTCCATGACTCTTGA | 4972 | TTTGGCAGAATGTTTCAAGAGT | 5001 |
| B0768I12-A2.x | | BACend | | CACAAAGACAGACCCACAGCTC | 4973 | GCTGTGGGAAATGTGAGCTGTG | 5002 |
| B1056C02-A2.x | | BACend | | CCACACAGGAAAACTGCCATCT | 4974 | CCAATTCTCCTTTCAGATGGCA | 5003 |
| B1056C02-A2.y | | BACend | | GAGACGTGAGTCAGGACAGGTG | 4975 | TGCCCAATCTGTACCACCTGTC | 5004 |
| sts-AA017225 | | EST | | GATGCCAGGAAGTACCTGGTAA | 4976 | GCAATCTCCAATCCTTACCAGG | 5005 |
| A004F14 | | EST | | GGAAACCCGTGACTTGACTTAG | 4977 | TGTCATCAGCACCCCTAAGTCA | 5006 |
| SGC31333 | | EST | | AGGTGGTGATCTAGTCTCCGGT | 4978 | GAGTGAAAGGTGGAACCGGAGA | 5007 |
| WI-12422 | | EST | | AACCAGACAGCATCTCTGGAGAGA | 4979 | CACAGAGAGTGCATTTTCTCTCCA | 5008 |

TABLE 2-continued

PRIMER PAIRS

| Marker name | Locus | DNA type | Gene | Forward primer | Seq ID NO: | Reverse primer | Seq ID NO: |
|---|---|---|---|---|---|---|---|
| stSG21539 | | EST | | ATGCATACAGCAGGCCATTGTG | 4980 | CAGCCCCTATGACCACAATGG | 5009 |
| WI-13120 | | EST | | GGGAGCTACAGGTGATAGCTAT | 4981 | GGGCGCATAGCTATCACCTGTA | 5010 |
| stSG22703 | | EST | | CACCAGAGACCAGAGACTCGAA | 4982 | ACCATGGACAGGCCTTCGAGTC | 5011 |
| stSG36097 | | EST | | TGAGCAGTCTGACCTGCTTCTC | 4983 | AGCTGGAGCACCTGGAGAAGCA | 5012 |
| stSG9807 | | EST | | CAGCCAGCTACTGAACCTTATG | 4984 | TGGCCCTAGGCACACATAAGGT | 5013 |
| stSG15434 | | EST | | TACCACCACCCTGCGCAGATGG | 4985 | GTANTCTGTGGCCGCCATCTGC | 5014 |
| stSG30525 | | EST | | GGCACACAGTCTGCAATGCTTG | 4986 | TAGGGGACATCCCTCAAGCATT | 5015 |
| A007A34 | | EST | | TGTTCTGGCAGATTCCATCATC | 4987 | CTTATGTTGGGATTGATGATGG | 5016 |
| A006D44 | | EST | | CAGGGTCATTCGAGGAGGAACA | 4988 | CGAAAGCTTGAATCTGTTCCTC | 5017 |
| SGC30248 | | EST | | GATGCAAGCAGCACAGAGCAGT | 4989 | CTCCTTCCCACAGCACTGCTCT | 5018 |
| sts-N20163 | | EST | | TCTCTACCAGGCAATACTTCAC | 4990 | CTGAAATCGAGTGAGTGAAGTA | 5019 |
| Cda0af01 | | EST | | AAAGGCCACACAGCCCACAATC | 4991 | GGCCTGCAGTGGATGATTGTGG | 5020 |
| Cda0ca07 | | EST | | AAGTCTGACTTCAAATCGGTAC | 4992 | TGTCTAAGCCTCATGTACCGAT | 5021 |
| stSG3292 | | EST | | AAGTCTGACTTCAAATCGGTAC | 4993 | TGTCTAAGCCTCATGTACCGAT | 5022 |
| SGC34088 | | EST | | AAGTCAATTGCTCCCCATCTGC | 4994 | CTTGTTCGTTGCTGGCAGATGG | 5023 |
| WI-12272 | | EST | | GACTCATATGACAGACCTTGAA | 4995 | TGTCCCACCTTTCCTTCAAGGT | 5024 |
| stSG16387 | | EST | | CATGACTCCCAGACCCCTTAGA | 4996 | TGCCCAAATTCCTGTCTAAGGG | 5025 |
| SGC31722 | | EST | | CAAACGGAGAAGCCCCAGATAC | 4997 | TTGTTACTGTACGTGTATCTGG | 5026 |
| WI-15018 | | EST | | AGTGACAATTAGAGCTCTGGGG | 4998 | GCTCCTTCATTCTCCCCCAGAG | 5027 |
| WI-18492 | | EST | | TGCTTGGCCAAACAGACTTCCT | 4999 | TGATGAGACTGCAGAGGAAGTC | 5028 |
| stSG9546 | | EST | | ACCTGAGAGCAGGGAGATTCCA | 5029 | TAACTCCTAGCAGCTGGAATCT | 5058 |
| A006O16 | | EST | | CCCGAGGCTTCTCTGAACACTA | 5030 | CTCACAGCGCTTTCTAGTGTTC | 5059 |
| H64839 | | EST | | AATCTGAGGCACACAGGAGAGT | 5031 | ACTGAGCTCCTTTCACTCTCCT | 5060 |
| stSG3357 | | EST | | GCCTTGCTAACTGTACCATAGT | 5032 | CACCTGCAGGAATAACTATGGT | 5061 |
| stSG30906 | | EST | | TCTAAGGTTCCGGATGGACGTG | 5033 | TGTCCCGCCAAATTCACGTCCA | 5062 |
| stSG26056 | | EST | | GAGTTACAGGAAGTGGTTCCCC | 5034 | CTGCGTGTCTGTCAGGGGAACC | 5063 |
| SGC30786 | | EST | | ACAGCTCTCCTTCCTTAATGCC | 5035 | CACCCTTATCTCTGGGCATTAA | 5064 |
| sts-N59820 | | EST | | AGACTGCATCCTTCGAACAACAGG | 5036 | ACTGGGAAATCTAGCGCCTGTTGT | 5065 |
| stSG42115 | | EST | | TTCTCGAGGGTTCTCTGCTTCACT | 5037 | AGTTCTCTCGGGAGTTAGTGAAGC | 5066 |
| FB9F8 | | EST | | GAAAACCCGCACCCTGACACAAC | 5038 | CGTCCAGAAAACGTAGGTTGTGTC | 5067 |
| AA252357 | | EST | | CAGCACATCGAGTCCTCAAATCCG | 5039 | CCAGACTTTCCTCACTCGGATTTG | 5068 |
| stSG4720 | | EST | | TCGAGAAAGGCTGTTCCTACAAGG | 5040 | TAACCTCAGGACCTTCCCTTGTAG | 5069 |
| sts-AA001424 | | EST | | AAGCTGCTCTTCTCAGCTACTCTG | 5041 | TTTCAGGGTTCTGGGTCAGAGTAG | 5070 |
| stSG31443 | | EST | | CAAAGCACTGGACTGAGAGAATTC | 5042 | GGTGGATACAGTGTGTGAATTCTC | 5071 |
| WI-6385 | D12S1405 | EST | | TAAAGGCAAAGGCCACACAGCCCA | 5043 | CTGCAGTGGATGATTGTGGGCTGT | 5072 |
| A008Y05 | | EST | | TAAAGATAAGGCGTGGGCTTTGAC | 5044 | AACTCTGGCAGACACTGTCAAAGC | 5073 |
| R50113 | | EST | | TCATACCAAGTGCTGGCTGCTAAG | 5045 | CCAGTTTCTCCACATCCTTAGCAG | 5074 |

TABLE 2-continued

PRIMER PAIRS

| Marker name | Locus | DNA type | Gene | Forward primer | Seq ID NO: | Reverse primer | Seq ID NO: |
|---|---|---|---|---|---|---|---|
| sts-H94865 | | EST | | CTCTAAGAACCAGACCCTCAGTTG | 5046 | CTCATTCCCTTACTGGCAACTGAG | 5075 |
| A006R19 | | EST | | GGTTTGAACAGTGGGAGATACCAG | 5047 | TTTTCTCCTCCCACCTCTGGTATC | 5076 |
| SGC34278 | | EST | | CAAACACAAGAGGTCCTCTTGCTG | 5048 | ACAGTCCATGGAAAGGCAGCAAGA | 5077 |
| A004B47 | | EST | | GTGCCCTGTGAAATTGGCCTTTCT | 5049 | GCTGGAAGCAGAAAGAAGAAAGGC | 5078 |
| stSG40199 | | EST | | GGAAGGCTGTCTTCTTTCTACCAC | 5050 | TGACACCTGCCTCATGGTGGTAGA | 5079 |
| stSG8935 | | EST | | CAAACACAAGAGGTCCTCTTGCTG | 5051 | ACAGTCCATGGAAAGGCAGCAAGA | 5080 |
| stSG4731 | | EST | | GCATGTGTTGTTTCGTCTGGGAT | 5052 | AGCAGACAAGATCTAGATCCCAGA | 5081 |
| stSG8142 | | EST | | GTGCCCTGTGAAATTGGCCTTTCT | 5053 | GCTGGAAGCAGAAAGAAGAAAGGC | 5082 |
| A005X42 | | EST | | GCATGTGTTGTTTCGTCTGGGAT | 5054 | AGCAGACAAGATCTAGATCCCAGA | 5083 |
| CDA18G06 | D12S1205 | EST | | ACAGACTACAACGTCAATGAAGCC | 5055 | TCCGACAATGCCAGGAGGCTTCAT | 5084 |
| STSG40222 | | EST | | TCTTCTCTCTCACTGCAGACCATG | 5056 | TGCCCACATGGAGAAACATGGTCT | 5085 |
| sts-R55615 | | EST | | GCTAGTGGAACGGATACCTGAAAG | 5057 | CTTCCTGTGGTAGTGTCTTTCAGG | 5086 |
| sts-R02295 | | EST | | CTCAATCCACATGACAACGCTTTG | 5087 | ACCTAGTATCCTACCTCAAAGCGT | 5114 |
| sts-R81342 | | EST | | GGCAAAAGGGAAAAACCATGTATG | 5088 | TCACTTCCCTTACAGTCATACATG | 5115 |
| sts-H65839 | | EST | | AATAGATTGATTGCCGTCCTCAAC | 5089 | AAGTATGTGCTAACTTGTTGAGGA | 5116 |
| stSG52716 | | EST | | AGATGGGGAGACAAACGGTAAAC | 5090 | CGGAAAGGAAACATCTGTTTACCG | 5117 |
| stSG54813 | | EST | highly similar to 22 kd peroxisomal membrane protein | TTTGTTGGTCAGCTGGTCCAACCA | 5091 | TGCAGTAATGGATGGGTGGTTGGA | 5118 |
| stSG50504 | | EST | | CCGTATTACCCAGACTACACACTG | 5092 | CACCAATGGCATAGCACAGTGTGT | 5119 |
| stSG48386 | | EST | | CCAGCAGCAGGATATTGTGTACGT | 5093 | GTTTACAGCCTACAGGACGTACAC | 5120 |
| stSG54842 | | EST | | TTCTTCTTCAGGTCCCGCTCAAAG | 5094 | TCACGGCCTACGAGATCTTTGAGC | 5121 |
| stSG53600 | | EST | Highly similar to peptide transporter PTR2 | AACTGGGATGCCAACTAACACGTG | 5095 | AAGTCTTGGGGAACTCCACGTGTT | 5122 |
| stSG53541 | | EST | Homo sapiens hiwi mRNA, partial cds | AACCCCACCTATGGTTGTAGTGAG | 5096 | GGCGTAAAGTAGGATGCTCACTAC | 5123 |
| stSG53307 | | EST | | GAGGCTAGGCTGAATATAACCAGG | 5097 | CACTGCCAGTCAGCAACCTGGTTA | 5124 |
| stSG63473 | | EST | | CCACTGGCTGCATTTTCCAGCTTT | 5098 | CACCAGGTACTAGAGAAAAGCTGG | 5125 |
| stSG54325 | | EST | | CGGCACAAGCAGATTTCAGATCAG | 5099 | CTGGGGGAAATGCTGACTGATCTG | 5126 |
| stSG52343 | | EST | | AACTGGAGTCAGGTGATCACGAAG | 5100 | CCAGTGAAATAAGCCCCTTCGTGA | 5127 |
| WIAF-856 | | EST | | AAGTCAATTGCTCCCCATCTGCCA | 5101 | TCTACTTGTTCGTTGCTGGCAGAT | 5128 |
| stSG47723 | | EST | | CTGAGTTCCTTAGCAGCTTCCGTA | 5102 | TCTTCAAAGGACCTCCTACGGAAG | 5129 |
| stSG60065 | | EST | | GGAGGTGAATAAGCTGATCCTGCA | 5103 | GCTGGGTAACTAGAAGTGCAGGAT | 5130 |
| stSG46424 | | EST | | GGACACATCTGTTCCATCTTCACC | 5104 | CCCATGAGTTGTTAGTGGTGAAGA | 5131 |
| sts-U79526 | | Gene | DEZ | TGATCCTCACTGTGGAACCCCT | 5105 | GAGAGAGTCCATTGAGGGGTTC | 5132 |
| SGC31491 | | Gene | NOS1 | AGAGCGGCTCTTTTAATGAGGG | 5106 | GGGAGACGTCGCAACCCTCATT | 5133 |
| stSG1936 | | Gene | CLA-1 | TCAGTCCATAGGATGATGTCAG | 5107 | TCCTCCAGCCTAAACTGACATC | 5134 |

TABLE 2-continued

PRIMER PAIRS

| Marker name | Locus | DNA type | Gene | Forward primer | Seq ID NO: | Reverse primer | Seq ID NO: |
|---|---|---|---|---|---|---|---|
| sts-W31616 | | Gene | UBA52 | CCCAGCAAAGATCAACCTCTGC | 5108 | ATCCCTCCTGATCAGCAGAGGT | 5135 |
| ZNF10 | | Gene | KOX 1 | ATGTGGGAAGGCCTTTGGTAGT | 5109 | GTAAGGTTTGAGCCACTACCAA | 5136 |
| ZNF26 | | Gene | KOX20 | GTGAATGTGGAAAAGCCTTCAC | 5110 | GAGATGACTTCTGAGTGAAGGC | 5137 |
| WI-6921 | | Gene | RNP24 | GTTGCAAGTGTTCTCACCCAAG | 5111 | AACCATACTTCCACCTTGGGTG | 5138 |
| sts-D60472 | | Gene | SMRT | GAACGACGTGTGTAAATGACAG | 5112 | AGGGTGGTGGTATTCTGTCATT | 5139 |
| WI-16177 | | Gene | RAN | CCTTCAGGCATCCCACAGATGA | 5113 | CGGAACATGTGCCTTCATCTGT | 5140 |
| stSG1702 | | Gene | CAGH32 | TCAGGCACCAAATCTGAACAAGGG | 5141 | GAAGGTTGGATCCAAGCCCTTGTT | 5170 |
| IB2452 | | Gene | ULK1 | GCCATCAAGGTGATGAGGAAGAAG | 5142 | AAGAAAATCCCCGTGACTTCTTCC | 5171 |
| stSG39493 | | Gene | CAGH32 | GTGCTGAATCTCTTGCGTGACATG | 5143 | TAGTGAACCTTGGGACCATGTCAC | 5172 |
| A002A44 | | Gene | CAGH32 | TGGTTCTCTGCTTCACTGGCAGAA | 5144 | GGATAAGCTTGTGTGGTTCTGCCA | 5173 |
| stSG27206 | | Gene | GCP170 | GAGCACATCTGGCCTGGCCAGT | 5145 | TGAGGTTCTGAGTCACTGGCCA | 5174 |
| CDA1JF08 | | Gene | GCP170 | AGTGAGCTCAGAACACCTCACACC | 5146 | AGTTGAGTGACGCTGTGGTGTGAG | 5175 |
| R39599 | | Gene | GCP170 | ACTTCTGCAGTCATCGAGAAGTCC | 5147 | CCCACAAAAGATCCCAGGACTTCT | 5176 |
| stSG31494 | | Gene | ZNF140 | TCTCCAGTATGAGTCCTCTGGTGT | 5148 | GCTTTTCCCTGGTGTTACACCAGA | 5177 |
| TH_a | | Gene | MUC8 | ATCCACCGCTAGAAACCCACTC | 5149 | GACCATCAACTGATGAGTGGGT | 5178 |
| SGC31491_a | | Gene | NOS1 | CCTAGTAGCTTTCCTCCCAAAG | 5150 | ATTGGAAAGAAAGCCTTTGGGA | 5179 |
| sts-X89576 | | Gene | MMP17 | AGAGGAGCTGTCTAAGGCCATC | 5151 | TGCTGCATGGCTGTGATGGCCT | 5180 |
| stSG43910 | | Gene | SFRS8 | cagtacatgtttacccacagac | 5152 | tgcacataagtcgacagacacc | 5181 |
| P699K7/T7 | D12S2479 | Genomic | | AGAAAGCCTCTCTTCCCCTCTCTC | 5153 | GTCACATTTTTGGGGTGAGAGAGG | 5182 |
| P493P14/T7 | D12S2451 | Genomic | | TCTCAGGAACCAGAGTCCATAG | 5154 | CAGTTAGATAAAAGCTATGGAC | 5183 |
| P313C9/SP6 | D12S2447 | Genomic | | CAGCTCAGGAAGTTCACCAGGC | 5155 | AGGACCCAGTTGAAGCCTGGTG | 5184 |
| WI-5824 | D12S2002 | Genomic | | CATTTACCTGCCCGCCTGGTCA | 5156 | CAGGATTTGTGTGGTGACCAGG | 5185 |
| WI-10803 | D12S1944 | Genomic | | CTGGATTTCCAGAGACTGACCT | 5157 | TCAGGCAATAGAGAAGGTCAGT | 5186 |
| WI-2002 | D12S1084 | Genomic | | ACAACAGAAGTTGTCAGTGAAG | 5158 | CTGTTCAACAGTGCCTTCACTG | 5187 |
| WI-3045 | d12S1420 | Genomic | | CTTAAGCGAGCAACCTGATAACCC | 5159 | TCCTAATCTGGCAGGTGGGTTATC | 5188 |
| WI-3549 | D12S1998 | Genomic | | GAGAATCAGCTGCCATGTTGTGAG | 5160 | GGACTCTTTGAGCATCCTCACAAC | 5189 |
| WI-6077 | D12S1322 | Genomic | | AGCAGCACTAGGCATGGCTGTT | 5161 | ATAAGAGCTGAGATAACAGCCA | 5190 |
| SHGC-12243 | D12S1845 | Genomic | | CAAGCTTCCCTCCTTTCCCATTGT | 5162 | TTCCGGCGTTGTAGTTACAATGGG | 5191 |
| SHGC-13782 | D12S1851 | Genomic | | AGTCAGGTACAGGGTTCTGACAAC | 5163 | CACCTTGTTCGTCTCTGTTGTCAG | 5192 |
| SHGC-14238_a | D12S1853 | Genomic | | CAAGTGTCCCACTTTTCCTGCA | 5164 | CCGCTCACTCACTCTGCAGGAA | 5193 |
| WI-3549_a | D12S1998 | Genomic | | CCATGTTGTGAGGATGCTCAAA | 5165 | ACCTTTTAGGACTCTTTGAGCA | 5194 |
| AFMb337xc1 | D12S1675 | MSAT | | GATCTGCAGCATTGAGGGAGCA | 5166 | GTCTCTAGGCACATTGCTCCCT | 5195 |
| AFMa197zd9 | D12S1609 | MSAT | | GGGGATTAGTAGNTCAATGTA | 5167 | GTCATCGGGTGACATACATTGA | 5196 |
| AFMb350zb5 | D12S1679 | MSAT | | GTTTGTAGGCTTCTTGCCTCTG | 5168 | CCCTCTACCATTCACAGAGGCA | 5197 |
| UT7009 | D12S834 | MSAT | | GTCCAAGAGTGGGCAGTTGACC | 5169 | ATTGGATAGGCATAGGTCAACT | 5198 |
| AFMb301we5 | D12S1659 | MSAT | | TCTAACTTTCGTTTGCCTGCTT | 5199 | CACTGTGCTTTCAGAAGCAGGC | 5214 |
| AFMa064xg9 | D12S1714 | MSAT | | GTTCGAGATCCACAGGTGTCTA | 5200 | TGTAGCATATGATGTAGACACC | 5215 |

TABLE 2-continued

PRIMER PAIRS

| Marker name | Locus | DNA type | Gene | Forward primer | Seq ID NO: | Reverse primer | Seq ID NO: |
|---|---|---|---|---|---|---|---|
| CHLC.ATA19A06 | D22S2069 | MSAT | | TGTTGCCTAGGCTGGTCTTGAA | 5201 | CTTGAGTCCAAGAGTTCAAGAC | 5216 |
| ATA29A06 | D12S1045 | MSAT | | GACCAGCCTAGGCACATAGTGA | 5202 | TTAGAGATGGGGTCTCACTATG | 5217 |
| AFM210zd6 | D12S97 | MSAT | | AATTGTCTCCATGGGGCTCGAA | 5203 | CCTTCACTGAGGAGTTCGAGCC | 5218 |
| AFM295ye9 | D12S343 | MSAT | | TACTGCCACTCTCCAGAATATC | 5204 | GATCTGGAAGGTCGGATATTCT | 5219 |
| 509/510 | D12S63 | MSAT | | GTGGTTGGGTTAACAAAGAATG | 5205 | GAGAAGCTGCAACGCATTCTTT | 5220 |
| AFMa275xb9 | D12S1628 | MSAT | | AAGGTAGAGCTTGGCAACAGGA | 5206 | AGCCCCGCTGGACCTCCTGTTG | 5221 |
| AFMb002vd5 | D12S1638 | MSAT | | TGCCAGGAGTTTTAAGTTGGTT | 5207 | GAATGGCATTTGGTAACCAACT | 5222 |
| GATA13D05 | D12S392 | MSAT | | GTATGGATAGCAGACGATAGAG | 5208 | TCTATCTGTCATCCCTCTATCG | 5223 |
| 12QTEL82 | D12S2342 | MSAT | | TACATTCCACCAGCAGTGCACAAG | 5209 | TGGAGAAATTGGAAGCCTTGTGCA | 5224 |
| 12QTEL87 | D12S2343 | MSAT | | TTGTTAGGCTTCTGGGTTGGGTAC | 5210 | ACAGGCATTAGCCCCTGTACCCAA | 5225 |
| AFMa082ze9_a | D12S1723 | MSAT | | CTTCCGTCATGAATGTCAGTAG | 5211 | TCTGCAGTGGTTCCCTACTGAC | 5226 |
| AFM156xc5_a | D12S1599 | MSAT | | TGGGAAGAGTTGCCTCCAGGAA | 5212 | CCCTTCTCAGTCCTTTCCTGGA | 5227 |
| AFMa123xe1 | D12S367 | MSAT | | CTGTATTAAATGAGTCTGGGTT | 5213 | GGGTTAATACAGTTAACCCAGA | 5228 |

3 Radiation Hybrid (RH) Mapping: Radiation hybrid mapping was performed against the Genebridge4 panel (Gyapay et al., 1996, *Hum. Mol. Genet.* 5:339-46) purchased from Research Genetics. Mapping was performed in order to refine the chromosomal localization of genetic markers used in genotyping as well as to identify, confirm, and refine localizations of markers from proprietary sequences. Standard PCR procedures were used for typing the RH panel with markers of interest.

Briefly, 10 μl PCR reactions contained 25 ng DNA of each of the 93 Genebridge4 RH samples. PCR products were electrophoresed on 2% agarose gels (Sigma) containing 0.5 μg/ml ethidium bromide in 1×TBE at 150 volts for 45 min. Model A3-1 electrophoresis systems were used (Owl Scientific Products, Portsmouth, N.H.). Typically, gels contained 10 tiers of lanes with 50 wells/tier. Molecular weight markers (100 bp ladder, GibcoBRL, Rockville, Md.) were loaded at both ends of the gel.

Images of the gels were captured with a Kodak DC40 CCD camera and processed with Kodak 1D software (Eastman Kodak Comp.; Rochester, N.Y.). The gel data were exported as tab delimited text files. The names of the files included information about the panel screened, the gel image files, and the marker screened. These data were automatically imported using a customized Perl script into Filemaker databases for data storage and analysis. The data were then automatically formatted and submitted to an internal server for linkage analysis to create a radiation hybrid map using RHMAPPER (L. Stein et al., 1995; available from Whitehead Institute/MIT Center for Genome Research)

4. BAC Library Screening: The protocol used for BAC library screening was based on the "overgo" method, originally developed by John McPherson at Washington University in St. Louis (http://www.tree.caltech.edu/protocols/overgo.html, and W-W. Cai et al., 1998, *Genomics* 54:387-397). This method involved filling in the overhangs generated after annealing two primers. Each primer was 22 nucleotides in length, and overlapped by 8 nucleotides. The resulting labeled product (36 bp) was then used in hybridization-based screening of high density grids derived from the RPCI-11 BAC library (dejong, supra). Typically, 15 probes were pooled together to hybridize 12 filters (13.5 genome equivalents).

Stock solutions (2 μM) of combined complementary oligos were heated at 80° C. for 5 min, placed at 37° C. for 10 min, and then stored on ice. Labeling reactions included the following: 1.0 μl H$_2$O; 5 μl mixed oligos (2 μM each); 0.5 μl BSA (2 mg/ml); 2 μl OLB (-A, -C, -N6) Solution (see below); 0.5 μl $^{32}$P-dATP (3000 Ci/mmol); 0.5 μl $^{32}$P-dCTP (3000 Ci/mmol); and 0.5 μl Klenow fragment (5 U/μl). The reaction was incubated at RT for 1 hr, and unincorporated nucleotides were removed using Sephadex G50 spin columns. Solution 0:1.25 M Tris-HCl, pH 8, and 125 M MgCl$_2$; Solution A: 1 ml Solution O, 18 μl 2-mercaptoethanol, 5 μl 0.1M dTTP, and 5 μl 0.1 M dGTP; Solution B: 2 M HEPES-NaOH, pH 6.6; Solution C: 3 mM Tris-HCl, pH 7.4, and 0.2 mM EDTA; Solutions A, B, and C were combined to a final ratio of 1:2.5:1.5, and aliquots were stored at −20° C.

High-density BAC library membranes were pre-wetted in 2×SSC at 58° C. Filters were then drained slightly and placed in hybridization solution (1% BSA; 1 mM EDTA, pH 8.0; 7% SDS; and 0.5 M sodium phosphate), pre-warmed to 58° C., and incubated at 58° C. for 2-4 hr. Typically, 6 filters were hybridized in each container. Ten milliliters of pre-hybridization solution was removed, combined with the denatured overgo probes, and added back to the filters. Hybridization was performed overnight at 58° C. The hybridization solution was removed and filters were washed once in 2×SSC, 0.1% SDS, followed by a 30 min wash in the same solution at 58° C. Filters were then washed in: 1) 1.5×SSC and 0.1% SDS at 58° C. for 30 min; 2) 0.5×SSC and 0.1% SDS at 58° C. for 30 min; and in 3) 0.1×SSC and 0.1% SDS at 58° C. for 30 min. Filters were then wrapped in Saran Wrap®, and exposed to film overnight. To remove bound probe, filters were treated in 0.1×SSC and 0.1% SDS pre-warmed to 95° C., and then cooled to RT. Clone addresses were determined in accordance with instructions supplied by RPCI.

To recover clonal BAC cultures from the library, a sample from the appropriate library well was plated by streaking onto LB agar (T. Maniatis et al., 1982, *Molecular Cloning: A Laboratory Manual*, Cold Spring Harbor Laboratory, Cold Spring Harbor, N.Y.) containing 12.5 µg/ml chloramphenicol (Sigma), and plates were incubated overnight. A single colony and a portion of the initial streak quadrant were inoculated into in each well of a 96-well plate containing 400 µl LB plus chloramphenicol. Cultures were grown overnight at 37° C. For storage, 100 µl of 80% glycerol was added to each well, and the plates were placed at −80° C.

To determine the marker content of clones, aliquots of the 96-well plate cultures were transferred to the surface of nylon filters (GeneScreen Plus, NEN) placed on LB/chloramphenicol petri plates. Colonies were grown overnight at 37° C. and colony lysis was performed by placing filters on pools of: 1) 10% SDS for 3 min; 2) 0.5 N NaOH and 1.5 M NaCl for 5 min; and 3) 0.5 M Tris-HCl, pH 7.5, and 1 M NaCl for 5 min. Filters were then air-dried and washed free of debris in 2×SSC for 1 hr. The filters were air-dried for at least 1 hr, and DNA was crosslinked linked to the membrane using standard conditions. Probe hybridization and filter washing were performed as described above for the primary library screening. Confirmed clones were stored in LB containing 15% glycerol.

In certain cases, polymerase chain reaction (PCR) was used to confirm the marker content of clones. PCR conditions for each primer pair were optimized with respect to $MgCl_2$ concentration. The standard buffer contained 10 mM Tris-HCl (pH 8.3), 50 mM KCl, $MgCl_2$, 0.2 mM each dNTP, 0.2 µM each primer, 2.7 ng/µl human DNA, 0.25 U AmpliTaq (Perkin Elmer) and $MgCl_2$ concentrations of 1.0 mM, 1.5 mM, 2.0 mM or 2.4 mM. Cycling conditions included an initial denaturation at 94° C. for 2 min; 40 cycles at 94° C. for 15 sec, 55° C. for 25 sec, and 72° C. for 25 sec; and a final extension at 72° C. for 3 min. Depending on the results, the conditions were further optimized as required. For further optimization, the annealing temperature was increased to 58° C. or 60° C., the cycle number was increased to 42, the annealing and extension times were increased to 30 sec, and/or AmpliTaqGold was used (Perkin Elmer).

5. BAC DNA Preparation: Several different types of DNA preparation methods were used to isolate BAC DNA. The manual alkaline lysis miniprep protocol listed below (Maniatis et al., 1982) was successfully used for most applications, i.e., restriction mapping, CHEF gel analysis, and FISH mapping, but this protocol was not reproducibly successful for endsequencing. The Autogen protocol described below was used to isolate BAC DNA for endsequencing.

For manual alkaline lysis BAC minipreps, bacteria were grown in 15 ml terrific broth (TB) containing 12.5 µg/ml chloramphenicol. Cultures were placed in a 50 ml conical tube at 37° C. for 20 hr with shaking at 300 rpm. Cultures were centrifuged in a Sorvall RT 6000 D at 3000 rpm (1800× g) at 4° C. for 15 min. The supernatant was aspirated as completely as possible. In some cases, cell pellets were frozen at −20° C. at this step for up to 2 weeks. The pellet was then vortexed to homogenize the cells and minimize clumping. Following this, 250 µl of P1 solution (50 mM glucose, 15 mM Tris-HCl, pH 8, 10 mM EDTA, and 100 µg/ml RNase A) was added. The mixture was pipetted up and down to mix. The mixture was then transferred to a 2 ml Eppendorf tube. Subsequently, 350 µl of P2 solution (0.2 N NaOH, 1% SDS) was added, mixed gently, and the mixture was incubated for 5 min at RT. Then, 350 µl of P3 solution (3 M KOAc, pH 5.5) was added and mixed gently until a white precipitate formed. The solution was incubated on ice for 5 min, and then centrifuged at 4° C. in a microfuge for 10 min.

The supernatant was transferred carefully (avoiding the white precipitate) to a fresh 2 ml Eppendorf tube, and 0.9 ml of isopropanol was added. The solution was mixed and left on ice for 5 min. The samples were centrifuged for 10 min, and the supernatant was carefully removed. Pellets were washed in 70% ethanol and air-dried for 5 min. Pellets were then resuspended in 200 µl of TE8 (10 mM Tris-HCl, pH 8.0, 1.0 mM EDTA, pH 8.0), and RNase (Boehringer Mannheim; Germany) added to 100 µg/ml. Samples were incubated at 37° C. for 30 min, then precipitated by addition of $NH_4OAc$ to 0.5 M and 2 volumes of ethanol. Samples were then centrifuged for 10 min, and the pellets were washed with 70% ethanol. The pellets were air-dried and dissolved in 50 µl TE8. Typical yields for this DNA prep were 3-5 µg per 15 ml bacterial culture. Ten to 15 µl of DNA was used for EcoRI restriction analysis; 5 µl was used for NotI digestion and clone insert sizing by CHEF gel electrophoresis.

Autogen 740 BAC DNA preparations were made by dispensing 3 ml of LB media containing 12.5 µg/ml of chloramphenicol into autoclaved Autogen tubes. A single tube was used for each clone. For inoculation, glycerol stocks were removed from −70° C. storage and placed on dry ice. A small portion of the glycerol stock was removed from the original tube with a sterile toothpick and transferred into the Autogen tube. The toothpick was left in the Autogen tube for at least 2 min before discarding. After inoculation the tubes were covered with tape to ensure that the seal was tight. When all samples were inoculated, the tubes were transferred into an Autogen rack holder and placed into a rotary shaker. Cultures were incubated at 37° C. for 16-17 hr at 250 rpm.

Following this, standard conditions for BAC DNA preparation, as defined by the manufacturer, were used to program the Autogen. However, samples were not dissolved in TE8 as part of the program. Instead, DNA pellets were left dry. When the program was completed, the tubes were removed from the output tray and 30 µl of sterile distilled and deionized $H_2O$ was added directly to the bottom of the tube. The tubes were then gently shaken for 2-5 sec and then covered with parafilm and incubated at RT for 1-3 hr. DNA samples were then transferred to an Eppendorf tube and used either directly for sequencing or stored at 4° C. for later use.

6. BAC Clone Characterization: DNA samples prepared either by manual alkaline lysis or the Autogen protocol were digested with EcoRI for analysis of restriction fragment sizes. These data were used to compare the extent of overlap among clones. Typically 1-2 µg DNA was used for each reaction. Reaction mixtures included: 1× Buffer 2 (NEB); 0.1 mg/ml BSA (NEB); 50 µg/ml RNase A (Boehringer-Mannheim); and 20 U EcoRI (NEB) in a final volume of 25 µl. Digestions were incubated at 37° C. for 4-6 hr. BAC DNA was also digested with NotI for estimation of insert size by CHEF gel analysis (see below). Reaction conditions were identical to those for the EcoRI digestion, except that 20 U NotI were used. Six microliters of 6× Ficoll loading buffer containing bromphenol blue and xylene cyanol was added prior to electrophoresis.

EcoRI digests were analyzed on 0.6% agarose gels (Seakem, FMC Bioproducts, Rockland, Me.) in 1×TBE containing 0.5 µg/ml ethidium bromide. Gels (20 cm×25 cm) were electrophoresed in a Model A4 electrophoresis unit (Owl Scientific) at 50 volts for 20-24 hr. Molecular weight size markers included undigested lambda DNA, HindIII digested lambda DNA, and HaeIII digested X174 DNA. Molecular weight markers were heated at 65° C. for 2 min prior to loading the gel. Images were captured with a Kodak DC40 CCD camera and analyzed with Kodak 1D software.

NotI digests were analyzed on a CHEF DRII (Bio-Rad) electrophoresis unit according to the manufacturer's recommendations. Briefly, 1% agarose gels (Bio-Rad pulsed field grade) were prepared in 0.5×TBE, equilibrated for 30 min in the electrophoresis unit at 14° C., and electrophoresed at 6 volts/cm for 14 hr with circulation. Switching times were ramped from 10 sec to 20 sec. Gels were stained after electrophoresis in 0.5 µg/ml ethidium bromide. Molecular weight markers included undigested lambda DNA, HindIII digested lambda DNA, lambda ladder PFG ladder, and low range PFG marker (all from NEB).

7. BAC Endsequencing: The sequence of BAC insert ends utilized DNA prepared by either of the two methods described above. The ends of BAC clones were sequenced for the purpose of filling gaps in the physical map and for gene discovery information. The following vector primers specific to the BAC vector pBACe3.6 were used to generate endsequence from BAC clones: pBAC 5'-2 (TGT AGG ACT ATA TTG CTC; SEQ ID NO: 5229) and pBAC 3'-1 (CGA CAT TTA GGT GAC ACT; SEQ ID NO: 5230).

The ABI dye-terminator sequencing protocol was used to set up sequencing reactions for 96 clones. The BigDye (ABI; PE Applied Biosystems) Terminator Ready Reaction Mix with AmpliTaq" FS, Part number 4303151, was used for sequencing with fluorescently labeled dideoxy nucleotides. A master sequencing mix was prepared for each primer reaction set, and included: 1600 µl of BigDye terminator mix (ABI; PE Applied Biosystems); 800 µl of 5×CSA buffer (ABI; PE Applied Biosystems); and 800 µl of primer (either pBAC 5'-2 or pBAC 3'-1 at 3.2 µM). The sequencing cocktail was vortexed to ensure it was well-mixed and 32 µl was aliquoted into each PCR tube. Eight microliters of the Autogen DNA for each clone was transferred from the DNA source plate to a corresponding well of the PCR plate. The PCR plates were sealed tightly and centrifuged briefly to collect all the reagents. Cycling conditions were as follows: 1) 95° C. for 5 min; 2) 95° C. for 30 sec; 3) 50° C. for 20 sec; 4) 65° C. for 4 min; 5) steps 2 through 4 were repeated 74 times; and 6) samples were stored at 4° C.

At the end of the sequencing reaction, the plates were removed from the thermocycler and centrifuged briefly. Centri•Sep 96 plates were then used according to manufacturer's recommendations to remove unincorporated nucleotides, salts, and excess primers. Each sample was resuspended in 1.5 µl of loading dye, and 1.3 µl of the mixture was loaded onto ABI 377 Fluorescent Sequencers. The resulting end sequences were then used to develop markers to rescreen the BAC library and fill sequence gaps. The end sequences were also analyzed by BLASTN to identify EST or gene content. The BAC end sequences correspond to SEQ ID NO:156 to SEQ ID NO:693, disclosed herein.

Example 5

Subcloning and Sequencing of BACs from 12q23-qter

The physical map of the chromosome 12 region provided a set of BAC clones for use as sequencing templates (see FIGS. 5A-5I). BAC DNA was isolated according by a QIAGEN purification (QIAGEN, Inc., Valencia, Calif., per manufacturer's instructions) or a manual purification. The manual purification method was a modification of the standard alkaline lysis/cesium chloride preparation for plasmid DNA (see e.g., F. M. Ausubel et al., 1997, *Current Protocols in Molecular Biology*, John Wiley & Sons, New York, N.Y.).

Briefly, for manual purification, cells were pelleted, and resuspended in GTE (50 mM glucose, 25 mM Tris-Cl (pH 8), and 10 mM EDTA) and lysozyme (50 mg/ml solution). This was followed by addition of NaOH/SDS (1% SDS and 0.2N NaOH) and then an ice-cold solution of 3M KOAc (pH 4.5-4.8). RnaseA was added to the filtered supernatant, followed by Proteinase K and 20% SDS. The DNA was precipitated with isopropanol, and then dried, and resuspended in TE (10 mM Tris, 1 mM EDTA (pH 8.0)). The BAC DNA was further purified by cesium chloride density-gradient centrifugation (Ausubel et al., 1997). Following isolation, the BAC DNA was hydrodynamically sheared using HPLC (Hengen et al., 1997, *Trends in Biochem. Sci.*, 22:273-274) to an insert size of 2000-3000 bp. After shearing, the DNA was concentrated and separated on a standard 1% agarose gel. A single fraction, corresponding to the approximate size, was excised from the gel and purified by electroelution (Sambrook et al., 1989).

The purified DNA fragments were then blunt-ended using T4 DNA polymerase. The blunt-ended DNA was then ligated to unique BstXI-linker adapters (5' GTCTTCACCACGGGG (SEQ ID NO: 5231) and 5' GTGGTGAAGAC (SEQ ID NO: 5232) in 100-1000 fold molar excess. These adapters were complimentary to the BstXI-cut pMPX vector, whereas the BstXI-cut vector was not self-complimentary. Therefore, the adapters would not concatemerize, and the cut vector would not ligate to itself. The linker-adapted inserts were separated from unincorporated linkers on a 1% agarose gel and purified using GeneClean (BIO 101, Inc., Vista, Calif.). The linker-adapted insert was then ligated to a modified pBlueScript vector to construct a "shotgun" subclone library. The vector contained an out-of-frame lacZ gene at the cloning site, which became in-frame in the event that an adapter-dimer was cloned. Such adapter-dimer clones gave rise to blue colonies, which were avoided.

Sequencing was performed using ABI377 automated DNA sequencing methods. Major modifications to the protocols are highlighted as follows. Briefly, the library was transformed into DH5-competent cells (GibcoBRL, DH5-transformation protocol). Transformed cells were plated onto antibiotic plates containing ampicillin and IPTG/X-gal. The plates were incubated overnight at 37° C. White colonies were identified, and plated to obtain individual clones for sequencing. Cultures were grown overnight at 37° C. DNA was purified using a silica bead DNA preparation method (Ng et al., 1996, *Nucl. Acids Res.*, 24:5045-5047). In this manner, 25 µg of DNA was obtained per clone.

Purified DNA samples were sequenced using ABI dye-terminator chemistry. The ABI dye terminator sequence reads were run on ABI377 machines, and the data were directly transferred to UNIX machines following lane tracking of the gels. All reads were assembled using PHRAP (P. Green, *Abstracts of DOE Human Genome Program Contractor-Grantee Workshop V*, January 1996, p. 157) with default parameters and quality scores. Each BAC was sequenced for ~3× coverage. SEQ ID NOs for assembled contigs are shown in Table 3A, below.

TABLE 3A

| BAC SEQUENCES | |
|---|---|
| Genomic Sequence | SEQ ID NO: Range |
| RP11-666B20 | 719-765 |
| RP11-702C13 | 766-808 |

TABLE 3A-continued

BAC SEQUENCES

| Genomic Sequence | SEQ ID NO: Range |
|---|---|
| RP11-723P10 | 809-869 |
| RP11-831E18 | 870-899 |
| RP11-899A17 | 900-927 |
| RP11-932D22 | 928-978 |

Additional BAC sequences (GenBank (www.ncbi.nlm.nih.gov)) were also investigated as potentially containing gene or gene(s) involved in asthma and related diseases thereof.

TABLE 3B

BAC SEQUENCES

| Genomic Sequence | SEQ ID NO: |
|---|---|
| AC003982 | 694 |
| AC011216 | 695 |
| AC023437 | 696 |
| AC024021 | 697 |
| AC024642 | 698 |
| AC025641 | 699 |
| AC025837 | 700 |
| AC026331 | 701 |
| AC026333 | 702 |
| AC026336 | 703 |
| AC026764 | 705 |
| AC026869 | 704 |
| AC048337 | 706 |
| AC063926 | 707 |
| AC069209 | 708 |
| AC073527 | 709 |
| AC073862 | 710 |
| AC073912 | 711 |
| AC073930 | 712 |
| AC078925 | 713 |
| AC078926 | 714 |
| AC079031 | 715 |
| AC079602 | 716 |
| AC090147 | 717 |
| AC090565 | 718 |
| Z98941 | 979 |

Example 6

Gene Identification

1. Gene Identification from clustered DNA fragments. DNA sequences corresponding to gene fragments in public databases (GenBank and human dbEST) and proprietary cDNA sequences (IMAGE consortium and direct selected cDNAs) were masked for repetitive sequences and clustered using the PANGEA Systems EST clustering tool (DoubleTwist, Oakland, Calif.). The clustered sequences were then subjected to computational analysis to identify regions bearing similarity to known genes. This protocol included the following steps:

a. The clustered sequences were compared to the publicly available UniGene database (NCBI) using the BLASTN2 algorithm (Altschul et al., 1997). The parameters for this search were: E=0.05, v=50, B=50, where E was the expected probability score cutoff, V was the number of database entries returned in the reporting of the results, and B was the number of sequence alignments returned in the reporting of the results (Altschul et al., 1990).

b. The clustered sequences were compared to the GenBank database (NCBI) using BLASTN2 (Altschul et al., 1997). The parameters for this search were E=0.05, V=50, B=50, where E, V, and B were defined as above.

c. The clustered sequences were translated into protein sequences for all six reading frames, and the protein sequences were compared to a non-redundant protein database compiled from GenPept, SWISSPROT, and PIR (NCBI). The parameters for this search were E=0.05, V=50, B=50, where E, V, and B were defined as above.

d. The clustered sequences were compared to BAC sequences (see below) using BLASTN2 (Altschul et al., 1997). The parameters for this search were E=0.05, V=50, B=50, where E, V, and B were defined as above.

2. Gene Identification from BAC Genomic Sequence: Following assembly of the BAC sequences into contigs, the contigs were subjected to computational analyses to identify coding regions and regions bearing DNA sequence similarity to known genes. This protocol included the following steps:

a. Contigs were degapped. The contig sequences contained symbols that represented locations where the individual ABI sequence reads had insertions or deletions (denoted by periods). Prior to automated computational analysis of the contigs, the periods were removed. The original contig sequences were held for future reference.

b. BAC vector sequences were masked within the sequence by using the program CROSSMATCH (P. Green, University of Washington; Seattle, Wash.). Shotgun library construction (detailed above) left BAC vector sequences in the shotgun libraries. The CROSSMATCH program was used to compare the sequence of the BAC contigs to the BAC vector and to mask any vector sequence prior to subsequent steps. Masked sequences were marked by "Xs" in the sequence files, and were omitted during subsequent analyses.

c. *E. coli* sequences contaminating the BAC sequences were masked by comparing the BAC contigs to the entire *E. coli* genome.

d. Repetitive elements known to be common in the human genome were masked using CROSSMATCH (P. Green, University of Washington). In this implementation of CROSSMATCH, the BAC sequence was compared to a database of human repetitive elements (J. Jerka, Genetic Information Research Institute, Palo Alto, Calif.). The masked repeats were marked by "Xs" in the sequence files, and were omitted during subsequent analyses.

e. The location of exons within the sequence was predicted using the MZEF computer program (Zhang, 1997, *Proc. Natl. Acad. Sci.*, 94:565-568) and GenScan gene prediction program (Burge and Karlin, *J. Mol. Biol.*, 268:78-94).

f. The sequence was compared to the publicly available UniGene database (NCBI) using the BLASTN2 algorithm (Altschul et al., 1997). The parameters for this search were: E=0.05, V=50, B=50, where E was the expected probability score cutoff, V was the number of database entries returned in the reporting of the results, and B was the number of sequence alignments returned in the reporting of the results (Altschul et al., 1990).

g. The nucleotide sequence was translated into amino acid sequences for all six reading frames, and the amino acid sequences were compared to a non-redundant protein database compiled from GenPept, SWISSPROT, and PIR(NCBI). The parameters for this search were E=0.05, V=50, B=50, where E, V, and B were defined as above.

h. The BAC DNA sequence was compared to a database of clustered sequences using the BLASTN2 algorithm (Altschul et al., 1997). The parameters for this search were E=0.05, V=50, B=50, where E, V, and B were defined as above. The database of clustered sequences was prepared utilizing a proprietary clustering technology (PANGEA Systems, Inc.). The clustering program compiled cDNA clones derived from direct selection experiments (described below), human dbEST sequences mapping to the 12q23-ter region, proprietary cDNAs, GenBank genes, and IMAGE consortium cDNA clones.

i. The BAC sequence was compared to the BAC end sequences from the 12q23-ter region using the BLASTN2 algorithm (Altschul et al., 1997). The parameters for this search were E=0.05, V=50, B=50, where E, V, and B were defined as above.

j. The BAC sequence was compared to the GenBank database (NCBI) using the BLASTN2 algorithm (Altschul et al., 1997). The parameters for this search were E=0.05, V=50, B=50, where E, V, and B were defined as above.

k. The BAC sequence was compared to the STS division of GenBank database (NCBI) using the BLASTN2 algorithm (Altschul et al., 1997). The parameters for this search were E=0.05, V=50, B=50, where E, V, and B were defined as above.

l. The BAC sequence was compared to the Expressed Sequence Tag (EST) GenBank database (NCBI) using the BLASTN2 algorithm (Altschul et al., 1997). The parameters for this search were E=0.05, V=50, B=50, where E, V, and B were defined as above.

m. The exon prediction programs MZEF (Zhang, 1997, *Proc. Natl. Acad. Sci. USA* 94:565-568) and GenScan (Burge and Karlin, *J. Mol. Biol.,* 268:78-94) were also utilized to help identify the exons.

The results of BLAST searches of protein and nucleotide databases are summarized in Table 4. Column 1 lists the gene names, and column 2 lists the types of sequences (i.e., Gene, Express Sequence Tag (EST), etc.). Columns 3 and 4 list the SEQ ID NOs for the nucleotide and amino acid sequences, respectively. Column 5 lists the GenBank accession numbers. Column 6 lists the descriptions of the genes or ESTs relating to potential functions. Using this information, one of ordinary skill in the art is able to appreciate the roles of these genes and their relation to the disorders described herein. The seventh column lists the genetic markers, and the eighth column lists the corresponding BAC clones. The SEQ ID NOs corresponding to the BAC clones are shown in Tables 3A and 3B, above. It should be noted that 12q23-qter alternate splice variants are referred to herein using both short (e.g., 561.1, 561.2, etc.; see Table 4, column 1) and long (e.g., 561.nt1, 561.nt2; see Example 14) nomenclature.

TABLE 4

IDENTIFIED GENES

| Gene Number | Gene Type | SEQ ID NO: (NT) | SEQ ID NO: (AA) | GenBank Accession # | Description | Marker | Genomic Seq |
|---|---|---|---|---|---|---|---|
| 214.1 | Gene | 1 | 93 | U14383 | MUC8, Mucin 8 | TH | RP11-702C13, AC079031 |
| 214.2 | Gene | 2 | 94 | U14383 | MUC8, Mucin 8 | TH | RP11-702C13, AC079031 |
| 214.3 | Gene | 3 | 95 | U14383 | MUC8, Mucin 8 | TH | RP11-702C13, AC079031 |
| 214.4 | Gene | 4 | 96 | U14383 | MUC8, Mucin 8 | TH | RP11-702C13, AC079031 |
| 214.5 | Gene | 5 | 97 | U14383 | MUC8, Mucin 8 | TH | RP11-702C13, AC079031 |
| 215.1 | Gene | 6 | 98 | NM_004072 | CMKLR1, Chemokine-like receptor 1 | sts-U79526 | |
| 224.1 | Gene | 7 | 99 | U17327 | NOS1, Nitric oxide synthase 1, Neuronal | RK903904 | |
| 266.1 | Gene | 8 | 100 | L07395 | PPP1CC, Protein phosphatase 1, catalytic subunit, gamma isoform | SHGC11024 | |
| 283.1 | Gene | 9 | 101 | AF055581 | Lnk, Lymphocyte adaptor protein | SGC35065 | |
| 292.1 | Gene | 10 | 102 | AF032437 | MAPKAPK5, Mitogen activated protein kinase activated protein kinase gene | SGC34324 | |
| 298.1 | Gene | 11 | 103 | D13540 | PTPn11, Protein-tyrosine phosphatase 2C | WI-7628 | |
| 321.1 | Gene | 12 | 104 | AB007447 | Fin29, TRAF interacting Zn finger protein | A002Y44 | |
| 399.1 | Gene | 13 | 105 | U14588 | PXN Paxillin gamma | sts-AA002185 | |
| 399.2 | Gene | 14 | 106 | U14588 | PXN Paxillin gamma | sts-AA002185 | |
| 399.3 | Gene | 15 | 107 | U14588 | PXN Paxillin gamma | sts-AA002185 | |
| 422.1 | Gene | 16 | 108 | M21054 | PLA2, phospholipase A2, group IB | PLA2G1B | AC003982, AC078926, AC073930 |
| 436.1 | Gene | 17 | 109 | AF191093 | P2RX4, P2X4, P2x purinoreceptor, Ligand gated ion channel | sts-Y07684 | AC069209, AC048337, AC011216, AC024642 |
| 436.2 | Gene | 18 | 110 | AF191093 | P2RX4, P2X4, P2x purinoreceptor, Ligand gated ion channel | sts-Y07684 | AC069209, AC048337, AC011216, AC024642 |
| 454.1 | Gene | 19 | 111 | Y09561 | P2X7, ATP ligand gated cationic channel | stSG36007 | Z98941, AC011216, AC069209, AC024642 |
| 515.1 | Gene | 20 | 112 | NM_006018 | HM74, Probable G protein-coupled receptors | WI-7227 | |
| 536.1 | EST | 21 | 113 | | | A004O46 | |
| 543.1 | Gene | 22 | 114 | AB009010.1 | UBC, ubiquitin C | Bda03b10 | |
| 548.1 | Gene | 23 | 115 | Z22555.1 | CLA-1, CD36 antigen (collagen type I receptor, thrombospondin receptor)-like | stSG1936 | |
| 549.1 | EST | 24 | | AA017225 | | sts-AA017225 | |
| 550.1 | EST | 25 | 116 | A004F14 | | A004F14 | |
| 550.2 | EST | 26 | 1176 | A004F14 | | A004F14 | |

TABLE 4-continued

IDENTIFIED GENES

| Gene Number | Gene Type | SEQ ID NO: (NT) | SEQ ID NO: (AA) | GenBank Accession # | Description | Marker | Genomic Seq |
|---|---|---|---|---|---|---|---|
| 551.1 | EST | 27 | 1187 | H92073 | | SGC31333 | |
| 553.1 | EST | 28 | | R41805 | | WI-12422 | |
| 555.1 | EST | 29 | | N50054 | | stSG21539 | |
| 559.1 | Gene | 30 | 119 | X52351 | Kox20, zinc finger protein | ZNF26 | |
| 561.1 | EST | 31 | 6161 | AB002316.1 | RIMBP2 | WI-13120 | AC063926, AC025837, AC090147, AC090565, AC024021, RP11-831E18 |
| 561.2 | EST | 32 | 120 | AB002316.1 | RIMBP2 | WI-13120 | AC063926, AC025837, AC090147, AC090565, AC024021, RP11-831E18 |
| 562.1 | EST | 33 | | T50448 | | stSG22703 | |
| 566.1 | Gene | 34 | 122 | AF113003.1 | SMRT, Silencing mediator of retinoid and thyroid hormone action | stSG15434 | |
| 567.1 | EST | 35 | | AA167552 | | stSG30525 | |
| 570.1 | EST | 36 | 123 | H30072 | Highly similar to Peptide transporter PTR2, [*Saccharomyces cerevisiae*] | SGC30248 | AC023437, RP11-666B20 |
| 570.2 | EST | 37 | 124 | H30072 | Highly similar to Peptide transporter PTR2, [*Saccharomyces cerevisiae*] | SGC30248 | AC023437, RP11-666B20 |
| 571.1 | EST | 38 | | N20163 | | sts-N20163 | |
| 572.1 | EST | 39 | | AF052172 | | Cda0af01 | |
| 575.1 | EST | 40 | 125 | R24284 | | SGC34088 | |
| 577.1 | Gene | 41 | 126 | J05158 | CPN, Carboxypeptidase N | stSG16387 | |
| 579.1 | EST | 42 | | H20731 | | WI-15018 | |
| 581.1 | Gene | 43 | | H23544 | RAN, TC4, Ras-like protein | WI-16177 | AC073912, RP11-899A17 |
| 581.2 | Gene | 44 | | H23544 | RAN, TC4, Ras-like protein | WI-16177 | AC073912, RP11-899A17 |
| 583.1 | EST | 45 | 127 | A006O16 | | A006O16 | |
| 584.1 | EST | 46 | | H64839 | | H64839 | |
| 586.1 | EST | 47 | | AA180186 | | stSG30906 | |
| 587.1 | EST | 48 | | T50225 | | stSG26056 | |
| 589.1 | Gene | 49 | 128 | AA025934 | CAGH32 | stSG1702 | |
| 590.1 | EST | 50 | | N59820 | | sts-N59820 | |
| 592.1 | Gene | 51 | 129 | AF045458.1 | ULK1, *Homo sapiens* serine/threonine kinase | IB2452 | |
| 594.1 | EST | 52 | 130 | AA252357 | | AA252357 | |
| 595.1 | Gene | 53 | 131 | AF116238.1 | PUS1, pseudouridine synthase 1 | stSG4720 | |
| 596.1 | EST | 54 | 132 | AA001424 | | sts-AA001424 | |
| 601.1 | EST | 55 | | R50113 | | R50113 | |
| 603.1 | EST | 56 | | H94865 | | sts-H94865 | |
| 604.1 | EST | 57 | | A006R19 | | A006R19 | |
| 605.1 | EST | 58 | 133 | N23648 | similar to ZN91_HUMAN ZINC FINGER PROTEIN 91 | SGC34278 | |
| 605.2 | EST | 59 | | N23648 | similar to ZN91_HUMAN ZINC FINGER PROTEIN 92 | SGC34278 | |
| 606.1 | EST | 60 | 134 | A004B47 | Similar to DNA Polymerase epsilon, catalytic subunit | A004B47 | |
| 608.1 | EST | 61 | 135 | AB014592 | | stSG40199 | |
| 611.1 | EST | 62 | 136 | A005Q05 | | A005Q05 | |
| 615.1 | Gene | 63 | 137 | D63997 | GCP170, Golgi membrane protein | CDA1JF08 | |
| 617.1 | Gene | 64 | 138 | U09368 | ZNF140 | stSG31494 | |
| 618.1 | EST | 65 | 139 | R44594 | ZNF84 | stSG40222 | |
| 621.1 | EST | 66 | 140 | R81342 | ZNF10 | sts-R81342 | |
| 622.1 | EST | 67 | | H65839 | | sts-H65839 | |
| 690.1 | EST | 68 | 141 | AA812723 | | stSG60065 | |
| 692.1 | EST | 69 | | R24284 | similar to reverse transcriptase homolog [*H. sapiens*] | WI-AF856 | |
| 693.1 | EST | 70 | 142 | AA678190 | | stSG52343 | |
| 694.1 | EST | 71 | | AA897697 | | stSG54325 | |
| 695.1 | EST | 72 | | AA705809 | | stSG63473 | |
| 697.1 | EST | 73 | | AA889526 | | stSG53307 | |
| 698.1 | GENE | 74 | 143 | AF104260.1 | hiwi | stSG53541 | AC025837, RP11-831E18, AC090147, AC090565 |
| 699.1 | GENE | 75 | 144 | N49217 | SFRS8, Splicing factor, arginine/serine-rich 8, (suppressor-of-white-apricot *Drosophila* homolog) | stSG43910 | |
| 702.1 | GENE | 76 | 145 | X89576 | MMP17, matrix metalloproteinase 17 (membrane-inserted) | stsX89576 | RP11-932D22, RP11-723P10 |
| 705.1 | EST | 77 | 146 | AA846540 | | stSG54842 | |
| 707.1 | EST | 78 | 147 | AA223499 | | stSG48386 | |
| 707.2 | EST | 79 | 148 | AA223499 | | stSG48386 | |

TABLE 4-continued

IDENTIFIED GENES

| Gene Number | Gene Type | SEQ ID NO: (NT) | SEQ ID NO: (AA) | GenBank Accession # | Description | Marker | Genomic Seq |
|---|---|---|---|---|---|---|---|
| 722.1 | GENE | 80 | 149 | D14582 | EPIM, Epimorphin-isoform, Syntaxin family | B0700A09-A2.x | AC073912, RP11-899A17 |
| 722.2 | GENE | 81 | | D14582 | EPIM, Epimorphin-isoform, Syntaxin family | B0700A09-A2.x | AC073912, RP11-899A17 |
| 748.1 | EST | 82 | | AA625844 | | | AC025641, AC079602, Z98941 |
| 749.1 | EST | 83 | | AA969066 | | | |
| 751.1 | EST | 84 | 150 | AL162032 | Similar to latrophilin-3 | | AC073527, AC078925, AC073862 |
| 752.1 | EST | 85 | | AI184706 | | | |
| 753.1 | EST | 86 | | AL039191 | | | |
| 754.1 | EST | 87 | | AI240327 | | | |
| 755.1 | EST | 88 | 151 | AB031230 | PCCX2 mRNA for protein containing CXXC domain 2 | | |
| 756.1 | EST | 89 | 152 | AB028999 | | | |
| 757.1 | Gene | 90 | 153 | AB027464 | FZD10, Frizzled 10 | | AC026336, AC026869, AC026764 |
| 835.1 | EST | 91 | 154 | AL136697 | CABP1, Calcium binding protein 1 (calbrain) | | |
| 848.1 | EST | 92 | 155 | AA214469 | | | AC026336, AC026869, AC026764 |

Example 7 cDNA Cloning

1. Construction and screening of cDNA libraries: Directionally cloned cDNA libraries from normal lung and bronchial epithelium were constructed using standard methods (Soares et al., 1994, *Automated DNA Sequencing and Analysis*, Adams et al. (eds), Academic Press, NY, pp. 110-114). Total and cytoplasmic RNAs were extracted from tissue or cells by homogenizing the sample in the presence of guanidinium thiocyanate-phenol-chloroform extraction buffer (e.g., Chomczynski and Sacchi, 1987, *Anal. Biochem.* 162: 156-159) using a polytron homogenizer (Brinkman Instruments, Inc.; Westbury, N.Y.). Poly (A)+ RNA was isolated from total/cytoplasmic RNA using dynabeads-dt according to the manufacturer's recommendations (Dynal Biotech; Norway). The double stranded cDNA was then ligated into the plasmid vector pBluescript II KS+ (Stratagene; La Jolla, Calif.), and the ligation mixture was transformed into *E. coli* host DH10B or DH12S by electroporation (Soares, 1994). Following overnight growth at 37° C., DNA was recovered from the *E. coli* colonies after scraping the plates as directed for the Mega-prep kit (QIAGEN). The quality of the cDNA libraries was estimated by counting a portion of the total number of primary transformants, determining the average insert size, and calculating the percentage of plasmids without cDNA insert. Additional cDNA libraries (human total brain, heart, kidney, leukocyte, and fetal brain) were purchased from Life Technologies (Bethesda, Md.).

cDNA libraries, both oligo (dT) and random hexamer-primed, were used to isolate cDNA clones mapped within the disorder critical region. Four 10×10 arrays of each of the cDNA libraries were prepared as follows. The cDNA libraries were titered to $2.5 \times 10^6$ using primary transformants. The appropriate volume of frozen stock was used to inoculate 2 L of LB/ampicillin (100 µg/µl). Four hundred aliquots containing 4 ml of the inoculated liquid culture were generated. Each tube contained about 5000 cfu (colony forming units). The tubes were incubated at 30° C. overnight with shaking until an OD of 0.7-0.9 was obtained. Frozen stocks were prepared for each of the cultures by aliquotting 300 µl of culture and 100 µl of 80% glycerol. Stocks were frozen in a dry ice/ethanol bath and stored at −70° C. DNA was isolated from the remaining culture using the QIAGEN spin mini-prep kit according to the manufacturer's instructions. The DNAs from the 400 cultures were pooled to make 80 column and row pools. Markers were designed to amplify putative exons from candidate genes. Once a standard PCR condition was identified and specific cDNA libraries were determined to contain cDNA clones of interest, the markers were used to screen the arrayed library. Positive addresses indicating the presence of cDNA clones were confirmed by a second PCR using the same markers.

Once a cDNA library was identified as likely to contain cDNA clones corresponding to a transcript of interest from the disorder critical region, it was used to isolate a clone or clones containing cDNA inserts. This was accomplished by a modification of the standard "colony screening" method (Sambrook et al., 1989). Specifically, twenty 150 mm LB plus ampicillin agar plates were spread with 20,000 cfu of cDNA library. Colonies were allowed to grow overnight at 37° C. Colonies were then transferred to nylon filters (Hybond from Amersham-Pharmacia, or equivalent) and duplicates prepared by pressing two filters together essentially as described (Sambrook et al., 1989). The "master" plate was then incubated an additional 6-8 hr to allow the colonies additional time to grow. The DNA from the bacterial colonies was then bound to the nylon filters by incubating the filters with denaturing solution (0.5 N NaOH, 1.5 M NaCl) for 2 min, and neutralization solution (0.5 M Tris-Cl pH 8.0, 1.5 M NaCl) for 2 min (twice). The bacterial colonies were removed from the filters by washing in a solution of 2×SSC/2% SDS for 1 min while rubbing with tissue paper. The filters were air-dried and baked under vacuum at 80° C. for 1-2 hr to crosslink the DNA to the filters.

cDNA hybridization probes were prepared by random hexamer labeling (Fineberg and Vogelstein, 1983, *Anal. Biochem.* 132:6-13). For small fragments, probes were prepared using gene-specific primers and omitting random hexamers in the reaction. The colony membranes were pre-washed in 10 mM Tris-Cl pH 8.0, 1 M NaCl, 1 mM EDTA, and 0.1% SDS for 30 min at 55° C. Following the pre-wash, the filters were pre-hybridized in more than 2 ml/filter of 6×SSC, 50% deionized formamide, 2% SDS, 5×Denhardt's solution, and 100 mg/ml denatured salmon sperm DNA, at 42° C. for 30 min. The filters were then transferred to hybridization solution (6×SSC, 2% SDS, 5×Denhardt's, and 100 mg/ml denatured salmon sperm DNA) containing denatured $\alpha$-$^{32}$P-dCTP-labeled cDNA probe, and incubated overnight at 42° C.

The following morning, the filters were washed under constant agitation in 2×SSC/2% SDS at RT (room temperature) for 20 min, followed by two washes at 65° C. for 15 min each. A final wash was performed in 0.5×SSC/0.5% SDS for 15 min at 65° C. Filters were then wrapped in plastic wrap and exposed to radiographic film. Individual colonies on plates were aligned with the autoradiograph, and positive clones were inoculated into a 1 ml solution of LB Broth containing ampicillin. After shaking at 37° C. for 1-2 hr, aliquots of the solution were plated on 150 mm plates for secondary screening. Secondary screening was identical to primary screening (above), except that it was performed on plates containing ~250 colonies, so that individual colonies could be clearly identified. Positive cDNA clones were characterized by restriction endonuclease cleavage, PCR, and direct sequencing to confirm the sequence identity between the original probe and the isolated clone.

4. Gene Identification in region 12q23-qter by Direct cDNA Selection: Direct cDNA selection is a powerful technique for the identification of genes mapping to a particular genomic interval. It involves hybridizing genomic DNA (in this case, BACs) from a region of interest to pools of cDNAs derived from various tissue sources. The procedure permits the rapid isolation of cDNAs, and obviates the need for extensive screening of cDNA libraries. The tissues used in this study included unstimulated Th2 cells, Th2 cells stimulated with TPA, bronchial smooth muscle cells, unstimulated ThO cells, ThO stimulated with anti CD3 and TPA, pulmonary artery endothelium cells, lung microvascular endothelial cells, bronchial epithelium cells, normal and asthmatic lung, small airway epithelium cells, pulmonary artery smooth muscle cells, and lung fibroblasts. These cell types have been implicated in the pathophysiology of asthma and were expected to express genes involved in the asthmatic inflammatory response. In addition, RNA isolated from brain cells was used, because brain cells expresses a diverse array of genes.

Cytoplasmic RNA was isolated as described by Sambrook et al, 1989, *Molecular Cloning: A Laboratory Manual*, Cold Spring Harbor Laboratories, Cold Spring Harbor, N.Y. Approximately 400-600 µg of cytoplasmic RNA was isolated from 50 million cells. Total RNA was isolated from normal and asthmatic lung tissue using TRizol Reagents (GibcoBRL), which are ready-to-use monophasic solutions of guanadinium isothiocyanate and phenol (P. Chomczynski and N. Sacchi, 1987, *Anal. Biochem.* 162:156-159; P. Chomczynski et al., 1987, *J. NIH Res.* 6:83; D. Simms et al., 1993, *Focus* 15:99; P. Chomczynski, 1993, *BioTechniques* 15:532). Five hundred milligrams of frozen tissue was crushed into a fine powder using a Bessman tissue pulverizer (Fisher Scientific). The TRizol Reagents were mixed with the crushed tissue according to the manufacturer's recommendations.

To ascertain whether there was genomic DNA or heteronuclear RNA contamination, PCR and RT/PCR were performed. PCR analysis was performed using primers (Research Genetics) that amplified STS markers from chromosomes 2 (D2S2358)7 (D7S2776 and D7S685), 10 (D10S228 and D10S1755), and 20 (D20S905 and D20S95).

All PCR reactions were performed in a final volume of 25 µl, containing 1 µl of RNA, 10 mM Tris-HCl (pH 8.3), 50 mM KCl, 1.5 mM MgCl$_2$, 0.001% gelatin, 200 mM each dNTPs, 10 µM of each primer, and 1 U Taq DNA polymerase (Perkin Elmer). A Perkin Elmer 9600 cycler was used for amplification as follows: 30 sec at 94° C., 30 sec at 55° C., and 30 sec at 72° C. for 30 cycles. RT/PCR analysis was performed using the SuperScript One-Step RT-PCR System (Gibco-BRL, Rockville, Md.) according to the manufacturer's recommendations. All PCR and RT/PCR products were evaluated by electrophoresis on a 1% agarose gel.

Poly (A)+ RNA was prepared from the total RNA isolated from the human primary cells and lung tissues using Dynabeads Oligo(dT) according to the manufacturer's recommendations (Dynal, Lake Success, N.Y.). Approximately 4 µg of messenger RNA was isolated from 150 µg of total RNA for each cell type and tissue source. Total RNA isolated from brain tissue was purchased from CLONTECH (Palo Alto, Calif.), and poly(A)+ RNA was prepared from this material using Dynabeads Oligo(dT), described above. Oligo dT and random primed cDNA pools were generated from the mRNA isolated from each cell type and tissue source. Briefly, 2.0 µg mRNA was mixed with oligo(dT) primer in one reaction. In another reaction, 2.0 µg mRNA was mixed with random hexamers, and converted to double stranded complementary DNA using the SuperScript Choice System for cDNA Synthesis (Gibco-BRL, Rockville, Md.) according to the manufacturer's recommendations.

Four different paired phosphorylated cDNA linkers (Table 5) were annealed by mixing a 1:1 ratio of the paired linkers (10 µg each), incubating the mixture at 65° C. for 5 min, and allowing the mixture to cool to RT for 30 min. The annealed linkers were ligated to the oligo(dT) and random-primed cDNA pools from various tissue and cell sources (Table 5) according to manufacturer's instructions (GibcoBRL). The linker sequence provided a tag to identify the RNA from the particular cell types.

TABLE 5

PAIRED LINKERS

| Paired linkers | Sequence | SEQ ID NO: | Cell/Tissue Type |
|---|---|---|---|
| OLIGO 3 | 5'CTC GAG AAT TCT GGA TCC TC3' | 5233 | Th2/unstimulated (dT + rp) |
| OLIGO 4 | 5'TTG AGG ATC CAG AAT TCT CGA G3' | 5234 | Th0/stimulated/ anti CD3 (dT + rp) Pulmonary artery endothelium cells (dT + rp) Lung microvascular Endothelial cells (dT + rp) Bronchial epithelium cells (dT + rp) |
| OLIGO 5 | 5'TGT ATG CGA ATT CGC TGC GCG3' | 5235 | Normal Lung (dT + rp) |
| OLIGO 6 | 5'TTC GCG CAG CGA ATT CGC ATA CA3' | 5236 | Athmatic lung (dT + rp) Th2/stimulated/ TPA (dT + rp) Bronchial smooth muscle cells (dT + rp) |
| OLIGO 9 | 5'CCT ACG GAA TTC TCA CTC AGC3' | 5237 | Brain (dT + rp) |

TABLE 5-continued

PAIRED LINKERS

| Paired linkers | Sequence | SEQ ID NO: | Cell/Tissue Type |
|---|---|---|---|
| OLIGO 10 | 5'TTG CTG AGT GAG AAT TCC GTA GG3' | 5238 | Th0/unstimulated (dT + rp) Pulmonary artery smooth muscle cells (dT + rp) |
| OLIGO 11 | 5'GAA TCC GAA TTC CTG GTC AGC3' | 5239 | Lung fibroblasts (dT + rp) |
| OLIGO 12 | 5'TTG CTG ACC AGG AAT TCG GAT TC3' | 5240 | Th0/stimulated/ TPA (dT + rp) Small airway epi- thelium cells (dT + rp) |

The cDNA pools were evaluated for length distribution by PCR amplification using 1 µl of a 1:1, 1:10, and 1:100 dilution of the ligation reaction. All PCR reactions were performed in a final volume of 25 µl, containing 1 µl of DNA, 10 mM Tris-HCl (pH 8.3), 50 mM KCl, 1.5 mM $MgCl_2$, 0.001% gelatin, 200 mM of each dNTP, 10 µM of each primer, and 1 U Taq DNA polymerase (Perkin Elmer). A Perkin Elmer 9600 cycler was used to for amplification as follows: 30 seconds at 94° C., 30 seconds at 55° C., and 2 minutes at 72° C. for 30 cycles. The length distribution of the amplified cDNA pools was evaluated by electrophoresis on a 1% agarose gel. The PCR reaction that gave the best representation of the random primed and oligo dT primed cDNA pools was scaled-up to yield ~2-3 µg of each cDNA pool. This represented a 1×PCR reaction for the starting cDNA pools.

Twenty BACs (Table 6) that spanned the 15 cM critical region between markers D12S1609 and D12S357 were pooled in equimolar amounts. One microgram of the isolated genomic DNA was labeled with biotin 16-UTP by nick translation in accordance with the manufacturers instructions (Boehringer-Mannheim). The incorporation of biotin was monitored by standard methods (Del Mastro and Lovett, 1996, *Methods in Molecular Biology*, Humana Press Inc., NJ).

TABLE 6

BACs SPANNING THE 15 cM REGION

0753B07
0666B20
0687F10
0820N16
0899A17
0716I10
0839D11
0894M06
0696L08
0979G13
0723P10
0932D22
0825K21
0866B05
0750I23
0831E18
0761L21
0702C13
0739N03
1064I09

Direct cDNA selection was performed using standard methods (Del Mastro and Lovett, 1996, Methods in Molecular Biology, Humana Press Inc., NJ). Briefly, 1 µg of each cDNA pool was placed into individual PCR tubes. A total of 30 direct selection experiments were arrayed onto a PCR plate. Suppression of high copy repeats, ribosomal RNA, and plasmid DNA in the cDNA pools was performed to a $Cot_{20}$. One hundred nanograms of biotinylated BAC DNA was mixed with the suppressed cDNAs, and hybridized in solution to a $Cot_{200}$. The biotinylated DNA and the cognate cDNAs were then captured on streptavidin-coated paramagnetic beads. The beads were washed and the primary selected cDNAs were eluted. The products from the first round of direct selection were PCR amplified using appropriate primers (shown in Table 5), and a second round of direct selection was performed.

GTP-Binding Nuclear Protein RAN (TC4, a gene that maps within the 7.6 cM critical region) was used to monitor the enrichment during the two rounds of direct selection. The enrichment of the TC4 was monitored in the starting, primary, and secondary selected material of the fifteen oligo dT and random primed cDNA pools. The random primed product of the second round of direct selection (the secondary selected material) from lung microvascular endothelial cells, Th0/unstimulated cells, lung fibroblast cells, Th2/unstimulated cells, pulmonary artery endothelium cells, normal lung, small airway epithelium cells, bronchial epithelium cells, Th0 cells stimulated with TPA, and oligo dT primed Th0 cells stimulated with TPA was PCR-amplified with modified primers (Table 7, below). These primers were used for two rounds of direct cDNA selection.

TABLE 7

MODIFIED OLIGONUCLEOTIDES

| Modified Oligonu- cleotides | SEQ ID NO | Sequence |
|---|---|---|
| OLIGO 3 | 5241 | 5' CUA CUA CUA CUA CTC GAG AAT TCT GGA TCC TC 3' |
| OLIGO 5 | 5242 | 5' CUA CUA CUACUATGT ATG CGA ATT CGC TGC GCG 3' |
| OLIGO 9 | 5243 | 5' CUA CUA CUA CUA CCT ACG GAA TTC TCA CTC AGC 3' |
| OLIGO 11 | 5244 | 5' CUA CUA CUA CUA GAA TCC GAA TTC CTG GTC AGC 3' |

The amplified material was cloned into the UDG vector pAMP10 (GibcoBRL) in accordance with the manufacturers recommendations. Four hundred and eighty clones were picked from each transformed source and arrayed into five 96-well microtiter plate. Each selected cDNA library was stamped, in duplicate, in high density format onto Hybond N+ nylon membrane (Amersham). The bacteria were grown overnight at 37° C., and the membranes were processed as recommended by the manufacturer.

To identify which of the clones represented common contaminants (e.g., high copy repeats and ribosomal RNA), a radiolabeled probe containing 1 µg of $Cot_1$ DNA and 0.5 µg ribosomal DNA was hybridized at 65° C. to the high density filters (Sambrook et al, 1989, *Molecular Cloning: A Laboratory Manual*, Cold Spring Harbor Laboratories, Cold Spring Harbor, N.Y.). The filters were washed three times in buffer (0.1×SSC/0.1% SDS) at 65° C., and were autoradiographed. Those cDNAs that showed duplicate signals were scored as background contaminants. The remaining clones were re-arrayed into 96-well microtiter plates. A total of twenty-three 96-well microtiter plates containing 2208 secondary selected clones were sequenced. This included three 96-well microtiter plates from all the random primed selections. Except, only two plates were included for the ThO cells stimulated with TPA, and only one plate was included for the ThO cells stimulated with TPA from the oligo dT selection. All cDNA clones were sequenced using M13 dye primer terminator cycle sequencing kits (Applied Biosystems). Data was collected by the ABI 377 automated fluorescence sequencer (Applied Biosystems).

Clones representing other contaminants, such as high copy repeats, ribosomal RNA, plasmid DNA, mitochondrial DNA, and E. coli and yeast DNA that were not identified in the hybridization process were removed from the dataset using in silico methods. This produced a set of cDNA clones corresponding to SEQ ID NO:980 to SEQ ID NO:1766, disclosed herein. These clones were clustered using PANGEA System's EST Clustering Tool (Oakland, Calif.), and analyzed with BLASTN, BLASTX, and FASTA programs. This allowed the assembly of full-length gene sequences. The direct selected clones were combined with the ESTs homologous to BAC sequences, BAC end sequences, and sequence within the public domain (dbEST and GenBank), and then clustered using the PANGEA Systems EST Clustering Tool. The clustered sequences (i.e., consensus sequences) correspond to SEQ ID NO:1767 to SEQ ID NO:4687, disclosed herein. In silico and hybridization techniques were used to map the direct selected cDNAs to the 15 cM region. Using well-established sequencing techniques, one skilled in the art could extend these candidate clones to map back the region into a full-length gene.

Example 8

Expression Analysis

In order to characterize the expression of genes mapping to the 12q23-qter region, a series of experiments were performed. First, oligonucleotide primers were designed for PCR and RT-PCR reactions to amplify cDNA, EST, or genomic DNA could be amplified from a pool of DNA molecules or RNA population. The PCR primers were used in a reaction containing genomic DNA to verify that they generated a product of the predicted size, based on the genomic sequence. The length, in nucleotides, of the processed transcript or messenger RNA (mRNA) was determined by Northern analysis (Sambrook et al, 1989, *Molecular Cloning: A Laboratory Manual*, Cold Spring Harbor Laboratory, Cold Spring Harbor N.Y.). Probes were generated using one of the methods described below.

Briefly, sequence verified IMAGE consortium cDNA clones were digested with appropriate restriction endonucleases to release the insert. The restriction digest was electrophoresed on an agarose gel and the bands containing the insert were excised. The gel piece containing the DNA insert was placed in a Spin-X (Corning Costar Corporation, Cambridge, Mass.) or Supelco spin column (Supelco Park, Pa.) and spun at high speed for 15 min. The DNA was ethanol precipitated and resuspended in TE. Alternatively, PCR products obtained from genomic DNA or RT-PCR were purified as described above. Inserts purified from IMAGE clones were random primer labeled (Feinberg and Vogelstein) to generate probes for hybridization. Probes from purified PCR products were generated by incorporation of $\alpha$-$^{32}$P-dCTP in second round of PCR. Commercially available Multiple Tissue Northern blots (CLONTECH, Palo Alto, Calif.) were hybridized and washed under conditions recommended by the manufacturer.

FIGS. 6A-6U show Northern blots illustrating the expression of the indicated genes in various tissues. With the exception of Gene 214 (FIG. 6A), all blots were Multiple Tissue Northern Blots (CLONTECH, Palo Alto, Calif.). The tissues included: 1) brain; 2) heart; 3) skeletal muscle; 4) colon; 5) thymus; 6) spleen; 7) kidney; 8) liver; 9) small intestine; 10) placenta; 11) lung; and 12) peripheral blood leukocytes. Size standards (Kb) are indicated to the left of each blot. FIG. 6A shows the Northern blot for Gene 214, which includes poly (A)+ selected RNA from 1) a lymphoblast cell line from an asthmatic individual; 2) lung; and 3) trachea.

RT-PCR was used as an alternate method to Northern blotting to detect mRNAs with low levels of expression. Total RNA from multiple human tissues was purchased from CLONTECH (Palo Alto, Calif.), and genomic DNA was removed by DNaseI digestion. The Superscript' Preamplification System for First strand cDNA synthesis (Life Technologies, Gaithersburg, Md.) was used according to manufacturer's directions, with oligo(dT) or random hexamers to synthesize cDNA from the DNaseI treated total RNA. Gene specific primers were used to amplify the target cDNAs in a 30 µl PCR reaction containing 0.5 µl of first strand cDNA, 1 µl sense primer (10 µM), 1 µl antisense primer (10 µM), 3 µl dNTPs (2 mM), 1.2 µl $MgCl_2$ (25 mM), 3 p 10×PCR buffer, and 1 U Taq Polymerase (Perkin Elmer). The PCR reaction included a denaturation step at 94° C. for 4 min, followed by 30 cycles at 94° C. for 30 sec, 58° C. for 1 min, and 72° C. for 1 min, and an extention step at 72° C. for 7 min. PCR products were analyzed on agarose gels.

The 12q23-qter genes are shown in Table 4; the nucleotide sequences correspond to SEQ ID NO:1 to SEQ ID NO:92, the encoded amino acid sequences correspond to SEQ ID NO:93-155, and the BAC nucleotide sequences correspond to SEQ ID NO:694 to SEQ ID NO:979, as disclosed herein.

Example 9

Mutation Analysis

In order to conduct mutation analysis, the genomic structure of Gene 214, Gene 224, Gene 422, Gene 436, Gene 449, Gene 454, Gene 515, Gene 561, Gene 570, Gene 581, Gene 698, Gene 702, Gene 722, Gene 748, Gene 751, Gene 757 and Gene 848 was determined. For genes with previously unidentified exon-intron boundaries, the cDNA sequences were compared to genomic sequence from the BACs. The precise intron-exon junctions were determined based on the consensus sequences at splice junctions. The exon prediction programs MZEF (Zhang, 1997, *Proc. Natl. Acad. Sci.*, 94:565-568) and GenScan (Burge and Karlin, 1997, *J. Mol. Biol.*, 268:78-94) were also utilized to identify the exons.

Disorder associated candidate genes (Table 4) were identified using the above procedures, and exons from these genes were subjected to mutation detection analysis. A combination of fluorescent single stranded confirmation (SSCP) analysis (ABI), DNA sequencing, and other sequence analysis methods described herein were utilized to precisely identify and determine nucleotide sequence variants. SSCP analysis was used to screen individual DNA sequences for variants. Briefly, PCR was used to generate templates from unrelated asthmatic individuals that showed increased sharing for the 12q23-qter chromosomal region, and contributed towards linkage. Non-asthmatic individuals were used as controls. Enzymatic amplification of genes within the asthma region of 12q23-qter was accomplished using primers flanking each exon and the putative 5' regulatory elements of each gene. The primers were designed to amplify each exon, as well as 15 or more base pairs of each intron on either side of the splice site. The forward and the reverse primers had two different dye colors to allow analysis of each strand, and independent confirmation of variants. PCR reactions were optimized for each exon primer pair. Buffer and cycling conditions were specific to each primer set. PCR products were denatured using a formamide dye, and electrophoresed on non-denaturing acrylamide gels with varying concentrations of glycerol (at least two different glycerol concentrations).

Primers utilized in fluorescent SSCP experiments to screen coding and non-coding regions of Gene 214, Gene 224, Gene 422, Gene 436, Gene 449, Gene 454, Gene 515, Gene 561, Gene 570, Gene 581, Gene 698, Gene 702, Gene 722, Gene 748, Gene 751, Gene 757 and Gene 848 for polymorphisms are provided in Table 8. Column 1 lists the genes targeted for mutation analysis. Column 2 lists the specific exons analyzed. Column 3 lists the assigned primer names. Columns 4 and 5 list the forward primer sequences and the reverse primer sequences, respectively. The genes listed in column 1 of Table 8 correspond to the gene identifiers in column 1 of Table 4.

TABLE 8

SSCP PRIMERS
Primers used in SSCP experiments

| Gene | Exon | SSCP Assay | SEQ ID NO: | Forward Sequence | SEQ ID NO: | Reverse Sequence |
|---|---|---|---|---|---|---|
| 454 | A | 55_454_A_F_56_454_A_R | 5245 | TGGCCCTGTCAGGAAGAGTA | 5271 | CTGCAGAGATCTGGGTCCTC |
| 454 | B | 57_454_B_F_58_454_B_R | 5246 | TTGATGCTTTCCCATGTCTG | 5272 | GGAGAATGCTACGAGGTGCT |
| 454 | C | 59_454_C_F_60_454_C_R | 5247 | TCAAAGGCCTTGCATTTTCT | 5273 | GTCCGCATTTCTGCTTCTTC |
| 454 | D | 61_454_D_F_62_454_D_R | 5248 | TCCCCACTCTGTCATCCTTC | 5274 | GAGGCTGAAGACCTGACCTG |
| 454 | E | 63_454_E_F_64_454_E_R | 5249 | CCTCTCCGCAGTTCTTTCAC | 5275 | GAGGGCCACTGTGTCTGTCT |
| 454 | F | 65_454_F_F_66_454_F_R | 5250 | GTATCCCAAAGACCAAGCCA | 5276 | AACTAAGACAGCCAGGCAGC |
| 454 | G | 67_454_G_F_68_454_G_R | 5251 | ATGGAACCTCTCCACCACAC | 5277 | TCCCAGTGTACAAAGCACCA |
| 454 | H | 69_454_H_F_70_454_H_R | 5252 | CTGGCTATGCAGGAGATGT | 5278 | GTGAGTTTGACCTGGGCCT |
| 454 | K | 71_454_K_F_72_454_K_R | 5253 | CCAGAACCCAGCACTTTCA | 5279 | AGGCTGAGACCAAAACCCTT |
| 454 | L | 73_454_L_F_74_454_L_R | 5254 | AACCAACAATTGCACGTTGA | 5280 | TGTCGATGAGGAAGTCGATG |
| 454 | M | 75_454_M_F_76_454_M_R | 5255 | CAGCGCTTGTCTGCATTCT | 5281 | GGAATCTCTCCGTGTCTTGG |
| 454 | N | 77_454_N_F_78_454_N_R | 5256 | TGATAATTCTGTACAAAAATGGGTAA | 5282 | CTTTGTTAAAATCCATCAGTTTTG |
| 454 | O1 | 79_454_O_F_80_454_O_R | 5257 | CCTAGAACCTGAGGGCTTGTC | 5283 | CTGTGGCTCTCAGGGAGTTG |
| 454 | O2 | 81_454_O_F_82_454_O_R | 5258 | GGTGCCAGTGTGGAAGATG | 5284 | AGGTGGCGTAGCACCTGTAG |
| 454 | O3 | 83_454_O_F_84_454_O_R | 5259 | CACCACCTCAGAGCTGTTCA | 5285 | ACTGCCCTTCACTCTTTGGA |
| 454 | O4 | 85_454_O_F_86_454_O_R | 5260 | CCAGGACATGGCTGACTTTG | 5286 | ACAGACAGGATTTCGCCTTG |
| 454 | AA | 1959_454_AA_F_1960_454_AA_R | 5261 | GAAATATTCCAATTTGCCTGG | 5287 | CCGAGGAAAGTGGAGTTGAG |
| 454 | AA | 1961_454_AA_F_1962_454_AA_R | 5262 | CCTGTTTTGCTTTGAGTCCA | 5288 | TACTCTCCACCCTCCTCTGC |
| 454 | AA | 1963_454_AA_F_1964_454_AA_R | 5263 | CCTGGTGATCTTTGGCTGAT | 5289 | ACAACCCTTTATTCAGCCCC |
| 454 | AA | 1965_454_AA_F_1966_454_AA_R | 5264 | GGGGAGATCTTCATTTACCCA | 5290 | GTGTTCAGAGGATGGGCATT |
| 454 | AA | 1967_454_AA_F_1968_454_AA_R | 5265 | GGGGAAAAGGGAGAATTCTAAA | 5291 | CCCTCCCAGTAACTGCAAAA |
| 454 | AA | 1969_454_AA_F_1970_454_AA_R | 5266 | GCAGTCATTGGAGGAGCTTG | 5292 | GGAAAAGATGATCACGTGGAA |
| 757 | A | 1750_757_A_F_1751_757_A_R | 5267 | GAGCAGGGGTGGAGAGCC | 5293 | CAGGTTGGGCATACGAGTCA |
| 757 | A | 1752_757_A_F_1753_757_A_R | 5268 | GCAAGGACATCGGCTACAA | 5294 | ATAATCGGGGAGCACTTGAG |
| 757 | A | 1778_757_A_F_1779_757_A_R | 5269 | TGCACCGAGCAGGTCTCTAC | 5295 | GTCCTTCAGCGGGTGCTC |
| 757 | A | 1780_757_A_F_1781_757_A_R | 5270 | AACTACCTGTGCATGGAGGC | 5296 | GAAGGTGAGCACGGTGAAG |
| 757 | A | 1758_757_A_F_1759_757_A_R | 5297 | CGTGCTCACCTTCCTCATC | 5330 | GTGAGGACCACCCACCAC |
| 757 | A | 1760_757_A_F_1761_757_A_R | 5298 | CTGTGGTGGGTGGTCCTC | 5331 | GTAGCAGGCCAGGGGAAT |
| 757 | A | 1782_757_A_F_1783_757_A_R | 5299 | TCTGCTACGTGGGCAGCAT | 5332 | CCATGTTGAGGCGTTCGTAA |

TABLE 8-continued

SSCP PRIMERS
Primers used in SSCP experiments

| Gene | Exon | SSCP Assay | SEQ ID NO: | Forward Sequence | SEQ ID NO: | Reverse Sequence |
|---|---|---|---|---|---|---|
| 757 | A | 1784_757_A_F_1785_757_A_R | 5300 | CTCTGTGCTGTACACCGTGC | 5333 | GGTTTTCTCCGGCTCTTCTT |
| 757 | A | 1786_757_A_F_1787_757_A_R | 5301 | CCTCCAAGACTCTGCAGTCC | 5334 | CACAACCAAGAAAAGCACCA |
| 757 | A | 1788_757_A_F_1789_757_A_R | 5302 | AAATATGAGATCCCTGCCCA | 5335 | CTTCGCTGGAAAACCAAAAC |
| 757 | A | 1768_757_A_F_1769_757_A_R | 5303 | TGAAATTCAGGATGCTGTGA | 5336 | TTGCAAAGCAGTTATCTGTCC |
| 757 | A | 1770_757_A_F_1771_757_A_R | 5304 | TTGAGTTGGCTTTGCTACCC | 5337 | TGTGAGGTTTGATGGAGGTTT |
| 757 | A | 1772_757_A_F_1773_757_A_R | 5305 | CTGCAAGACAGAAACCTCCA | 5338 | TCCACAAATCAGTCCAAACG |
| 757 | A | 1774_757_A_F_1775_757_A_R | 5306 | TAATGGAAACCAAGCCAATG | 5339 | CAAATATACACACGCAGAAACC |
| 757 | A | 1776_757_A_F_1777_757_A_R | 5307 | TGCCAGGAAAGAGTGGTTTC | 5340 | GCTAGAAGCACAACCCAGA |
| 561 | A | 1530_561_A_F_1531_561_A_R | 5308 | AGGGTATAGGATGCACGCC | 5341 | CTCCACCACACCAGGGAT |
| 561 | B | 937_561_B_F_938_561_B_R | 5309 | ACACACATTTCCACCACCAA | 5342 | CATGAACTGTGGGAAAGGCT |
| 561 | B | 939_561_B_F_940_561_B_R | 5310 | CCGGACTCAAAGTGAGCAGT | 5343 | ATTTCACCTGTGCACACCCT |
| 561 | C | 941_561_C_F_942_561_C_R | 5311 | CATGACCAACGTGCTTTGAC | 5344 | ATCTTGCGCTACCGGATCT |
| 561 | C | 943_561_C_F_944_561_C_R | 5312 | GTCAGGAGAGCGCTATTGGA | 5345 | AACAGGACAAACTGGCCAAC |
| 561 | D | 945_561_D_F_946_561_D_R | 5313 | CCTCCAGCTTCAATAACCCA | 5346 | AAATCCCACCTTCTCCTCGT |
| 561 | E | 947_561_E_F_948_561_E_R | 5314 | TGTGTCCTCCAGAGCCTCTAA | 5347 | GGGAGCCCTGCCTATCTATC |
| 561 | F | 949_561_F_F_950_561_F_R | 5315 | CTGTGTTGGCTGGGTGATAA | 5348 | GGCACTGTTGTCGGTGATG |
| 561 | F | 951_561_F_F_952_561_F_R | 5316 | GAGAGCACATCCTGGACCTC | 5349 | TTCATGCGTGTCTCCTTGTC |
| 561 | F | 953_561_F_F_954_561_F_R | 5317 | GCCACCAGGATGGGGAAC | 5350 | TCTGCGTGATGTTGTCCAC |
| 561 | F | 955_561_F_F_956_561_F_R | 5318 | GTGGGCAAGGACGTGGTG | 5351 | CTCCCTTTGCTCCAGCGG |
| 561 | F | 957_561_F_F_958_561_F_R | 5319 | CACGTCATCTTCCTCAACGA | 5352 | GGAAGGACACAGGGCTCAC |
| 561 | G | 1532_561_G_F_1533_561_G_R | 5320 | ACCGAATGATCTCGTTTCCA | 5353 | AAAACTCACCCTCTGCCCTT |
| 561 | G | 1534_561_G_F_1535_561_G_R | 5321 | CACCCCCACAAGATGTTACC | 5354 | AGTGATCAGGGCTGGAAGAG |
| 561 | H | 961_561_H_F_962_561_H_R | 5322 | GGCTCCCCATTGCAGGAC | 5355 | TGATTGGGGTGCAGGTCTC |
| 561 | H | 963_561_H_F_964_561_H_R | 5323 | ACTCTGCAGTTGCTGCCGT | 5356 | CTGTGGCTGTGGCAGGAT |
| 561 | H | 1536_561_H_F_1537_561_H_R | 5324 | CACGCCAGGATGGATGAG | 5357 | GACTGAGGAGCCACCGAG |
| 561 | I | 967_561_I_F_968_561_I_R | 5325 | GTAGCTGAAGGTGGCCCTG | 5358 | CCACCAGGAGGATGGTGT |
| 561 | J | 969_561_J_F_970_561_J_R | 5326 | TGTAGGATGCGGGAGGAG | 5359 | AGCTACTCTGGGGACGGAG |
| 561 | K | 971_561_K_F_972_561_K_R | 5327 | ATGCTGGCGAGACTTACGAC | 5360 | TTTGCTTAGCGGAAAATGCT |
| 561 | L | 973_561_L_F_974_561_L_R | 5328 | CACGCTCCTCAGTTAGGCTC | 5361 | CACCTTGATGATCTGGCCTT |
| 561 | L | 975_561_L_F_976_561_L_R | 5329 | AGACCGCCTTTCTCCAGACT | 5362 | GTCGATACCCTGTTGCCAGT |
| 561 | M | 977_561_M_F_978_561_M_R | 5363 | CTGAACCAATCAATTACAGTGCT | 5396 | GATAAAATGCAGGGAAGGTC |
| 561 | N | 979_561_N_F_980_561_N_R | 5364 | AGGGGAACACCGCTAAGTTT | 5397 | GTGGTGTACCACGAGGGAAG |
| 561 | O | 1538_561_O_F_1539_561_O_R | 5365 | TTCTCAAATAGTAAGGGAAAGCA | 5398 | ATGACGTTCATGCCCAATTT |
| 561 | P | 983_561_P_F_984_561_P_R | 5366 | TCCTTTAGCCAAAGCAAGATG | 5399 | ATATGGCAGAACGGGACAGA |
| 561 | Q | 1248_561_Q_F_1249_561_Q_R | 5367 | CCAAGGGCTTCTCAAGCATA | 5400 | ACACTGGCCCGGTTAAGGTA |
| 561 | X | 1744_561_X_F_1745_561_X_R | 5368 | GCCCCTAACTGATACAGAGGAA | 5401 | AAGGAGGCAGACAAGCAAA |
| 561 | Y | 1746_561_Y_F_1747_561_Y_R | 5369 | GGAGCTCCTAACCACTGCAC | 5402 | CTTCCCAGTTGTTCCTCCCT |

TABLE 8-continued

SSCP PRIMERS
Primers used in SSCP experiments

| Gene | Exon | SSCP Assay | SEQ ID NO: | Forward Sequence | SEQ ID NO: | Reverse Sequence |
|---|---|---|---|---|---|---|
| 561 | Z | 1748_561_Z_F_1749_561_Z_R | 5370 | AGAGGAAGCAACGGATACCA | 5403 | TCACACCGACCTCACAAAGA |
| 561 | R | 1957_561_R_F_1958_561_R_R | 5371 | ACCTGCCACGATAGCACAG | 5404 | ATAGGTGAGGAGAACGTGGC |
| 214 | B | 192_214_B_F_193_214_B_R | 5372 | CACTGTGTTAAAACGCCTGG | 5405 | GTTGGGATTACAGGCACGAG |
| 214 | B | 194_214_B_F_195_214_B_R | 5373 | CAGAAGCAACCCACATGACC | 5406 | ACTACAGGTTTGCACCACCA |
| 214 | A | 196_214_A_F_197_214_A_R | 5374 | GCCCTTAGGGAGAGCAGC | 5407 | CCACATCGTGCCTTTGTGTA |
| 214 | C | 626_214_C_F_627_214_C_R | 5375 | ATGCTCTCCTGATGGCTCCT | 5408 | AGGGAATGCAGGTGCAAAG |
| 214 | C | 628_214_C_F_629_214_C_R | 5376 | ACTCGGGAAAGGAAGGCTCT | 5409 | CATACCTTGAGTGCACACCG |
| 214 | AA | 1607_214_AA_F_1608_214_AA_R | 5377 | AGACAGTGTTGTTCCCGGAG | 5410 | TCACTGCTCACCCACGTTAG |
| 214 | E | 1609_214_E_F_1610_214_E_R | 5378 | ATATGTTTGCTGGCTTTGGG | 5411 | GAAGGAGTGAGCCGGTAACA |
| 214 | E | 1611_214_E_F_1612_214_E_R | 5379 | CTGCTTCAAGATGCCAGTGA | 5412 | AACAAACGCCTGGGTTGAG |
| 214 | E | 1613_214_E_F_1614_214_E_R | 5380 | CCGTCCCAGGATACCTTTTC | 5413 | CCCAGGCTGTGTGTCCTCTA |
| 214 | E | 1615_214_E_F_1616_214_E_R | 5381 | ACACCCATCACCTTACATGG | 5414 | AATGAACGTGGTGACTACAGC |
| 214 | E | 1617_214_E_F_1618_214_E_R | 5382 | TATCTGGACGTGGTGGTGC | 5415 | AGCAGAGTGAACAGTGGCTG |
| 214 | AA | 1599_214_AA_F_1600_214_AA_R | 5383 | CGGGCGTGTATATCTCTTCA | 5416 | TTCGCTTGTGATCATGTCG |
| 214 | AA | 1601_214_AA_F_1602_214_AA_R | 5384 | TGTACGAACAGTCCAGACGAG | 5417 | GCCATGGTTGTTAAATTAGGC |
| 214 | AA | 1603_214_AA_F_1604_214_AA_R | 5385 | CGACATGATCACAAGCGAAA | 5418 | TTTGGTCTGCTTCAGTGGTG |
| 214 | AA | 1605_214_AA_F_1606_214_AA_R | 5386 | CGAATAAAGGCGTCGAGAAG | 5419 | CAGGGTCCTCTTCAGAGTCG |
| 224 | W | 133_224_W_F_134_224_W_R | 5387 | CACCTGTCACCTGCCTTGTA | 5420 | GGGACCCACCTTGCTGAG |
| 224 | BB | 1432_224_BB_F_1433_224_BB_R | 5388 | CCCAGCCCCTTCTCACTG | 5421 | GGAAAAGGGACCTGGGAAGT |
| 224 | C | 1434_224_C_F_1435_224_C_R | 5389 | CAGCAAGTCCCTCCTGATGT | 5422 | TTTAGCTTCCCTCCCCTCAG |
| 224 | D | 1436_224_D_F_1437_224_D_R | 5390 | GCAGATCCCAGGAAGAACAA | 5423 | AGCTGCCACCCTCTCATCTA |
| 224 | J | 1438_224_J_F_1439_224_J_R | 5391 | TGTGGGTACAGTGGCATTA | 5424 | GCAAACCCACTCACCCTCT |
| 224 | L | 1440_224_L_F_1441_224_L_R | 5392 | ATCCAGAGATACCCCAGCCT | 5425 | CAAAGGTGGTTTCTGGCAGT |
| 224 | Y | 1442_224_Y_F_1443_224_Y_R | 5393 | GCCTGTGGGTATTTTGCACT | 5426 | ACCTACCCCAACTTGTGACG |
| 224 | Z | 1444_224_Z_F_1445_224_Z_R | 5394 | TTGATTGGATTTGAGCTCTGC | 5427 | CCGTGGAGAGACACCTTCAC |
| 224 | S | 131_224_S_F_132_224_S_R | 5395 | TTGGCAGACAGAAGAGGAGG | 5428 | TTTCCTGTAGGTCCATGAG |
| 422 | C | 1859_422_C_F_1860_422_C_R | 5429 | TTATCTGGGCAGGGTTGTGT | 5462 | CCCATTCCAGAGGAGTGAGA |
| 422 | D | 1861_422_D_F_1862_422_D_R | 5430 | CTGGCAGACCGATTTGAACT | 5463 | GGCAGGCACTCCAATTTTC |
| 422 | E | 1863_422_E_F_1864_422_E_R | 5431 | GTGAGGGCTGACCTATTGCT | 5464 | CGGCCTACTGAGAACCAACT |
| 422 | F | 1865_422_F_F_1866_422_F_R | 5432 | TTCTTCTTGCCCCAGATTGT | 5465 | TGAGATGAGGCAGATAGAGGTG |
| 422 | F | 1867_422_F_F_1868_422_F_R | 5433 | AAGGCACACAAGAACCTGGA | 5466 | AGGTGGCATCACTGCACTC |
| 436 | A | 1549_436_A_F_1550_436_A_R | 5434 | CCTAGAGGGTCATCGTTCCC | 5467 | TCGTACTCGAACAGGAAGGC |
| 436 | A | 1551_436_A_F_1552_436_A_R | 5435 | ACCCAGACCGACTAGGGGAC | 5468 | GACCGAGGCCAGGATGAG |
| 436 | B | 1553_436_B_F_1554_436_B_R | 5436 | TTCCCCATCAATTCAAATCC | 5469 | TCAGGCCACGTCAATCATTA |
| 436 | C | 1555_436_C_F_1556_436_C_R | 5437 | TTTCTTGGCTCTCCGTGAGT | 5470 | GAGCGAAAGAAAGTCCACG |
| 436 | D | 1557_436_D_F_1558_436_D_R | 5438 | GCCACGTGGACTTTCTTTTC | 5471 | GGGTCATGTGAAGGAATTGG |
| 436 | E | 1559_436_E_F_1560_436_E_R | 5439 | TAGGAGACCCCTGTGGACAT | 5472 | TGAGGCACAGAAAATCACTTG |

TABLE 8-continued

SSCP PRIMERS
Primers used in SSCP experiments

| Gene | Exon | SSCP Assay | SEQ ID NO: | Forward Sequence | SEQ ID NO: | Reverse Sequence |
|---|---|---|---|---|---|---|
| 436 | F | 1561_436_F_F_1562_436_F_R | 5440 | CTGCACTCGAGGTGACAGAG | 5473 | ACACCTGGCCACCACTTACT |
| 436 | G | 1563_436_G_F_1564_436_G_R | 5441 | TCTCTGAGGTTTTCGTCGCT | 5474 | GGGATGAGCAGCAGAGACAC |
| 436 | H | 1565_436_H_F_1566_436_H_R | 5442 | CAGGTGCTGAGGAAAGCCT | 5475 | TGCCTGAGTGCTGGTCTTC |
| 436 | I | 1567_436_I_F_1568_436_I_R | 5443 | TGTGCCAGCTCCACTCTAAC | 5476 | ATGTCAAATTTCCCTGCCTG |
| 436 | J | 1569_436_J_F_1570_436_J_R | 5444 | GCCCCTGCAGAAACACTTT | 5477 | GGTCTTGGAGAAGGGAAGGT |
| 436 | K | 1571_436_K_F_1572_436_K_R | 5445 | CCATTCCGGTAAAGATTCCA | 5478 | ACACCCAAGAGATGAGAGGC |
| 436 | L | 1573_436_L_F_1574_436_L_R | 5446 | CTACTTCAGTGCACCTTGCG | 5479 | ATTTCTCTGGGGTGATGTGG |
| 436 | M | 1671_436_M_F_1672_436_M_R | 5447 | CCATCAGTGTGCTGAGTGCT | 5480 | ACAGGCCTCTTAAATTGCCA |
| 449 | A | 1971_449_A_F_1972_449_A_R | 5448 | CCAGATATTCCAGCCTCAGC | 5481 | ATCAGTGCCATCTCTGTCCC |
| 449 | A | 1973_449_A_F_1974_449_A_R | 5449 | CTGGGTAGGAGCCTGGCTAT | 5482 | AAATGCTCCTGCCTCAGAAA |
| 449 | A | 1975_449_A_F_1976_449_A_R | 5450 | GGAAGAGGTGCTAGACGCTG | 5483 | GCTAGGTGGGATGGGGTATT |
| 449 | B | 1977_449_B_F_1978_449_B_R | 5451 | AGTGGGCCTCAGGGTGAC | 5484 | TCTCTGCTCCATCCTCAGGT |
| 449 | B | 1979_449_B_F_1980_449_B_R | 5452 | ATGTGGCAAAGCCAGGAC | 5485 | CCCCAAGCATAGGACACAGA |
| 449 | C | 1981_449_C_F_1982_449_C_R | 5453 | TCAATCCCCAATCTCTTCCT | 5486 | CTCTTCCCTCTCCTTGCC |
| 449 | D | 1983_449_D_F_1984_449_D_R | 5454 | CAACGCCATCCTTACACAGA | 5487 | TGTGGAGTGTGTAGTACTTGGTCC |
| 449 | D | 1985_449_D_F_1986_449_D_R | 5455 | ACTGTGATGGACCTGCTCCT | 5488 | TGTGTTGGTGTGGGAGGTC |
| 449 | E | 1987_449_E_F_1988_449_E_R | 5456 | CAAACCATTATGAGCCTGGG | 5489 | GTCGTTCTGACCTTCAAGCC |
| 449 | F | 1989_449_F_F_1990_449_F_R | 5457 | TGTGGACTTAACACCTCTCCTTC | 5490 | TGAGTGTGGGAGAAGATCCC |
| 449 | F | 1991_449_F_F_1992_449_F_R | 5458 | GCTCCTTAGCCAAATATGGGA | 5491 | ATAGATCCCCAGACCCAACC |
| 449 | F | 1993_449_F_F_1994_449_F_R | 5459 | ATTCCAAGGCCAAGTCCTG | 5492 | TCTGGCCTGGGATAACTCAT |
| 449 | F | 2011_449_F_F_1992_449_F_R | 5460 | CAGGTGCTCCTTAGCCAAATA | 5493 | ATAGATCCCCAGACCCAACC |
| 515 | A | 1226_515_A_F_1227_515_A_R | 5461 | GCTCCATCGGACTCACTAGC | 5494 | TGGATTTCCAGGACTTGAGG |
| 515 | A | 1228_515_A_F_1229_515_A_R | 5495 | TGTTGGGGCTGGAGTTTATC | 5528 | TCATGGCAAACATGAAGAGC |
| 515 | A | 1230_515_A_F_1231_515_A_R | 5496 | GCCGTTCGTGATGGACTACT | 5529 | GCCATTCTGGATCAGCAACT |
| 515 | A | 1232_515_A_F_1233_515_A_R | 5497 | CAGCCATCATCTCTTGCCTT | 5530 | CCACCATGATGAAGGTGATG |
| 515 | A | 1234_515_A_F_1235_515_A_R | 5498 | GCATCATCCTGTTCTGCTCA | 5531 | TGATAAAGAACGCCAGGTCC |
| 515 | A | 1236_515_A_F_1237_515_A_R | 5499 | GGCCATCGTCTTTGTCATCT | 5532 | GCTCGTGCTGCGGTATTAT |
| 515 | A | 1238_515_A_F_1239_515_A_R | 5500 | ACTTCTCCAGCCCATCCTTT | 5533 | GCAACAGCCCAACTGTTTCT |
| 515 | A | 1240_515_A_F_1241_515_A_R | 5501 | CATGGAGCCCCTCTTATCTG | 5534 | GCAACCAGTCTCCCACTCAT |
| 570 | C | 1310_570_C_F_1311_570_C_R | 5502 | GGTTTTCATCCTTGAAGACTGT | 5535 | CCACAGAGGAAGACCACAA |
| 570 | C | 1312_570_C_F_1313_570_C_R | 5503 | TAGGCGGCATTGCCTATATT | 5536 | ACCTTTCAAACAGCCCAAGA |
| 570 | D | 1314_570_D_F_1315_570_D_R | 5504 | TGAGCTGGTTTCTTACCTCCA | 5537 | CAAAGCCAAGAAAACAGGGA |
| 570 | D | 1316_570_D_F_1317_570_D_R | 5505 | AGGCATTGGAGTCTTTCAGC | 5538 | AAATGGCCAAAACAAGTGCT |
| 570 | E | 1318_570_E_F_1319_570_E_R | 5506 | GAGAGCACAGTTGGTCCACA | 5539 | ACAATGCTTTTGTGTCGGTG |
| 570 | F | 1320_570_F_F_1321_570_F_R | 5507 | CCTGTATTGCGGGGAGTAAA | 5540 | TCTGAATCCACAACTGCTGC |
| 570 | G | 1322_570_G_F_1323_570_G_R | 5508 | CGAAGTCTCGTAGCCAACATC | 5541 | GTGCCTGGACTCAGACACCT |
| 570 | H | 1324_570_H_F_1325_570_H_R | 5509 | CCATGTGTTAAAGTGCCCCT | 5542 | CCCCTCACTGGCTATTTTCA |

TABLE 8-continued

SSCP PRIMERS
Primers used in SSCP experiments

| Gene | Exon | SSCP Assay | SEQ ID NO: | Forward Sequence | SEQ ID NO: | Reverse Sequence |
|---|---|---|---|---|---|---|
| 570 | I | 1326_570_I_F_1327_570_I_R | 5510 | GCTTGCATCACTGTGTTTCC | 5543 | AGAAAGGGAAGCTTGGGGTA |
| 570 | I | 1516_570_I_F_1517_570_I_R | 5511 | GGGACGTCCTTGACAGACA | 5544 | TGGAGCTGTTTTTGTGCATC |
| 570 | J | 1330_570_J_F_1331_570_J_R | 5512 | AAAATACCTGTAGCAGCGCA | 5545 | ATTGGCTCTTGATCGCTGA |
| 570 | J | 1332_570_J_F_1333_570_J_R | 5513 | GCTACCCTCCTGCTTTTCCT | 5546 | ATCAATCCAGGCAACATGC |
| 570 | B | 1897_570_B_F_1898_570_B_R | 5514 | TGGTGCTATTCCTGAACGGG | 5547 | GCCGTGCAGTTGAGCAGG |
| 581 | C | 1362_581_C_F_1363_581_C_R | 5515 | TTCCGTGACTCTGGGATCTT | 5548 | ATGAACCTCAACACCCAAGG |
| 581 | D | 1364_581_D_F_1365_581_D_R | 5516 | GGAAAACCTTGCTTGTGGAA | 5549 | TGTTGGAACAGACCTGATTTTC |
| 581 | E | 1366_581_E_F_1367_581_E_R | 5517 | TGAGGGGAGAGATACAGGTGA | 5550 | TGTTGCCACACAACACAATG |
| 581 | E | 1368_581_E_F_1369_581_E_R | 5518 | ACAAGAATGTGCCTAACTGGC | 5551 | GACTCCGTCTTGGGGAAAA |
| 581 | F | 1370_581_F_F_1371_581_F_R | 5519 | ACCATGCCTTGCCAAGAA | 5552 | GCTCATACTGTGCTGCCAAA |
| 581 | F | 1524_581_F_F_1525_581_F_R | 5520 | CAGTACTACGACATTTCTGCCAA | 5553 | GGAATAAACAAGCCAAACCG |
| 581 | G | 1374_581_G_F_1375_581_G_R | 5521 | GATTGTTCGGTTTGGCTTGT | 5554 | TCAGCATCCCACAGATGAAG |
| 698 | A | 1334_698_A_F_1335_698_A_R | 5522 | GACCAGAATCCCAAGAGCAC | 5555 | TGCTGTGATTGCCCTAACAA |
| 698 | B | 1336_698_B_F_1337_698_B_R | 5523 | TTTTGCCCACTGAGATGCTA | 5556 | AAATCCAGTGGCTTCCTTCC |
| 698 | C | 1338_698_C_F_1339_698_C_R | 5524 | ACTGCTTTGTCTCCTGGGAA | 5557 | CACAAAACTGAAACCCTGCC |
| 698 | E | 1342_698_E_F_1343_698_E_R | 5525 | TGTTTGGCTTGATCACTGAGA | 5558 | TGACTGCCAAGCAATTTTCA |
| 698 | F | 1344_698_F_F_1345_698_F_R | 5526 | AGGAAGGTGTTTATGCACGG | 5559 | GCTCTTTCACCGAAAACTGC |
| 698 | G | 1520_698_G_F_1521_698_G_R | 5527 | CAGGTGAGTTTAGTTTCCTGTCC | 5560 | CCTCCCATCTTGCAGTTCAT |
| 698 | G | 1522_698_G_F_1523_698_G_R | 5561 | TCAGGTTGTCTGTCTGTTGTCA | 5594 | AAACGGCATCTACCAATTAAATC |
| 698 | H | 1348_698_H_F_1349_698_H_R | 5562 | CATCCCCGTGAGTTTGATTT | 5595 | CTCACTGCCACCCACAGTAG |
| 698 | I | 1350_698_I_F_1351_698_I_R | 5563 | TCCTGCTCCTTCTGTGTAAGG | 5596 | TTTCTGGAAGACCCCAGTTT |
| 698 | J | 1352_698_J_F_1353_698_J_R | 5564 | TGTGTCGTAGGCATGAATTG | 5597 | CCCTCATCCTTTCATCTTGTG |
| 698 | K | 1354_698_K_F_1355_698_K_R | 5565 | GGAGCATGTGAACACCTGAA | 5598 | GAAACCACCACCAAGGAGAA |
| 698 | L | 1356_698_L_F_1357_698_L_R | 5566 | AGTTTTCAGCACATCCGTGT | 5599 | GCCTTTTAAACCACAGCTATTTC |
| 698 | M | 1358_698_M_F_1359_698_M_R | 5567 | TTGACCTACAAGCTGTGCCA | 5600 | CTCTGGCCAACAAGAAAAGC |
| 698 | M | 1360_698_M_F_1361_698_M_R | 5568 | TCCTTCCACTAAAGGGTGTCA | 5601 | TCCTAATCCCCTTCCCAAGT |
| 698 | D | 1518_698_D_F_1519_698_D_R | 5569 | TGTGTCTTCTTGCTGTGTCT | 5602 | ACCATTGTTATTCCGGGCT |
| 702 | A | 630_702_A_F_631_702_A_R | 5570 | GGCCAGGGACATCAGGTT | 5603 | GTCTGCAGCTGCCCTGTT |
| 702 | A | 632_702_A_F_633_702_A_R | 5571 | CCCCTCACCCTGCTCTCT | 5604 | CATAAGACGGGACTGTGCCT |
| 702 | B | 634_702_B_F_635_702_B_R | 5572 | AGTGAGCTGGGCTAGGCTCT | 5605 | GGAGACCCCGTTCCTCAC |
| 702 | C | 636_702_C_F_637_702_C_R | 5573 | CTGCTCCTCATCCTCACAGG | 5606 | CCCTGAACTTCCACGAGGT |
| 702 | C | 638_702_C_F_639_702_C_R | 5574 | GTCGAAGGGGTAGCCGTC | 5607 | CCTGTTCTCCGTGACTCACTC |
| 702 | D | 640_702_D_F_641_702_D_R | 5575 | GGGGTTTCTGACCCCTCTT | 5608 | CAGTGGCTGTCCACGAGTT |
| 702 | D | 642_702_D_F_643_702_D_R | 5576 | ACCTTGTCCTCGTAGGGGAG | 5609 | GCCCTTCTTGCCCTTAGTTC |
| 702 | E | 644_702_E_F_645_702_E_R | 5577 | CAGAGCCTGTCTGCTGAGTG | 5610 | GGACAGGGATGAGGACAGAC |
| 702 | F | 646_702_F_F_647_702_F_R | 5578 | CACACAAGGATGCCTGTCC | 5611 | GGTCTGCACCCAGAGTGG |
| 702 | G | 648_702_G_F_649_702_G_R | 5579 | TGGGTGCAGACCGTCTCT | 5612 | CTCCATGAGGCGGACAGA |

TABLE 8-continued

SSCP PRIMERS
Primers used in SSCP experiments

| Gene | Exon | SSCP Assay | SEQ ID NO: | Forward Sequence | SEQ ID NO: | Reverse Sequence |
|---|---|---|---|---|---|---|
| 702 | H | 650_702_H_F_651_702_H_R | 5580 | CTTGGCTGCCCTGTAGTGAT | 5613 | CATCGACGCTGCCTTCTC |
| 702 | H | 652_702_H_F_653_702_H_R | 5581 | CCTCGTGTGGTCATCGTAAC | 5614 | GGCTGACACAGGAGAAGGAA |
| 702 | I | 654_702_I_F_655_702_I_R | 5582 | CGAGGGTACCCACTCCCAT | 5615 | ACCAACCCCACCCACACT |
| 702 | I | 656_702_I_F_657_702_I_R | 5583 | AGCAGGGAGAGGTCATGTTG | 5616 | CAGAAGGGTGCCCAGTCA |
| 702 | I | 658_702_I_F_659_702_I_R | 5584 | CCGAGATGCTCCCTCCAG | 5617 | CACAGAGGGCAAGGACTGTG |
| 702 | I | 660_702_I_F_661_702_I_R | 5585 | TCGTCAGTCAACACAGTCCC | 5618 | CCAGGCCCTGACGCTATG |
| 702 | I | 662_702_I_F_663_702_I_R | 5586 | CACAGTCCTTGCCCTCTGTG | 5619 | GCCCCTCCAGGACAACAT |
| 702 | I | 664_702_I_F_665_702_I_R | 5587 | GTGCATGAGCAGACCTCGTA | 5620 | TGCCTCCTACTTCTTCCGTG |
| 702 | I | 666_702_I_F_667_702_I_R | 5588 | CTCCACACACCAGCCAGTC | 5621 | CAGTCTTGTGCAAGCCCC |
| 722 | B | 382_722_B_F_510_722_B_R | 5589 | TTCAGTTCGCTATTTGTGCC | 5622 | GGACAGGTAGGCAGGCTATG |
| 722 | C | 813_722_C_F_814_722_C_R | 5590 | GATTTGAGTTTGCCATGCTGT | 5623 | ACAGCCAGAGGGACACACA |
| 722 | D | 386_722_D_F_387_722_D_R | 5591 | ATGTTGGATATTATAGCTCAGATGC | 5624 | CAAATACCCATACTCCCAACATC |
| 722 | E | 388_722_E_F_389_722_E_R | 5592 | TTGAAGTCAGGCTTGGAACA | 5625 | TTCAGAGTCTGCAAGAAGAAAGT |
| 722 | F | 390_722_F_F_391_722_F_R | 5593 | ATGGCCCTCAGATACGAATG | 5626 | TTGAAGTGAGACCTTAAGGGAGA |
| 722 | G | 512_722_G_F_513_722_G_R | 5627 | ATGGTTGCAAATGGCTTTGT | 5652 | ACAGAAGAGGACATGGAGCC |
| 722 | H | 394_722_H_F_395_722_H_R | 5628 | CCCTTTAACTTCCAAACCCA | 5653 | TCTTGGAGAATGCAAGAGTCTG |
| 722 | I | 396_722_I_F_397_722_I_R | 5629 | CCATTACATGCACATCGTGTT | 5654 | TCTTCGAAGCCAAACTCACC |
| 722 | J | 1526_722_J_F_1527_722_J_R | 5630 | GCAAATGCCATTGTTGATTT | 5655 | CGGGTTACAGCGTCTGAGAT |
| 722 | AA | 739_722_AA_F_740_722_AA_R | 5631 | TCAGCTTGCTTTTCTTTGACA | 5656 | GTGGCTGGCAAGCTTTTATT |
| 722 | A | 1901_722_A_F_1902_722_A_R | 5632 | GGGCTCCCGCTGGAAAG | 5657 | GGCCTGAACCGCTACCC |
| 748 | A | 1995_748_A_F_1996_748_A_R | 5633 | TAGCATCCACCTGTGGTCCC | 5658 | CAGAAGCCAGAAGGGCAAAG |
| 748 | A | 1997_748_A_F_1998_748_A_R | 5634 | GCTTCCATGGTTGCTTAAAA | 5659 | TGCCTTTCAATCAGTAGAAGAAC |
| 748 | A | 1999_748_A_F_2000_748_A_R | 5635 | TAAGAATGGGTTCGAGGGTG | 5660 | TGGTTGAGAGAGCAAGAGGAA |
| 751 | U | 1945_751_U_F_1946_751_U_R | 5636 | GGTGCTACCTCCTCTGATCCT | 5661 | CACCTGCAGCCTCATGGTA |
| 751 | V | 1947_751_V_F_1948_751_V_R | 5637 | TAGCCTGTGGTGAGGGCAGT | 5662 | TCCTGTGACCTCAAAGCATCC |
| 751 | W | 1949_751_W_F_1950_751_W_R | 5638 | TGCCACTCAGGGTGACTGT | 5663 | TGCAAGCCTGCTCCTGAT |
| 751 | X | 1951_751_X_F_1952_751_X_R | 5639 | CCTAACTACGTGCAAAGGGC | 5664 | GCTCAGGATTTGAGTCCCAG |
| 751 | Y | 1953_751_Y_F_1954_751_Y_R | 5640 | ATTTCCAAATCCCAACCTCC | 5665 | CTGGGACCCTCGGTTTATG |
| 751 | Z | 1955_751_Z_F_1956_751_Z_R | 5641 | TCACTGGGCTTATGGCTCTC | 5666 | GTCCATGAGCAAAGGTGGAG |
| 848 | Y | 2001_848_Y_F_2002_848_Y_R | 5642 | GCCTCCAACTTTGCCTCTC | 5667 | TAAAACGCAAATCCCACCTC |
| 848 | Y | 2003_848_Y_F_2002_848_Y_R | 5643 | TCTCCTCGCCCTCTCTCTG | 5668 | TAAAACGCAAATCCCACCTC |
| 848 | Z | 2004_848_Z_F_2005_848_Z_R | 5644 | CATTTGTCTTCACTGGCCG | 5669 | TGGTGTCTGCCGCTGATT |
| GenR2 | A | 1453_GenR2_A_F_1454_GenR2_A_R | 5645 | CCAAGCCCCAAATTTAAGTG | 5670 | CCTCTCGCCTAAAACTGTGC |
| GenR2 | B | 1455_GenR2_B_F_1456_GenR2_B_R | 5646 | CATTTCTTGGCACACAATGG | 5671 | TGGTTGAGCCACCATACTCA |
| GenR2 | C | 1457_GenR2_C_F_1458_GenR2_C_R | 5647 | TATTTCACCCAGGAGGTTCG | 5672 | TGTTGCCAAGAATGTGGAAA |
| GenR2 | D | 1459_GenR2_D_F_1460_GenR2_D_R | 5648 | TCCTCCTAGGAACAGAGCCA | 5673 | ATGCACTCAGCGACCTTCT |
| GenR2 | F | 1575_GenR2_F_F_1576_GenR2_F_R | 5649 | GTCTTTCCCATCCCTCAACA | 5674 | GGGAGGCATAATGAACCAGA |

TABLE 8-continued

SSCP PRIMERS
Primers used in SSCP experiments

| Gene | Exon | SSCP Assay | SEQ ID NO: | Forward Sequence | SEQ ID NO: | Reverse Sequence |
|---|---|---|---|---|---|---|
| GenR2 | F | 1577_GenR2_F_F_1578_GenR2_F_R | 5650 | TAGCGCCCTATCCCTTTCTT | 5675 | TCCATCCCAAGCTTCACTCT |
| GenR2 | E | 1790_GenR2_E_F_1791_GenR2_E_R | 5651 | CTCTGACCTTGCACTACCCC | 5676 | CCACCGTGTCTTCAAATTCA |

Comparative DNA sequencing was used to determine the sequence changes in the genes in 12q23-qter. Variants detected by SSCP analysis in the initial set of asthmatic and normal individuals were analyzed by fluorescent sequencing on an ABI 377 automated sequencer (Perkin-Elmer Applied Biosystems Division). Sequencing was performed using Amersham Energy Transfer Dye Primer chemistry (Amersham-Pharmacia Biotech) following the standard protocol described by the manufacturer. Primers used for dye primer sequencing are shown in Table 9. Column 1 lists the genes targeted for sequencing. Column 2 lists the specific exons sequenced. Columns 3 and 4 list the forward primer names and the forward primer sequences, respectively. Columns 5 and 6 list the reverse primer names and reverse primer sequences, respectively.

TABLE 9

SEQUENCING PRIMERS

| Gene | Exon | Forward Primer | Forward Sequence | SEQ ID NO: | Reverse Primer | Reverse Sequence | SEQ ID NO: |
|---|---|---|---|---|---|---|---|
| 454 | B | MDSeq_118_454_B_F | CCAGATACTGGGCAAAGGAG | 5677 | MDSeq_118_454_B_R | TGCACCAGGACATGAGGCTAT | 5703 |
| 454 | E | MDSeq_119_454_E_F | AGCCAGCAGAATCCACAGTC | 5678 | MDSeq_119_454_E_R | GGTACCCTGGAAGATCTGGG | 5704 |
| 454 | E | MDSeq_473_454_E_F | TCCTGTTACTCTCCTGCGGT | 5679 | MDSeq_473_454_E_R | CCAACTCACGCAAAGAATGA | 5705 |
| 454 | F | MDSeq_120_454_F_F | ACAGCAAGGAGGAAGTCCG | 5680 | MDSeq_120_454_F_R | TGGAAAAGGGTTCTCCAGC | 5706 |
| 454 | G | MDSeq_121_454_G_F | TTCTCCCAGAGCAAGTGACC | 5681 | MDSeq_121_454_G_R | CCACAGGAAAGGAATACACCA | 5707 |
| 454 | H | MDSeq_122_454_H_F | AGTGCCCTGAATTCCAGTCT | 5682 | MDSeq_122_454_H_R | CATTCATCTTGTTGCCTTGG | 5708 |
| 454 | H | MDSeq_291_454_H_F | AGTGCCCTGAATTCCAGTCT | 5683 | MDSeq_291_454_H_R | CATTCATCTTGTTGCCTTGG | 5709 |
| 454 | K | MDSeq_123_454_K_F | CCCAGAACCCAGCACTTTC | 5684 | MDSeq_123_454_K_R | TAGAATTGCTTTCCAGGCCC | 5710 |
| 454 | L | MDSeq_124_454_L_F | GTCTCCCCTTAATGTGTGGG | 5685 | MDSeq_124_454_L_R | GGGCCTAATTTTCGTGCAT | 5711 |
| 454 | M | MDSeq_125_454_M_F | CCAGCACTTGAACGCATCTA | 5686 | MDSeq_125_454_M_R | CTTCCCTCTATCTTGCCCCT | 5712 |
| 454 | N | MDSeq_126_454_N_F | AGCATGGGGTTCCCATTT | 5687 | MDSeq_126_454_N_R | ATTGGAAGGGGCATAAAAG | 5713 |
| 454 | O | MDSeq_127_454_O_F | CGATTCCTGGACAACCAGA | 5688 | MDSeq_127_454_O_R | GGACAGTTTGCTGTGCCTC | 5714 |
| 454 | O | MDSeq_128_454_O_F | GAACACATGCATGGTCCTGA | 5689 | MDSeq_128_454_O_R | ACAGACAGGATTTCGCCTTG | 5715 |
| 454 | AA | MDSeq_460_454_AA_F | CTCAACTCCACTTTCCTCGG | 5690 | MDSeq_460_454_AA_R | CAAGAAGCGCCAAGTCCTAC | 5716 |
| 454 | AA | MDSeq_470_454_AA_F | TGCATCTTTGAGTGACTGCTG | 5691 | MDSeq_470_454_AA_R | ACTCTGGTCTGCAGTTGGTG | 5717 |
| 454 | AA | MDSeq_471_454_AA_F | TCTTGTGACATTTGCAAGGC | 5692 | MDSeq_471_454_AA_R | TCAGAATGTGCACCTGAAGC | 5718 |

TABLE 9-continued

SEQUENCING PRIMERS

| Gene | Exon | Forward Primer | Forward Sequence | SEQ ID NO: | Reverse Primer | Reverse Sequence | SEQ ID NO: |
|---|---|---|---|---|---|---|---|
| 757 | A | MDSeq_407_757_A_F | CTCGCTTCCCGGTATTGTT | 5693 | MDSeq_407_757_A_R | GCCTCCATGCACAGGTAGTT | 5719 |
| 757 | A | MDSeq_408_757_A_F | TTCTTCCTGTGCTCGCTGTA | 5694 | MDSeq_408_757_A_R | CTCTCCAGTCCCTCCTGGAT | 5720 |
| 757 | A | MDSeq_409_757_A_F | CGTGGACGTGTACTGGAGC | 5695 | MDSeq_409_757_A_R | CTCCAGCTTGTCCGTGTTCT | 5721 |
| 757 | A | MDSeq_410_757_A_F | AGCCAACAGCAGCTACTTCC | 5696 | MDSeq_410_757_A_R | GACTGGGCAGGGATCTCATA | 5722 |
| 757 | A | MDSeq_411_757_A_F | TCTTTATGCTGCTGGTGGTG | 5697 | MDSeq_411_757_A_R | GGGTCCTGTCTTTCCTCTGC | 5723 |
| 757 | A | MDSeq_412_757_A_F | AGGGAAGCTCCTCCAGTGA | 5698 | MDSeq_412_757_A_R | TCTGCCAACCTAGTGCTTCC | 5724 |
| 757 | A | MDSeq_413_757_A_F | TGAACTCAAACGATGTGCAA | 5699 | MDSeq_413_757_A_R | TTCCAACTTCACACATTGCC | 5725 |
| 757 | A | MDSeq_418_757_A_F | CTCGCTTCCCGGTATTGTT | 5700 | MDSeq_418_757_A_R | GCCTCCATGCACAGGTAGTT | 5726 |
| 757 | A | MDSeq_419_757_A_F | AGGGAAGCTCCTCCAGTGA | 5701 | MDSeq_419_757_A_R | TCTGCCAACCTAGTGCTTCC | 5727 |
| 757 | A | MDSeq_421_757_A_F | CAAACTTTGCTGCTCTCCG | 5702 | MDSeq_421_757_A_R | AGTTGGGGTCGTTCTTGTTG | 5728 |
| 757 | A | MDSeq_422_757_A_F | CAAGAAGAGGCCGAAGTTTG | 5729 | MDSeq_422_757_A_R | TACAGCGAGCACAGGAAGAA | 5761 |
| 757 | A | MDSeq_423_757_A_F | GAGGACACGTCCAACGCC | 5730 | MDSeq_423_757_A_R | CTCGTCCGAGCCGTTGTT | 5762 |
| 757 | A | MDSeq_424_757_A_F | CAAGAAGAGGCCGAAGTTTG | 5731 | MDSeq_424_757_A_R | TACAGCGAGCACAGGAAGAA | 5763 |
| 757 | A | MDSeq_425_757_A_F | GAGGACACGTCCAACGCC | 5732 | MDSeq_425_757_A_R | CTCGTCCGAGCCGTTGTT | 5764 |
| 561 | B | MDSeq_169_561_B_F | ACTGCTCTCCCGTGAAAGTG | 5733 | MDSeq_169_561_B_R | CCATCAGCATCTGTGTGACC | 5765 |
| 561 | C | MDSeq_170_561_C_F | TTAAGCCAAGGAAAGGAGCA | 5734 | MDSeq_170_561_C_R | CCTCGATGGGATTTGCTTT | 5766 |
| 561 | E | MDSeq_171_561_E_F | ATCTGTGTGTGTGAGCTGGC | 5735 | MDSeq_171_561_E_R | GGGTGCTGAAAGACAAGAGC | 5767 |
| 561 | H | MDSeq_172_561_H_F | AAATGGTTGACGTCACTGGC | 5736 | MDSeq_172_561_H_R | CTGTGGCTGTGGCAGGAT | 5768 |
| 561 | J | MDSeq_173_561_J_F | TGTTGGAGCTGAGAGACCTG | 5737 | MDSeq_173_561_J_R | CCTCTAAACTCCTTTACCCAGACC | 5769 |
| 561 | H | MDSeq_174_561_H_F | CTCTGGGCAGAGGACTGGT | 5738 | MDSeq_174_561_H_R | TGACAGAGTCCACCAGCAAA | 5770 |
| 561 | M | MDSeq_177_561_M_F | ACCCTGCCTGATGAGAAGAA | 5739 | MDSeq_177_561_M_R | TGTTTGCAAGCAAGACGGTA | 5771 |
| 561 | P | MDSeq_183_561_P_F | AGGCAGATTCCTCAGCTCCT | 5740 | MDSeq_183_561_P_R | CAGAGGGCAAATAACCTCCA | 5772 |
| 561 | G | MDSeq_390_561_G_F | GCATTTCCCAGAAGATGGTG | 5741 | MDSeq_390_561_G_R | TAATCCAGAGCAGAGCAGGG | 5773 |
| 561 | H | MDSeq_392_561_H_F | CTCTGGGCAGAGGACTGGT | 5742 | MDSeq_392_561_H_R | TGACAGAGTCCACCAGCAAA | 5774 |
| 561 | X | MDSeq_401_561_X_F | GAACTGCCCTGTCCATCTGT | 5743 | MDSeq_401_561_X_R | AAATCTCAGGCTGGGAGGAC | 5775 |

TABLE 9-continued

SEQUENCING PRIMERS

| Gene | Exon | Forward Primer | Forward Sequence | SEQ ID NO: | Reverse Primer | Reverse Sequence | SEQ ID NO: |
|---|---|---|---|---|---|---|---|
| 561 | Y | MDSeq_402_561_Y_F | ACAACTCCAATTGGCGAGAA | 5744 | MDSeq_402_561_Y_R | CCAAGCAGAGATAACCAGCA | 5776 |
| 561 | X | MDSeq_415_561_X_F | GAACTGCCCTGTCCATCTGT | 5745 | MDSeq_415_561_X_R | AAATCTCAGGCTGGGAGGAC | 5777 |
| 561 | X | MDSeq_417_561_X_F | GAACTGCCCTGTCCATCTGT | 5746 | MDSeq_417_561_X_R | AAATCTCAGGCTGGGAGGAC | 5778 |
| 214 | B | MDSeq_15_214_B_F | GACAGTCTGCTCCACATCCA | 5747 | MDSeq_15_214_B_R | TGGAGATGAAGTCTTGCTCT | 5779 |
| 214 | C | MDSeq_110_214_C_F | ATATGTTTGCTGGCTTTGGG | 5748 | MDSeq_110_214_C_R | CCCAGGCTGTGTGTCCTCTA | 5780 |
| 214 | E | MDSeq_343_214_E_F | TGCTTCCTGTTTGTCACTGC | 5749 | MDSeq_343_214_E_R | TGAGGACACGATGAACCTGA | 5781 |
| 214 | E | MDSeq_383_214_E_F | ATGGACCTGGGTGAGGACTT | 5750 | MDSeq_383_214_E_R | GCAGTGACAAACAGGAAGCA | 5782 |
| 214 | AA | MDSeq_399_214_AA_F | CGAATAAAGGCGTCGAGAAG | 5751 | MDSeq_399_214_AA_R | CCTTCCTGGAGAGGACGTG | 5783 |
| 224 | BB | MDSeq_403_224_BB_F | AATTGACTTTCCCGCCTTCT | 5752 | MDSeq_403_224_BB_R | GCCCAGCCATCCTTCTACTT | 5784 |
| 422 | E | MDSeq_431_422_E_F | AAGCATCTTGGCGAAGTCAT | 5753 | MDSeq_431_422_E_R | AAAGGAGACACTGCCCAGAA | 5785 |
| 422 | F | MDSeq_434_422_F_F | TGGGCATCCTGATGTACTTG | 5754 | MDSeq_434_422_F_R | GTGGTGCATGCCTATGGTC | 5786 |
| 422 | C | MDSeq_323_436_C_F | TGTGAAAAGTGTTGCTCTGAA | 5755 | MDSeq_323_436_C_R | AGTTTGGGTGACAGAGCG | 5787 |
| 422 | D | MDSeq_324_436_D_F | TGTGAAAAGTGTTGCTCTGAA | 5756 | MDSeq_324_436_D_R | AGTTTGGGTGACAGAGCG | 5788 |
| 422 | E | MDSeq_325_436_E_F | TCTTTAGCTTGGCATCACCC | 5757 | MDSeq_325_436_E_R | ACGCAGAGTTGAAGGTGCTT | 5789 |
| 422 | G | MDSeq_326_436_G_F | CTGCACTCGAGGTGACAGAG | 5758 | MDSeq_326_436_G_R | AGCCAGGAGATACGTTGTGC | 5790 |
| 422 | K | MDSeq_327_436_K_F | GCTAGGCATGGTGAGTGGTT | 5759 | MDSeq_327_436_K_R | CGCAAGGTGCACTGAAGTAG | 5791 |
| 422 | B | MDSeq_340_436_B_F | CCATCAGTGTGCTGAGTGCT | 5760 | MDSeq_340_436_B_R | ACCCAAAATGTGGAAAGGTG | 5792 |
| 422 | L | MDSeq_374_436_L_F | GCACAGGCCTCTCATCTCTT | 5793 | MDSeq_374_436_L_R | AGAGTTGACCCAGCCAAGAA | 5825 |
| 422 | A | MDSeq_375_436_A_F | CAAGATTCCTCTCACCTCGG | 5794 | MDSeq_375_436_A_R | AACAGCAGCAAGCAGCCT | 5826 |
| 422 | C | MDSeq_393_436_C_F | TCACTGTTTTCCATTGGGTTA | 5795 | MDSeq_393_436_C_R | GTAGGGCAAGAGCTGGGATG | 5827 |
| 422 | D | MDSeq_394_436_D_F | TCACTGTTTTCCATTGGGTTA | 5796 | MDSeq_394_436_D_R | GTAGGGCAAGAGCTGGGATG | 5828 |
| 422 | G | MDSeq_395_436_G_F | GGCTGCAGAAAACTTCACTCT | 5797 | MDSeq_395_436_G_R | TGAGTGCTGGTCTTCAGTGG | 5829 |
| 422 | A | MDSeq_396_436_A_F | GCTGGGATGACAGGTGTGAG | 5798 | MDSeq_396_436_A_R | TCCCAAAGTGCTCGGATTAC | 5830 |
| 422 | A | MDSeq_404_436_A_F | AGGAGCCTTTCGTCCTCAA | 5799 | MDSeq_404_436_A_R | ATGTTGCCCAAATTGGTTTC | 5831 |
| 422 | D | MDSeq_414_436_D_F | TCACTGTTTTCCATTGGGTTA | 5800 | MDSeq_414_436_D_R | GTAGGGCAAGAGCTGGGATG | 5832 |

TABLE 9-continued

SEQUENCING PRIMERS

| Gene | Exon | Forward Primer | Forward Sequence | SEQ ID NO: | Reverse Primer | Reverse Sequence | SEQ ID NO: |
|---|---|---|---|---|---|---|---|
| 422 | D | MDSeq_416_436_D_F | TCACTGTTTTCCATTGGGTTA | 5801 | MDSeq_416_436_D_R | GTAGGGCAAGAGCTGGGATG | 5833 |
| 436 | C | MDSeq_323_436_C_F | TGTGAAAAGTGTTGCTCTGAA | 5802 | MDSeq_323_436_C_R | AGTTTGGGTGACAGAGCG | 5834 |
| 436 | D | MDSeq_324_436_D_F | TGTGAAAAGTGTTGCTCTGAA | 5803 | MDSeq_324_436_D_R | AGTTTGGGTGACAGAGCG | 5835 |
| 436 | E | MDSeq_325_436_E_F | TCTTTAGCTTGGCATCACCC | 5804 | MDSeq_325_436_E_R | ACGCAGAGTTGAAGGTGCTT | 5836 |
| 436 | K | MDSeq_327_436_K_F | GCTAGGCATGGTGAGTGGTT | 5805 | MDSeq_327_436_K_R | CGCAAGGTGCACTGAAGTAG | 5837 |
| 436 | B | MDSeq_340_436_B_F | CCATCAGTGTGCTGAGTGCT | 5806 | MDSeq_340_436_B_R | ACCCAAAATGTGGAAAGGTG | 5838 |
| 436 | L | MDSeq_374_436_L_F | GCACAGGCCTCTCATCTCTT | 5807 | MDSeq_374_436_L_R | AGAGTTGACCCAGCCAAGAA | 5839 |
| 436 | C | MDSeq_393_436_C_F | TCACTGTTTTCCATTGGGTTA | 5808 | MDSeq_393_436_C_R | GTAGGGCAAGAGCTGGGATG | 5840 |
| 436 | D | MDSeq_394_436_D_F | TCACTGTTTTCCATTGGGTTA | 5809 | MDSeq_394_436_D_R | GTAGGGCAAGAGCTGGGATG | 5841 |
| 436 | G | MDSeq_395_436_G_F | GGCTGCAGAAAACTTCACTCT | 5810 | MDSeq_395_436_G_R | TGAGTGCTGGTCTTCAGTGG | 5842 |
| 436 | A | MDSeq_404_436_A_F | AGGAGCCTTTCGTCCTCAA | 5811 | MDSeq_404_436_A_R | ATGTTGCCCAAATTGGTTTC | 5843 |
| 436 | D | MDSeq_414_436_D_F | TCACTGTTTTCCATTGGGTTA | 5812 | MDSeq_414_436_D_R | GTAGGGCAAGAGCTGGGATG | 5844 |
| 436 | D | MDSeq_416_436_D_F | TCACTGTTTTCCATTGGGTTA | 5813 | MDSeq_416_436_D_R | GTAGGGCAAGAGCTGGGATG | 5845 |
| 449 | D | MDSeq_462_449_D_F | GTCACACAGCCAGTAGGCAG | 5814 | MDSeq_462_449_D_R | CAGAGAGCAAGAAGGCCAAG | 5846 |
| 449 | F | MDSeq_463_449_F_F | AAGAGAAAATCCGGAGGACC | 5815 | MDSeq_463_449_F_R | ACGGGGTCTCCCTGTGATA | 5847 |
| 449 | A | MDSeq_472_449_A_F | CCAACTTCAGTTTCCCAACG | 5816 | MDSeq_472_449_A_R | CAGGGACGTGGACTCTGATA | 5848 |
| 449 | F | MDSeq_474_449_F_F | CACATATCTGCCCTGCTCCT | 5817 | MDSeq_474_449_F_R | CACCATCAGGATTCTTCACG | 5849 |
| 515 | A | MDSeq_235_515_A_F | CAGCCATCATCTCTTGCCTT | 5818 | MDSeq_235_515_A_R | ATTACTCGATGCAACAGCCC | 5850 |
| 515 | A | MDSeq_236_515_A_F | TGGACCTGGCGTTCTTTATC | 5819 | MDSeq_236_515_A_R | CAGGAGCAACACAATTCCCT | 5851 |
| 515 | A | MDSeq_237_515_A_F | CGTAGTTTCCTGGTAACCATTCA | 5820 | MDSeq_237_515_A_R | TTGGAGATCTTGTTCAGGGC | 5852 |
| 515 | A | MDSeq_239_515_A_F | GGCCATCGTCTTTGTCATCT | 5821 | MDSeq_239_515_A_R | GCGTCAGAGATGAAGCAAGT | 5853 |
| 515 | A | MDSeq_263_515_A_F | CTGCTGTGTGTTCCGAGATG | 5822 | MDSeq_263_515_A_R | GTGTGCAGGAGCCAGAAGAT | 5854 |
| 515 | A | MDSeq_265_515_A_F | GGCCATCGTCTTTGTCATCT | 5823 | MDSeq_265_515_A_R | GCGTCAGAGATGAAGCAAGT | 5855 |
| 570 | C | MDSeq_266_570_C_F | TTGATTGTGTTGCGCTTCTT | 5824 | MDSeq_266_570_C_R | GCATGAGCTCTGGAATCAGG | 5856 |
| 570 | F | MDSeq_268_570_F_F | CACCTGATTATTTTCCCCTCA | 5857 | MDSeq_268_570_F_R | AACCTCCCTTTAACTCAGTC | 5889 |

TABLE 9-continued

SEQUENCING PRIMERS

| Gene | Exon | Forward Primer | Forward Sequence | SEQ ID NO: | Reverse Primer | Reverse Sequence | SEQ ID NO: |
|---|---|---|---|---|---|---|---|
| 570 | I | MDSeq_270_570_I_F | CTGAGTGAGCGGAGGTGTTT | 5858 | MDSeq_270_570_I_R | TTGGCAATTTCTTTCATCAG | 5890 |
| 570 | J | MDSeq_271_570_J_F | CAGACAGCCCACCTCCAG | 5859 | MDSeq_271_570-J_R | CCAAGACTTTGCAATCTCCA | 5891 |
| 570 | I | MDSeq_294_570_I_F | GCTGGCACTGGTGTCTATCA | 5860 | MDSeq_294_570_I_R | CCACGTAGGAATGGAGCTGT | 5892 |
| 581 | E | MDSeq_277_581_E_F | GGGAGATTTGATAGGGTCAGC | 5861 | MDSeq_277_581_E_R | TAGCCAGGCGTGGTGGTA | 5893 |
| 581 | F | MDSeq_345_581_F_F | CCTTCTGAGTAGCTGGGCTC | 5862 | MDSeq_345_581_F_R | TAGACTTCTGACGCTGGGCT | 5894 |
| 698 | B | MDSeq_274_698_B_F | TGTCCTGGACCATCACAGTT | 5863 | MDSeq_274_698_B_R | CGGCTAAGTCTTTCATCACG | 5895 |
| 698 | E | MDSeq_275_698_E_F | GTAAGCATTTGTGTGGCAGC | 5864 | MDSeq_275_698_E_R | TGCCAAGGGCTGTTTCTAAT | 5896 |
| 698 | H | MDSeq_280_698_H_F | TGTGTACAGATTGCCCTACCC | 5865 | MDSeq_280_698_H_R | TGACGAATACAGGATGAAAGTC | 5897 |
| 698 | I | MDSeq_287_698_I_F | GACAGCGCCTCTGGGTATTA | 5866 | MDSeq_287_698_I_R | TGAAACAGGCCAGAGAAGTTT | 5898 |
| 702 | C | MDSeq_111_702_C_F | GTGATGAGGACAAGCTCGG | 5867 | MDSeq_111_702_C_R | ACGTTCCCACGGGACTCA | 5899 |
| 702 | D | MDSeq_112_702_D_F | CAACCCTGCCTGTCGTAACT | 5868 | MDSeq_112_702_D_R | CGCTCCATGAATGGTACAAA | 5900 |
| 702 | A | MDSeq_113_702_A_F | TTCCCACCACTCTCCTGC | 5869 | MDSeq_113_702_A_R | AAGGGTGGGAGCCCTGAC | 5901 |
| 702 | B | MDSeq_114_702_B_F | CCCTCTGATCAGGCACAGTC | 5870 | MDSeq_114_702_B_R | GGATATCTACAGCAGGCCCA | 5902 |
| 702 | F | MDSeq_115_702_F_F | ACGCTTCTTGTAGGACCGAA | 5871 | MDSeq_115_702_F_R | AAGACGATCTTGTGGTCGCT | 5903 |
| 702 | I | MDSeq_116_702_I_F | AGCAGGGAGAGGTCATGTTG | 5872 | MDSeq_116_702_I_R | GGTGTGTGGAGACTCACAGG | 5904 |
| 702 | I | MDSeq_117_702_I_F | CACTAGGGGACAGCTCCGT | 5873 | MDSeq_117_702_I_R | CTGCCATCTAGCACGAGCC | 5905 |
| 702 | B | MDSeq_178_702_B_F | AGGCACAGTCCCGTCTTATG | 5874 | MDSeq_178_702_B_R | GAGAGCTCCTGCTGCTGTCT | 5906 |
| 702 | I | MDSeq_179_702_I_F | TCGTCAGTCAACACAGTCCC | 5875 | MDSeq_179_702_I_R | CCCACTGCAGTCTTGTGC | 5907 |
| 702 | C | MDSeq_191_702_C_F | AGATCGGCCTAGTGGGAAAT | 5876 | MDSeq_191_702_C_R | GCTCTCATTTCCCTCCCTC | 5908 |
| 702 | I | MDSeq_196_702_I_F | CAGTCTTGTGCAAGCCCC | 5877 | MDSeq_196_702_I_R | CACAGTCCTTGCCCTCTGTG | 5909 |
| 702 | I | MDSeq_269_702_I_F | AGCAGGGAGAGGTCATGTTG | 5878 | MDSeq_269_702_I_R | GGTGTGTGGAGACTCACAGG | 5910 |
| 722 | F | MDSeq_63_722_F_F | TAAGTAGGGTTGTGACCGGC | 5879 | MDSeq_63_722_F_R | CACTCTCCCAATCTCCCTGA | 5911 |
| 722 | C | MDSeq_132_722_C_F | ACCTGATAGGTTTTCCCGGT | 5880 | MDSeq_132_722_C_R | ATACAGATGCCCTGGCTCG | 5912 |
| 722 | AA | MDSeq_135_722_AA_F | GACACGATCCTGGCTCTCTG | 5881 | MDSeq_135_722_AA_R | GCCTGGGTGACACAGCTA | 5913 |
| 722 | B | MDSeq_141_722_B_F | TTCAGCCAGGATCTGTTGTG | 5882 | MDSeq_141_722_B_R | GGGCCTGGGAGTTACCTTAT | 5914 |

TABLE 9-continued

SEQUENCING PRIMERS

| Gene | Exon | Forward Primer | Forward Sequence | SEQ ID NO: | Reverse Primer | Reverse Sequence | SEQ ID NO: |
|---|---|---|---|---|---|---|---|
| 722 | B | MDSeq_146_722_B_F | TGCAACACCAGCAGTTTCAC | 5883 | MDSeq_146_722_B_R | ACCTCTACGGCAGGCTGAAT | 5915 |
| 722 | G | MDSeq_150_722_G_F | CAGTGTGCCGAGACATTGTT | 5884 | MDSeq_150_722_G_R | TGAGTCTCCACAAACATAGC | 5916 |
| 722 | A | MDSeq_441_722_A_F | TATTACCCAAAGCTGCACCC | 5885 | MDSeq_441_722_A_R | TCAGGACTCCCTGAGACCC | 5917 |
| 751 | U | MDSeq_455_751_U_F | AGACACTCTCCAGCTCTCGC | 5886 | MDSeq_455_751_U_R | GCAGGACCCTGGACTACAGA | 5918 |
| 751 | W | MDSeq_456_751_W_F | CTCCCAGGTAAATGCCTCAA | 5887 | MDSeq_455_751_W_R | TACTGTCCTCCATTCCCAGC | 5919 |
| GenR2 | F | MDSeq_420_GenR2_F_F | CCCAGGAGACAGAGGTTTCA | 5888 | MDSeq_420_GenR2_F_R | CCCAGACTGGCTTTGAACTC | 5920 |

Single nucleotide polymorphisms (SNPs) that were identified in genes from the disorder region are shown in Table 10. Column 1 lists the gene names. Column 2 lists the exons that either contain the SNPs or are flanked by intronic sequences that contain the SNPs. Column 3 lists the PMP sites for the SNPs. Column 4 lists the localization of the SNPs to exon, intron, or UTR sequences. Column 5 lists the SNP reference sequences and illustrates the SNP nucleotide changes with underlining. Column 6 lists the SEQ ID NOs of the SNP reference sequences. Column 7 lists the base changes of the SNP sequences. Column 8 lists the amino acid changes resulting from the SNP sequences.

The "−" symbols denote polymorphisms which are 5' of the exon and are within the intronic region. The "−" polymorphisms are numbered going from the 3' to 5' direction. The "+" symbols denote polymorphisms which are 3' of the exon and are within the intronic region. The "+" polymorphisms are numbered going from the 5' to 3' direction. The first, second, and third columns, combined, correspond to the SNP names as described herein, e.g., 214_B__1, 214_E__+2, etc. It should be noted that the disclosed SNPs are referred to herein using both short (e.g., 757_A__+4) and long (e.g., Gene 757 A +4) nomenclature.

The genomic sequences corresponding to the genes in Table 10 are shown in Tables 3A and 3A. Taking the information from Tables 3A and 3B, in combination with the last column in Table 4, one of skill in the art could identify the entire genomic sequence of the genes and SNPs described below. For example, the genomic sequence for Gene 214 is contained within BAC clones RP11-702C13 and AC079031 (see Table 4), and the nucleotide sequence of BAC clone RP11-702C13 corresponds to SEQ ID NO:766 to SEQ ID NO:808.

TABLE 10

SNPs

| Gene | Exon | PMP Site | Location | Sequence | SEQ ID NO | PMP | AA change |
|---|---|---|---|---|---|---|---|
| 214 | B | 1 | 3' UTR | CCTGTGCACTCTTGGGCATACGCCTAGGAGTGGAACTGCTG | 5921 | C > T | |
| 214 | C | −1 | Intron | GGGCTCTGCGCCACCTCAACCCAGGCGTTTGTTCCGCAGGA | 5922 | C > T | |
| 214 | E | +1 | Intron | AAGGACACATTCTTATCAGCTGTAGTCACCACGTTCATTAC | 5923 | T > C | |
| 214 | E | +2 | Intron | CCCTGTGACCCTCAACTCCCGGTCCCCTCCAGCCCTGACAG | 5924 | G > C | |
| 214 | E | +3 | Intron | CTCAACTCCCGGTCCCCTC**CAGCCCTGACAGCCACTGTT | 5925 | ** > TC | |
| 214 | E | −1 | Intron | AGGCCGCTTCAACCCTTCCTCCGGCAGGGGCAATGGCCAA | 5926 | C > T | |
| 214 | E | 1 | Exon | CACCTGCATTCCCTCTCTCTGTGAGTGTCCTGGGGCCCGTT | 5927 | G > T | Val > Leu |
| 214 | E | 2 | 3' UTR | GGGCTCTGCGCCACCTCAACCCAGGCGTTTGTTCCGCAGGA | 5928 | C > T | |
| 214 | E | 3 | 3' UTR | TCAGGAGCCTGTGCTTGACCCCCAAATCCGCCCCCCAACTC | 5929 | C > T | Pro > Ser |
| 422 | E | 1 | Exon | CAGACACATGACAACTGCTATGACCAGGCCAAGAAGCTGGA | 5930 | T > C | |
| 422 | E | 2 | Exon | ACCCACACCTATTCATACTCGTGCTCTGGCTCGGCAATCAC | 5931 | G > A | |
| 436 | A | +1 | Intron | GGCCGCGCGGGGGGCGCGGCGGGTGCTGCCCTCGCGTCCGC | 5932 | G > T | |

TABLE 10-continued

SNPs

| Gene | Exon | PMP Site | Location | Sequence | SEQ ID NO | PMP | AA change |
|---|---|---|---|---|---|---|---|
| 436 | A | +2 | Intron | CTGCTTGCTGCTGTTTTAAAGCCACAGCCTGGGCCAGGCGC | 5933 | G > A | |
| 436 | A | -1 | Intron | CCTTCCGGGCCATCATCCGCGATGACGGCGCCGCCAGCAGG | 5934 | G > T | |
| 436 | A | -2 | Intron | GCCCTCCCCCGGGCCCGGG**\*\*\*\*\*\*\***CCCCGACCGCCCGT | 5935 | \*\*\*\*\*\*\* > CCCCGGG | |
| 436 | A | -3 | Intron | TCCTCAAGGGMGAGGCCACTCCCCCCCCCCGCGAGTTCCAT | 5936 | CC > \*\* | |
| 436 | A | 1 | Exon | CGGGCGGCGCGGCCATGGCGGGCTGCTGCGCCGCGCTGGCG | 5937 | G > T | Gly > Cys |
| 436 | A | 2 | Exon | TGAACCGCGCCGTGCAACTGCTCATCCTGGCCTACGTCATC | 5938 | C > T | Leu > Phe |
| 436 | C | +1 | Intron | ATTCCAGATGCGACCACTGTGTGTAAATCAGATGCCAGCTG | 5939 | G > A | |
| 436 | C | +2 | Intron | AACGGTACGAGCTTGTGGCCTCCTGGGGAGGGCAGCCCCTG | 5940 | T > C | |
| 436 | C | +3 | Intron | TGTGGCCTCCTGGGGAGGGCAGCCCCTGAGCAGATCGCCCC | 5941 | A > G | |
| 436 | C | -1 | Intron | CTCTCCGTGAGTCCTCTGAGCGTGGCTTGCCCGTGCTGTCT | 5942 | C > T | |
| 436 | D | -1 | Intron | GTCCACCTGTGTGTGGGGCCGGGCCACGTGGACTTTCTTTT | 5943 | G > A | |
| 436 | D | 1 | Exon | ATTCCAGATGCGACCACTGTGTGTAAATCAGATGCCAGCTG | 5944 | G > A | |
| 436 | E | 1 | Exon | TGCGTAGCTTTCAACGGGTCCGTCAAGACGTGTGAGGTGGC | 5945 | C > T | |
| 436 | G | 1 | Exon | TAGTGGAGAACGCAGGACACAGTTTCCAGGACATGGCCGTG | 5946 | A > G | Ser > Gly |
| 436 | K | +1 | Intron | GGGAGGCCCTTCTGCAGAGGCTGGCACCAGTGTGGCGTGGT | 5947 | C > G | |
| 436 | K | +2 | Intron | RCGACATCTCARGTTGGTGATGATAATGCATGCTCTGAGAA | 5948 | T > A | |
| 436 | K | -1 | Intron | GCTCACTCTCACCCTATGCTAAACTCAGGCGACCGTGCTGT | 5949 | A > G | |
| 436 | K | -2 | Intron | GATTCCAGGCTTCTCAGGAAGGGGCACGCAAAGAATAAGAT | 5950 | G > C | |
| 436 | L | -1 | Intron | CCAGGAGCGCACCTCCCTCCCGCCTGCCACAAGGGGTCCCA | 5951 | C > T | |
| 436 | L | -2 | Intron | GGTGAAGTCCCAGGAGCGCACCTCCCTCCCGCCTGCCACAA | 5952 | C > A | |
| 436 | L | -3 | Intron | TGGCGTGGTGTCCCCGTTAACCCGGGCAGTCCTGCCACTCT | 5953 | C > T | |
| 436 | L | 1 | 3' UTR | AGCAGCTCCTGTGTGTTGTGTGCAGGATCTGTTTGCCCACT | 5954 | T > C | |
| 454 | B | -1 | Intron | AAGTGCCTGCATCCTCCAACCGCCTGCATCCCAACCCGCTGT | 5955 | C > T | |
| 454 | B | 1 | Exon | AGAGGTGAAAGAGGAGATCGTGGAGAATGGAGTGAAGAAGT | 5956 | T > C | Val > Ala |
| 454 | E | -1 | Intron | CTCCTGGAGAACGTCCTCTCCGCAGTTCTTTCACATCTGTG | 5957 | C > T | |
| 454 | E | -2 | Intron | CAAAGCCTAGTCTCTCGCCCGGGTTGAGTTAATGATGTCCC | 5958 | G > A | |
| 454 | E | 1 | Exon | CCCCTATAGGAATTCAGACCGGAAGGTGTGTAGTGTATGAA | 5959 | G > A | Gly > Arg |
| 454 | E | 2 | Exon | AGACCGGAAGGTGTGTAGTGCATGAAGGGAACCAGAAGACC | 5960 | C > T | His > Tyr |
| 454 | E | 3 | Exon | TGTGAAGTCTCTGCCTGGTGCCCCATCGAGGCAGTGGAAGA | 5961 | C > T | |
| 454 | F | +1 | Intron | TCTACTGCTGAGTAATAAATTATCCCAAACCTCAGAAGCCT | 5962 | T > C | |
| 454 | F | -1 | Intron | CATGGGCTCCCTCGGTCCCCACCGTCACTAATGGCCATTTT | 5963 | A > C | |
| 454 | F | -2 | Intron | GGCCCATGGGCTCCCTCGGTCCCCACCGTCACTAATGGCCA | 5964 | C > T | |
| 454 | F | -3 | Intron | TGTATCCATTTCTCTTCATGCATCCCAAAGACCAAGCCAAG | 5965 | C > T | |
| 454 | G | -1 | Intron | CACTCCTGGGAAAGAGACAGATCTGTTTTCAATCGAGATGT | 5966 | A > T | |
| 454 | H | -1 | Intron | GTTCTTCAATCAGCATTTTTCCTCTAAAAACCTTAAGCAAT | 5967 | C > T | |
| 454 | H | -2 | Intron | TTTAGGACAATGAGTTTAACGGTGATGTGTCCCAGACGGGG | 5968 | G > A | |
| 454 | H | 1 | Exon | CCGTTGGTTCCATCACTGCCGTCCCAAATACAGTTTCCGTC | 5969 | G > A | Arg > His |

TABLE 10-continued

SNPs

| Gene | Exon | PMP Site | Location | Sequence | SEQ ID NO | PMP | AA change |
|---|---|---|---|---|---|---|---|
| 454 | H | 2 | Exon | CCGTCCCAAATACAGTTTCCGTCGCCTTGACGACAAGACCA | 5970 | G > A | Arg > His |
| 454 | K | 1 | Exon | GGAAAACAATGTTGAGAAACGGACTCTGATAAAAGTCTTCG | 5971 | G > A | Arg > Gln |
| 454 | L | -1 | Intron | ATTTCACCTGAGTAAACTCTCCCACTCTGTTTTTAGGGAGG | 5972 | C > T | |
| 454 | M | 2 | Exon | CATCGACTTCCTCATCGACACTTACTCCAGTAACTGCTGTC | 5973 | C > G | Thr > Ser |
| 454 | M | +1 | Intron | GTTCACAGGACACCAAGACACGGAGAGATTCCATGAAATCA | 5974 | C > T | |
| 454 | M | +2 | Intron | GTAGTGGATACGTCGCTGGGCTCTACCCCGATCAACCAACT | 5975 | C > T | |
| 454 | M | 1 | Exon | GTCTGCATTCTCCCCAGGCCACTGTGTTCATCGACTTCCTC | 5976 | A > G | Thr > Ala |
| 454 | O | +1 | Intron | CTCACGTCTGTAATCCCAGCGCTTTGGGAGGCCGAGGCAGG | 5977 | G > A | |
| 454 | O | -1 | Intron | ATAAATCATGTAATATTAAATGTAACTTATAAGTTAATAA | 5978 | T > C | |
| 454 | O | 1 | Exon | TGGACAACCAGAGGAGATACAGCTGCTTAGAAAGGAGGCGA | 5979 | A > G | Gln > Arg |
| 454 | O | 2 | Exon | CCTAGATCCAGGGATAGCCCCGTCTGGTGCCAGTGTGGAAG | 5980 | C > T | |
| 454 | O | 3 | Exon | GAGCCACAGGTGCCTGGAGGAGCTGTGCTGCCGGAAAAAGC | 5981 | A > C | Glu > Ala |
| 454 | O | 4 | Exon | CTCTACCAGGAGCCCTTGCTGGCGCTGGATGTGGATTCCAC | 5982 | G > T | |
| 454 | O | 5 | Exon | GGACATGGCTGACTTTGCCATCCTGCCCAGCTGCTGCCGCT | 5983 | T > A | Ile > Asn |
| 454 | O | 6 | Exon | AGGATCCGGAAAGAGTTTCCAAAGAGTGAAGGGCAGTACAG | 5984 | A > G | |
| 515 | A | 1 | Exon | CAGCGTGGTTGTGCGGATCCGCATCTTCTGGCTCCTGCACA | 5985 | G > A | Arg > His |
| 515 | A | 2 | Exon | CGCTGCCTCCAGAGGAAGATGACAGGTGAGCCAGATAATAA | 5986 | G > A | Met > Ile |
| 515 | A | 3 | Exon | GGCGCTCCAGAGGCGTTAATGGCCAACTCCGGTGAGCCATG | 5987 | G > C | MET > Ile |
| 515 | A | 4 | Exon | GTCACTGGACTCGGCCTAAGGTTCCTGGAACTTCCAGATT | 5988 | G > A | Val > Ile |
| 515 | A | 5 | Exon | ACTTCCAGATTCAGAGAATCTGATTTAGGGAAACTGTGGCA | 5989 | C > G | Ile > MET |
| 515 | A | 6 | 3' UTR | CTTCCAGATTCAGAGAATCTGATTTAGGGAAACTGTGGCAG | 5990 | T > C | |
| 515 | A | 7 | Exon | CTGGTTGCAAGGTGTGACCACAGGAATCCTGGAGGAACAGA | 5991 | A > G | |
| 561 | B | +1 | Intron | TGTGGTGGGGAGAGAATGGCCGTTGGCTGCCTGCGAGGGTG | 5992 | C > T | |
| 561 | B | +2 | Intron | CGAGGGTGTGCACAGGTGAAATCGGTTTGGTGACACCTGGC | 5993 | A > G | |
| 561 | B | 1 | Exon | AAGTTCCGGCAGCACGCTGGCAAGATTGACCTGCTGGGTGG | 5994 | C > G | |
| 561 | C | 1 | Exon | GAATATATCCGGCCCCTTCCGCAGCTGGTGACAGGCCGGA | 5995 | G > A | |
| 561 | E | +1 | Intron | CAGGGCTCCCAACATACTCCTGGCCACCCAGCCCTCCTCTC | 5996 | T > C | |
| 561 | E | +2 | Intron | ACTCCGTAGTTACCAGGTTTGCCCTCTTTGACGACTGGAAA | 5997 | G > C | |
| 561 | E | 1 | Exon | AGCTGAGCTGCCCCTCACGGCGGGAAAATACCTCTACGTCT | 5998 | C > T | Ala > Val |
| 561 | G | +2 | Intron | GGGTGGGGAGGGTTTGTTAGGCCCTAACGCAGCAGGGACCG | 5999 | G > A | |
| 561 | G | +3 | Intron | GTGGGGAGGGTTTGTTAGGCCCTAACGCAGCAGGGACCGGC | 6000 | C > T | |
| 561 | G | -1 | Intron | GCCAGGGCTGGTCCCTGAACGCCTCCGTTCCCTTCTGTCCC | 6001 | G > A/C | |
| 561 | H | -1 | Intron | GCTCACCTCGGGCAGCCCGCGAGCCAGCTCTGCTTGTCCAC | 6002 | G > A | |
| 561 | H | -2 | Intron | GGCTCCCCATTGCAGGACCGCGGGGGCTCACCTCGGGCAGC | 6003 | G > * | |
| 561 | H | 1 | Exon | TCACCCAGCCGCATCCTGCCACAGCCACAGGGCACCCCGGT | 6004 | A > G | |
| 561 | J | 1 | Exon | CTGGAAGATGGGGGAAGGAGGCGGCCCAGCGGCACGTCCCA | 6005 | G > A | |
| 561 | M | +1 | Intron | AAAATAGGTAAGCGCAAACCCCTATTCGACCTTCCCTGTGC | 6006 | C > A | |

TABLE 10-continued

SNPs

| Gene | Exon | PMP Site | Location | Sequence | SEQ ID NO | PMP | AA change |
|---|---|---|---|---|---|---|---|
| 561 | M | +2 | Intron | TATGCCAAAGTCATGTAAATGTTGACCAGTGATTTTCTTG | 6007 | G > A | |
| 561 | M | +3 | Intron | GCCAAAGTCATGTAAATGTTGACCAGTGATTTTCTTGGGC | 6008 | G > A | |
| 561 | M | +4 | Intron | TTGGGCAAAAGCCACCCTACGAACCAGGACTGCCAGTAGTC | 6009 | G > A | |
| 561 | P | +1 | Intron | TAAGCAAACCTATTTAGCCTTTTTAATCTCTGTCCCGTTCT | 6010 | T > C | |
| 561 | P | 1 | Exon | GTGTTTTAGGGGAGCTGAATGGGCAGAAAGGCCTTGTGCC | 6011 | T > C | |
| 561 | X | −1 | Intron | TCTGTGAGGGTAAGGAACACATCTGCTCTGTTTACTACTTA | 6012 | A > T | |
| 561 | X | −2 | Intron | TCTCTCTGTGAGGGTAAGGAACACATCTGCTCTGTTTACTA | 6013 | A > C | |
| 561 | X | −3 | Intron | GACACCCAGATTTTCAGGCATCAAGTTCTTTCTTGCCTCAG | 6014 | T > A | |
| 561 | Y | +1 | Intron | ATCTGGGGCCCTGGAGGGAGCGGGCTGGGCCAGGGAGGAAC | 6015 | C > G | |
| 561 | Y | +2 | Intron | TGAGGCACCCAGTGATGTCTCATCCACTATCTGCTGGTTAT | 6016 | C > T | |
| 561 | Y | +3 | Intron | CCAGTGATGTCTCATCCACTATCTGCTGGTTATCTCTGCTT | 6017 | A > G | |
| 561 | Y | −1 | Intron | TACCAAGTCTCTAAACATGGGGGCACCATCTCACATGTCCT | 6018 | G > C | |
| 561 | Y | −2 | Intron | TCCAATTGGCGAGAAGTTCCGTTGCTTTTTAGGACACAGA | 6019 | G > A | |
| 561 | Y | −3 | Intron | CTCCAATTGGCGAGAAGTTCCCGTTGCTTTTTAGGACACAG | 6020 | C > T | |
| 570 | C | −1 | Intron | TTAACCACTTGACCGTATATGGTTTTCATCCTTGAAGACTG | 6021 | G > C | |
| 570 | C | 1 | Exon | TTAGGTTAAAGATCGAGGTCCGGAAGCCACTAGGAGATTTT | 6022 | C > T | Pro > Leu |
| 570 | C | 2 | Exon | AGGCGGTCTTGCTTTTGTGGTCTTCCTCTGTGGCAAGAGCG | 6023 | T > C | Val > Ala |
| 570 | C | 3 | Exon | CTTTTGTGGTCTTCCTCTGTGGCAAGAGCGTTTTCATCACC | 6024 | G > A | Gly > Ser |
| 570 | C | 4 | Exon | GAGGGCAGTGCTTTCACAGACATGTTCAAGATACTGACGTA | 6025 | C > T | |
| 570 | F | +1 | Intron | GTTGTGGATTCAGAATATAGTGCTCACACGCAGTCGTGCCC | 6026 | T > C | |
| 570 | F | −1 | Intron | AAGAAATCTTTTCCCAGTTCCGTTGTCTCTAAACTGAAGAG | 6027 | C > T | |
| 570 | F | 1 | Exon | ATGTTCTTTGTCATGTGCTCGGCCTTTGCTGCAGGTAAGAG | 6028 | G > A | |
| 570 | J | 1 | Exon | TATTTGAACTATTACTTTTTTCTTCTGGCTGCTATTCAAGG | 6029 | T > C | |
| 581 | F | +1 | Intron | TGTGGCCACTTTGCTGTTCAGATTGTTCGGTTTGGCTTGTT | 6030 | G > C | |
| 581 | F | +2 | Intron | CTTTGCTGTTCAGATTGTTCGGTTTGGCTTGTTATTCCTG | 6031 | G > T | |
| 581 | F | −1 | Intron | TGTACTATTGGCCTCAGGCAATCCCACCTCAGCCCCCGAAA | 6032 | A > G | |
| 698 | B | −1 | Intron | AGCCTTGCTATTGGCATCAGCTCTTTATTTTTTTAAAAAAT | 6033 | C > T | |
| 698 | B | 1 | Exon | CGGGGCCCTGGGGGACACTGCCAGGGCCTGCCATGCTCAT | 6034 | G > A | |
| 698 | E | 1 | Exon | AGCCATGGGCATGCAAATGAGAAAAGCAATAATGTAAGTTA | 6035 | G > A | Arg > Lys |
| 698 | I | +1 | Intron | GTCTGCCTGCAAGGTTAGTCACCTGTGGGGTTGCCATTCTA | 6036 | A > G | |
| 698 | I | +2 | Intron | GTTATTGATGGGCCCAGACTTTGGGAAGAACAGACGAGTTG | 6037 | T > C | |
| 698 | I | −1 | Intron | TGATGCTGATACGGGATCTCTTGTATCCTGCTCCTTCTGTG | 6038 | T > C | |
| 702 | A | −1 | Intron | TTTATTAAGACACTTTTCCGGCAGCTGCCCAGGGAAGAGAC | 6039 | G > A | |
| 702 | B | +1 | Intron | ACCTGTCGTGGAGGTGGGTGTGTGGCCAGGGTGAGGAGCGG | 6040 | T > C | |
| 702 | B | +2 | Intron | GGAGGTGGGCGCGTGGCCAGGGTGAGGAACGGGGTCTCCGT | 6041 | G > C | |
| 702 | B | +3 | Intron | GGGTGCGTGGCCAGGGTGAGGAACAGGGTCTCCGTGGAGGT | 6042 | G > C | |
| 702 | B | −2 | Intron | GTGCCAGAGTCAGGGCTCCCACCCTTGCGGATGCTCGGGAT | 6043 | A > G | |

TABLE 10-continued

SNPs

| Gene | Exon | PMP Site | Location | Sequence | SEQ ID NO | PMP | AA change |
|---|---|---|---|---|---|---|---|
| 702 | C | 1 | Exon | GCCCGACAGGCCAGCACCCAGCGAGGTCAGCCGGGCCGAGC | 6044 | G > A | Ala > Thr |
| 702 | D | -1 | Intron | GGGATGCCTCGATGCCGGCTGCGCCAGAGGGATTCTGCAGG | 6045 | G > A | |
| 702 | D | 1 | Exon | CCTCGTAGGGGAGCCCGTAGCGCAGCGGGTCACCCACCGGG | 6046 | C > T | Arg > His |
| 702 | F | -1 | Intron | GCCCTGTCCCGCGCTGCCCAGGGCCCCGCCTCCCAGCCCAC | 6047 | G > * | |
| 702 | F | 1 | Exon | GACGCGGTGGCCCAGATCCGGGGTGAAGCTTTCTTCTTCAA | 6048 | G > C | Arg > Pro |
| 702 | I | 1 | Exon | TGTGTGGAGACTCACAGGCCGATGGATCTGTGGCTGCGGGC | 6049 | G > A | Asp > Asn |
| 702 | I | 3 | Exon | CCCAGAGGTGCATGAGCAGACCTCGTAACCGTCCTCCGAGC | 6050 | G > A | Val > Ile |
| 722 | AA | +2 | Intron | CACGCAGTACAGATAATGCCATCTAGTGATACATCTGCCTG | 6051 | A > G | |
| 722 | AA | -1 | Intron | GGATGTCTTTTAATGTGGCAATATGAAATTAACCATGCATG | 6052 | A > G | |
| 722 | AA | -2 | Intron | GCCACCACACCTGGCCAGGTCGTTTTATTTTAAATGAAGGA | 6053 | C > T | |
| 722 | AA | -3 | Intron | CTCAGGTGATCCATCCGCCTCGGACTCCCAAAGTGCTGAGA | 6054 | C > G | |
| 722 | AA | -4 | Intron | CTGACCTCAGGTGATCCATCCGCCTCGGACTCCCAAAGTGC | 6055 | C > T | |
| 722 | C | 1 | Exon | GGTGGAGGAGATTAGAAACAGTATTGATAAAATAACTCAAT | 6056 | G > C | Ser > Thr |
| 722 | F | +1 | Intron | AAGTGAGTAATGGAGACTCCGTCTTTGTTAAAATCATGTTT | 6057 | G > A | |
| 722 | G | -1 | Intron | AAAAATGCTAACAACTATGATTGTAGTTGCTAACTTATGGT | 6058 | T > C | |
| 757 | A | +1 | Intron | ACTTTTGTTTAGAGCCCTCCGTAAATATACATCTGTGTATT | 6059 | G > C | |
| 757 | A | +2 | Intron | GAGTTGCTTAAAATAGACTCCGGCCTTCACCAATAGTCTCT | 6060 | C > T | |
| 757 | A | +3 | Intron | AGGCCCAGCCCTCAGAAACCCTTCAGTGCTACATTTTGTGG | 6061 | C > T | |
| 757 | A | +4 | Intron | ACCAAGCCAATGTTATAGACGTTTGGACTGATTTGTGGAAA | 6062 | G > C | |
| 757 | A | +5 | Intron | GACTGATTTGTGGAAAGGAGGGGGAAGAGGGAGAAGGATC | 6063 | G > A | |
| 757 | A | +6 | Intron | GTCTAGTGTATTCTCTTCACAGTGCCAGGAAAGAGTGGTTT | 6064 | A > G | |
| 757 | A | -1 | Intron | CCGAGCCGGGGCGCTGTGCGCAGCGCTCGGGCCAGGCCGG | 6065 | G > A | |
| 757 | A | 2 | Exon | TTGCACGAGTTCGCGCCGCTGGTGGAGTACGGCTGCCACGG | 6066 | G > C | |
| 757 | A | 4 | Exon | CTCACCTTCCTCATCGACCCGGCCCGCTTCCGCTACCCCGA | 6067 | G > C | |
| 757 | A | 5 | Exon | AGCCGGAGAAAACCGGCCAGCGTGATCACCAGCGGTGGGAT | 6068 | C > T | |

Example 10

Allele Specific Assay

Once variants were confirmed by sequencing, rapid allele specific assays were designed to type more than 400 individuals (>200 cases and >200 controls) for use in the association studies. All coding SNPs (cSNPs) that resulted in an amino acid change were typed. Neutral polymorphisms were typed if: 1) the polymorphism was present in an exon lacking a cSNP; 2) the polymorphism was present in an exon containing a cSNP, but the two polymorphisms were observed to have different frequencies; or 3) the polymorphism was in an intronic region adjacent to an exon without a cSNP. If results from the association studies appeared positive, additional neutral polymorphisms were typed.

Three types of allele specific assays (ASAs) were used. If the SNP resulted in a mutation that created or abolished a restriction site, RFLPs were obtained from PCR products that spanned the variants, and were subsequently analyzed. If the polymorphism did not result in an RFLP, allele-specific oligonucleotide or exonuclease proofreading assays were used. For the allele-specific oligonucleotide assays, PCR products that spanned the polymorphism were electrophoresed on agarose gels and transferred to nylon membranes by Southern blotting. Oligomers 16-20 bp in length were designed such that the middle base was specific for each variant. The oligomers were labeled and successively hybridized to the membrane in order to determine genotypes.

Table 11A, below, shows the information for the ASAs. Column 1 lists the SNP names. Column 2 lists the specific assays used (RFLP or ASO). Column 3 lists the enzymes used in the RFLP assay (described below). Columns 4 and 6 list the sequences of the primers used in the ASO assay (described below). Columns 5 and 7 list the corresponding SEQ ID NOs for the primers. It should be noted that the disclosed SNPs are referred to herein using both short (e.g., 454_E_2; see Table 11A) and long (e.g., Gene 454 E 2; see Examples 11-13) nomenclature.

TABLE 11A

ASA PRIMERS

| SNP | ASA Type | RFLP Enzyme | ASO Primer1 | SEQ ID NO | ASO Primer2 | SEQ ID NO: | Base change | AA change |
|---|---|---|---|---|---|---|---|---|
| 214_B_1 | RFLP | NdeII | | | | | C > T | |
| 214_C_-1 | ASO | | ACCTCAACCCAGGCGTT | 6069 | CACCTCAACTCAGGCGTTTG | 6080 | C > T | |
| 214_E_+1 | RFLP | PvuII | | | | | T > C | |
| 214_E_+2 | RFLP | MspI | | | | | G > C | |
| 214_E_-1 | RFLP | AvaI | | | | | C > T | |
| 214_E_1 | ASO | | CTCTCTCTGTGAGTGTCC | 6070 | CTCTCTCTTTGAGTGTCCTGG | 6081 | G > T | Val > Leu |
| 214_E_2 | ASO | | ACCTCAACCCAGGCGTTT | 6071 | CCACCTCAACTCAGGCGTTT | 6082 | C > T | |
| 214_E_3 | ASO | | TGCTTGACCCCCAAATCC | 6072 | GTGCTTGACCTCCAAATCCG | 6083 | C > T | Pro > Ser |
| 422_E_2 | ASO | | TCATACTCGTGCTCTGGC | 6073 | TATTCATACTCATGCTCTGGCT | 6084 | G > A | |
| 436_A_+2 | ASO | | TGTTTTAAAGCCACAGCCT | 6074 | CTGTTTTAAAACCACAGCCTGG | 6085 | G > A | |
| 436_A_1 | ASO | | CCCTCGGTTCCCACCGTC | 6075 | GCCATGGCGTGCTGCTGC | 6086 | G > T | Gly > Cys |
| 436_A_2 | ASO | | GTGCAACTGCTCATCCTG | 6076 | CGTGCAACTGTTCATCCTGG | 6087 | C > T | Leu > Phe |
| 436_C_+1 | RFLP | DraIII | | | | | G > A | |
| 436_C_-1 | RFLP | MwoI | | | | | C > T | |
| 436_D_1 | RFLP | DraIII | | | | | G > A | |
| 436_E_1 | RFLP | AvaII | | | | | C > T | |
| 436_G_1 | ASO | | GCAGGACACAGTTTCCAGGA | 6077 | CAGGACACGGTTTCCAG | 6088 | A > G | Ser > Gly |
| 436_K_+1 | RFLP | AlwNI | | | | | C > G | |
| 436_K_-2 | ASO | | CTCAGGAAGGGGCACGCA | 6078 | CTCAGGAACGGGCACGCA | 6089 | G > C | |
| 436_L_-1 | ASO | | CTCCCTCCCGCCTGCCAC | 6079 | CTCCCTCCTGCCTGCCAC | 6090 | C > T | |
| 436_L_-3 | RFLP | XmaI | | | | | C > T | |
| 436_L_1 | RFLP | HhaI | | | | | T > C | |
| 454_B_1 | RFLP | BstUI | | | | | T > C | Val > Ala |
| 454_E_-1 | RFLP | PstI | | | | | C > T | |
| 454_E_1 | RFLP | HpaII | | | | | G > A | Gly > Arg |
| 454_E_2 | RFLP | NlaIII | | | | | C > T | His > Tyr |
| 454_E_3 | RFLP | BanI | | | | | C > T | |
| 454_F_-2 | ASO | | CCCTCGGTCCCCACCGTC | 6091 | CCCTCGGTTCCCACCGTC | 6107 | C > T | |
| 454_G_-1 | RFLP | BstYI | | | | | A > T | |
| 454_H_1 | ASO | | CATCACTGCCGTCCCAAA | 6092 | CCATCACTGCCATCCCAAAT | 6108 | G > A | Arg > His |
| 454_H_2 | ASO | | CAGTTTCCGTCGCCTTGA | 6093 | CAGTTTCCATCGCCTTGACG | 6109 | G > A | Arg > His |
| 454_K_1 | RFLP | AlwNI | | | | | G > A | Arg > Gln |
| 454_L_-1 | RFLP | EarI | | | | | C > T | |
| 454_M_+1 | ASO | | CCAAGACACGGAGAGATT | 6094 | ACCAAGACATGGAGAGATTCC | 6110 | C > T | |
| 454_M_1 | RFLP | MspAI | | | | | A > G | Ala > Thr |
| 454_M_2 | ASO | | CATCGACACTTACTCCAG | 6095 | CATCGACAGTTACTCCAG | 6111 | C > G | Thr > Ser |

TABLE 11A-continued

ASA PRIMERS

| SNP | ASA Type | RFLP Enzyme | ASO Primer1 | SEQ ID NO | ASO Primer2 | SEQ ID NO: | Base change | AA change |
|---|---|---|---|---|---|---|---|---|
| 454_O_1 | RFLP | PvuII | | | | | A > G | Gln > Arg |
| 454_O_3 | RFLP | HhaI | | | | | A > C | Glu > Ala |
| 454_O_5 | ASO | | ACTTTGCCATCCTGCCCAG | 6096 | ACTTTGCCAACCTGCCCAG | 6112 | T > A | Ile > Asn |
| 454_O_6 | RFLP | MboII | | | | | A > G | |
| 515_A_1 | ASO | | GCGGATCCGCATCTTCT | 6097 | TGCGGATCCACATCTTCTGG | 6113 | G > A | Arg > His |
| 515_A_2 | ASO | | GGAAGATGACAGGTGAGC | 6098 | AGGAAGATAACAGGTGAGCC | 6114 | G > A | MET > Ile |
| 515_A_3 | RFLP | HaeIII | | | | | G > C | MET > Ile |
| 515_A_4 | RFLP | Bsu36I | | | | | G > A | Val > Ile |
| 515_A_5 | RFLP | BsmI | | | | | C > G | Ile > MET |
| 515_A_6 | RFLP | BsmI | | | | | T > C | |
| 515_A_7 | RFLP | XcmI | | | | | A > G | |
| 561_B_+1 | ASO | | AGAATGGCCGTTGGCTG | 6099 | GAGAATGGCTGTTGGCTGC | 6115 | C > T | |
| 561_B_1 | ASO | | CACGCTGGCAAGATTGAC | 6100 | CACGCTGGGAAGATTGAC | 6116 | C > G | |
| 561_C_1 | RFLP | MwoI | | | | | G > A | |
| 561_E_+1 | RFLP | MspI | | | | | T > C | |
| 561_E_1 | ASO | | CCTCACGGCGGGAAAAT | 6101 | CCCTCACGGTGGGAAAATAC | 6117 | C > T | Ala > Val |
| 561_H_1 | ASO | | CATCCTGCCACAGCCACAG | 6102 | ATCCTGCCGCAGCCACA | 6118 | A > G | |
| 561_J_1 | ASO | | GGAAGGAGGCGGCCCA | 6103 | GGGAAGGAGACGGCCCAG | 6119 | G > A | |
| 561_M_+1 | ASO | | CGCAAACCCCTATTCGAC | 6104 | GCGCAAACCACTATTCGACC | 6120 | C > A | |
| 561_P_1 | ASO | | GAGCTGAACGGGCAGAA | 6105 | GGAGCTGAATGGGCAGAAAG | 6121 | T > C | Arg > Trp |
| 561_X_-3 | ASO | | ATTTTCAGGCATCAAGTTCTTTC | 6106 | ATTTTCAGGCAACAAGTTCTTTCT | 6122 | T > A | |
| 561_Y_+1 | RFLP | BsrBI | | | | | C > G | |
| 561_Y_-1 | RFLP | Fnu4HI | | | | | G > C | |
| 570_C_1 | RFLP | MspI | | | | | C > T | Pro > Leu |
| 570_C_2 | ASO | | GCTTTTGTGGTCTTCCTCTG | 6123 | CTTTTGTGGCCTTCCTCT | 6135 | T > C | Val > Ala |
| 570_C_3 | ASO | | CTTTCACAGACATGTTCAAG | 6124 | GCTTTCACAGATATGTTCAAGA | 6136 | G > A | Gly > Ser |
| 570_C_4 | RFLP | AflIII | | | | | C > T | |
| 570_F_1 | RFLP | DdeI | | | | | G > A | |
| 581_F_+2 | ASO | | AGATTGTTCGGTTTGGCTT | 6125 | TCAGATTGTTCTGTTTGGCTTG | 6137 | G > T | |
| 698_E_1 | ASO | | CATGCAAATGAGAAAAGCAAT | 6126 | GGCATGCAAATGAAAAAAGCAAT | 6138 | G > A | Arg > Lys |
| 698_I_+1 | ASO | | CCCCACAGGTGACTAACCTT | 6127 | CCCACAGGCGACTAACC | 6139 | A > G | |
| 702_A_-1 | ASO | | ACTTTTCCGGCAGCTGC | 6128 | ACTTTTCCGTCAGCTGCCC | 6140 | G > A | |
| 702_B_+1 | ASO | | AGGTGGGTGTGTGGCCAG | 6129 | GGTGGGTGCGTGGCCA | 6141 | T > C | |
| 702_B_+3 | ASO | | AGGGTGAGGAACGGGGT | 6130 | AGGGTGAGCAACGGGGT | 6142 | G > C | |
| 702_C_1 | RFLP | HaeII | | | | | G > A | Ala > Thr |
| 702_D_1 | RFLP | HhaI | | | | | C > T | Arg > His |
| 702_F_1 | RFLP | NciII | | | | | G > C | Arg > Pro |

TABLE 11A-continued

ASA PRIMERS

| SNP | ASA Type | RFLP Enzyme | ASO Primer1 | SEQ ID NO | ASO Primer2 | SEQ ID NO: | Base change | AA change |
|---|---|---|---|---|---|---|---|---|
| 702_I_1 | RFLP | XcmI | | | | | G > A | Asp > Asn |
| 702_I_3 | RFLP | DpnII | | | | | G > A | Val > Ile |
| 722_C_1 | ASO | | GATTAGAAACAGTATTGATAAA | 6131 | GATTAGAAACACTATTGATAAA | 6143 | G > C | Ser > Thr |
| 722_F_+1 | RFLP | Tth111 | | | | | G > A | |
| 722_G_-1 | ASO | | AACAACTATGATTGTAGTTGCTA | 6132 | CAACTATGACTGTAGTTGC | 6144 | T > C | |
| 757_A_+4 | RFLP | HpyCH4IV | | | | | G > C | |
| 757_A_-1 | ASO | | GCTGTGCGCAGCGCTC | 6133 | CGCTGTGCACAGCGCTCG | 6145 | G > A | |
| 757_A_2 | ASO | | GCGCCGCTGGTGGAGTA | 6134 | GCGCCGCTCGTGGAGTA | 6146 | G > C | |
| 757_A_4 | RFLP | Sau96I | | | | | G > C | |
| 757_A_5 | RFLP | Cac8I | | | | | C > T | |

1. RFLP Assay: The amplicon containing the polymorphism was PCR amplified using primers that generated fragments for sequencing (sequencing primers) or SSCP (SSCP primers). The appropriate population of individuals was PCR amplified in 96-well microtiter plates. Enzymes were purchased from NEB. The restriction cocktail containing the appropriate enzyme for the particular polymorphism was added to the PCR product. The reaction was incubated at the appropriate temperature according to the manufacturer's recommendations for 2-3 hr, followed by a 4° C. incubation. After digestion, the reactions were size fractionated using the appropriate agarose gel depending on the assay specifications (2.5%, 3%, or Metaphor, FMC Bioproducts). Gels were electrophoresed in 1×TBE buffer at 170 V for approximately 2 hr. The gel was illuminated using UV, and the image was saved as a Kodak 1D file. Using the Kodak 1D image analysis software, the images were scored and the data was exported to Microsoft® Excel (Microsoft Corp.; Redmond, Wash.).

2. ASO assay: The amplicon containing the polymorphism was PCR amplified using primers that generated fragments for sequencing (sequencing primers) or SSCP (SSCP primers). The appropriate population of individuals was PCR amplified in 96-well microtiter plates and re-arrayed into 384-well microtiter plates using a Tecan Genesis RSP200. The amplified products were loaded onto 2% agarose gels and size fractionated at 150V for 5 min. The DNA was transferred from the gel to Hybond N+ nylon membrane (Amersham-Pharmacia) using a Vacuum blotter (Bio-Rad). The filter containing the blotted PCR products was transferred to a dish containing 300 ml pre-hybridization solution (5×SSPE (pH 7.4), 2% SDS, 5×Denhardt's). The filter was incubated in pre-hybridization solution at 40° C. for over 1 hr. After pre-hybridization, 10 ml of the pre-hybridization solution and the filter were transferred to a washed glass bottle. The allele-specific oligonucleotides (ASO) were designed to contain the polymorphism in the middle of the nucleotide sequence. The size of the oligonucleotide was dependent upon the GC content of the sequence around the polymorphism. Those ASOs that had a G or C polymorphism were designed so that the $T_m$ was between 54-56° C. Those ASOs that had an A or T polymorphism were designed so that the $T_m$ was between 60-64° C. All oligonucleotides were phosphate-free at the 5' ends and purchased from GibcoBRL. For each polymorphism, 2 ASOs were designed to yield one ASO for each strand.

The ASOs that represented each polymorphism were resuspended at a concentration of 1 μg/μl. Each ASO was end-labeled with γ-ATP$^{32}$ (6000 Ci/mmol) (NEN) using T4 polynucleotide kinase according to manufacturer recommendations (NEB). The end-labeled products were removed from the unincorporated γ-ATP$^{32}$ using a Sephadex G-25 column according to the manufacturer's instructions (Amersham-Pharmacia). The entire end-labeled product of one ASO was added to the bottle containing the appropriate filter and 10 ml hybridization solution. The hybridization reaction was placed in a rotisserie oven (Hybaid) and left at 40° C. for a minimum of 4 hr. The other ASO was stored at −20° C.

After the prerequisite hybridization time had elapsed, the filter was removed from the bottle and transferred to 1 L of wash solution (0.1×SSPE (pH 7.4) and 0.1% SDS) pre-warmed to 45° C. After 15 min, the filter was transferred to another liter of wash solution (0.1×SSPE (pH 7.4) and 0.1% SDS) pre-warmed to 50° C. After 15 min, the filter was wrapped in Saran Wrap®, placed in an autoradiograph cassette, and an X-ray film (Kodak) was placed on top of the filter. Typically, an image was visible within 1 hr. After an image was captured on film following the 50° C. wash, images were captured following wash steps at 55° C., 60° C. and 65° C. The best image was selected.

The ASO was removed from the filter by adding 1 L of boiling strip solution (0.1×SSPE (pH 7.4) and 0.1% SDS). This was repeated two more times. After removing the ASO, the filter was pre-hybridized in 300 ml pre-hybridization solution (5×SSPE (pH 7.4), 2% SDS, and 5×Denhardt's) at 40° C. for over 1 hr. The second end-labeled ASO corresponding to the other strand was removed from storage at −20° C. and thawed at RT. The filter was placed into a glass bottle along with 10 ml hybridization solution and the entire end-labeled product of the second ASO. The hybridization reaction was placed in a rotisserie oven (Hybaid Limited; United Kingdom) and left at 40° C. for a minimum of 4 hr. After the hybridization, the filter was washed at various temperatures and images captured on film as described above. The best image for each ASO was converted into a digital image by scanning the film into Adobe® Photoshop®. These images were overlaid using Graphic Converter, and the overlaid images were scored.

3. Exonuclease Proofreading Assay:

Exonuclease Proofreading Assays (EPAs) were also employed (see U.S. Pat. No. 5,391,480). Briefly, primers corresponding to the polymorphisms of interest were designed to contain fluorescent tags at the 3' ends. The primers were designed such that the 3' ends contained the variant or consensus nucleotides. Mismatched bases at the 3' ends were removed by an exonuclease proofreading enzyme (Pwo DNA polymerase; Roche, Germany; Cat. No. 1-644-855) in the PCR reaction. Where bases were matched, the resulting PCR products contained the tagged bases. The tagged bases were detected by gel electrophoresis or florescent polarization. Examples of primers used for EPA analysis of Gene 436, Gene 454, Gene 570, and Gene 698 are shown in the Table 11B, below.

TABLE 11B

EPA PRIMERS

| SNP | Primer Seq. (5'-3') | SEQ ID NO: |
|---|---|---|
| 436_K_-2 | TTATTCTTTGCGTGCCC | 6147 |
| 436_K_-2 | ACCTTCCCTTCTCCAAGACC | 6148 |
| 436_K_-2 | ATTCCAGGCTTCTCAGGAA | 6149 |
| 436_K_-2 | CGCCTGAGTTTAGCATAGGG | 6150 |
| 454_F_-2 | CATGGGCTCCCTCGGT | 6151 |
| 454_F_-2 | CCGGGGAAGTCGATATTGTT | 6152 |
| 454_F_-2 | CATGGGCTCCCTCGGT | 6153 |
| 570_C_2 | GCGGTCTTGCTTTTGTGG | 6154 |
| 570_C_2 | TTACTCTGGCGCTCTCCACT | 6155 |
| 570_C_2 | CGGTCTTGCTTTTGTGG | 6156 |
| 698_I_+1 | AGAATGGCAACCCCACAGG | 6157 |
| 698_I_+1 | GCTGGTTCTCACGCTGCATATTT | 6158 |
| 698_I_+1 | GTAGAATGGCAACCCCACAGG | 6159 |

Example 11

Association Study Analysis

1. Case-Control Study: In order to determine whether polymorphisms in candidate genes were associated with the asthma phenotype, association studies were performed using a case-control design. In a well-matched design, the case-control approach is more powerful than the family based transmission disequilibrium test (TDT) (N.E. Morton and A. Collins, 1998, *Proc. Natl. Acad. Sci. USA* 95:11389-93). Case-control studies are, however, sensitive to population admixture.

To avoid issues of population admixture, which can bias case-control studies, unaffected controls were collected in both the US and the UK. A total of three hundred controls were collected, 200 in the UK and 100 in the US. Inclusion into the study required that the control individual was 1) negative for asthma (as determined by self-report of never having asthma); 2) had no first degree relatives with asthma; and 3) was negative for eczema and symptoms indicative of atopy for the past 12 months. Data from an abbreviated questionnaire similar to that administered to the affected sib pair families were collected. Results from skin prick tests to 4 common allergens were also collected. The results of the skin prick tests were used to select a subset of controls that were most likely to be asthma and atopy negative.

A subset of unrelated cases was selected from the affected sib pair families based on the evidence for linkage at the chromosomal location near a given gene. One affected sib demonstrating identity-by-descent (IBD) at the appropriate marker loci was selected from each family. As the appropriate cases may vary for each gene in the region, a larger collection of individuals who were IBD across a larger interval was genotyped. A subset of this collection was used in the analyses. On average, 115 IBD affected individuals and 200 controls were compared for allele and genotype frequencies. This number provided 80% power to detect a difference of 5% or greater between the two groups for a rare allele ($\leq$5%) at a 0.05 level of significance. For a common allele (50%), the number provided 80% power to detect a difference of 10% or more between the two groups.

For each polymorphism, the frequency of the alleles in the control and case populations was compared using a Fisher's exact test. A mutation that increased susceptibility to the disease was expected to be more prevalent in the cases than in the controls, while a protective mutation was expected to be more prevalent in the control group. Similarly, the genotype frequencies of the SNPs were compared between cases and controls. P-values for the allele test were plotted against a coordinate system based on genomic sequence to visualize regions where allelic association was present. A small p-value (or a large value of −log(p) as plotted in the figures described below) was deemed indicative of an association between the SNPs and the disease phenotype. The analysis was repeated for the US and UK populations, separately, to correct for genetic heterogeneity.

2. Association test with individual SNPs: Chromosomal regions harboring asthma susceptibility genes were identified by association studies using the SNP typing data. Four separate phenotypes were used in these analyses: asthma, bronchial hyper-responsiveness, total IgE, and specific IgE.

a. Asthma Phenotype: A coordinate system was developed based on available genomic sequence, and was used to plot significance values of SNPs and haplotypes according to their relative location along the chromosome (as shown in FIGS. 11-26). Overlapping genomic sequences were assembled to provide a framework for estimation of relative physical distance between SNPs. Where necessary, gaps were introduced to provide contiguity.

Figure 11:
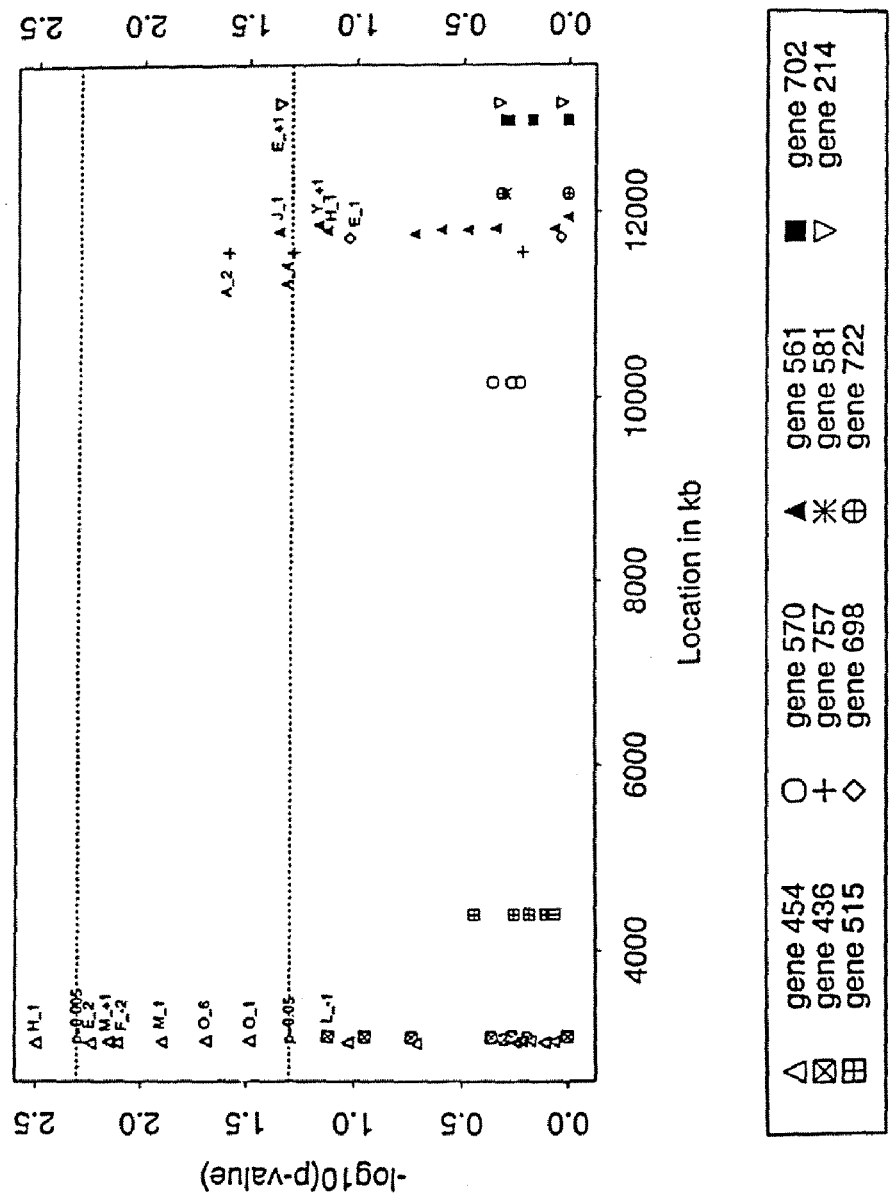
FIG. 11 shows the significance ($-\log_{10}$(p-value)) for the comparison of SNP allele frequencies in cases (asthma) and controls in the combined population against the relative location (Kb) of SNPs along chromosome 12.
Figure 12:
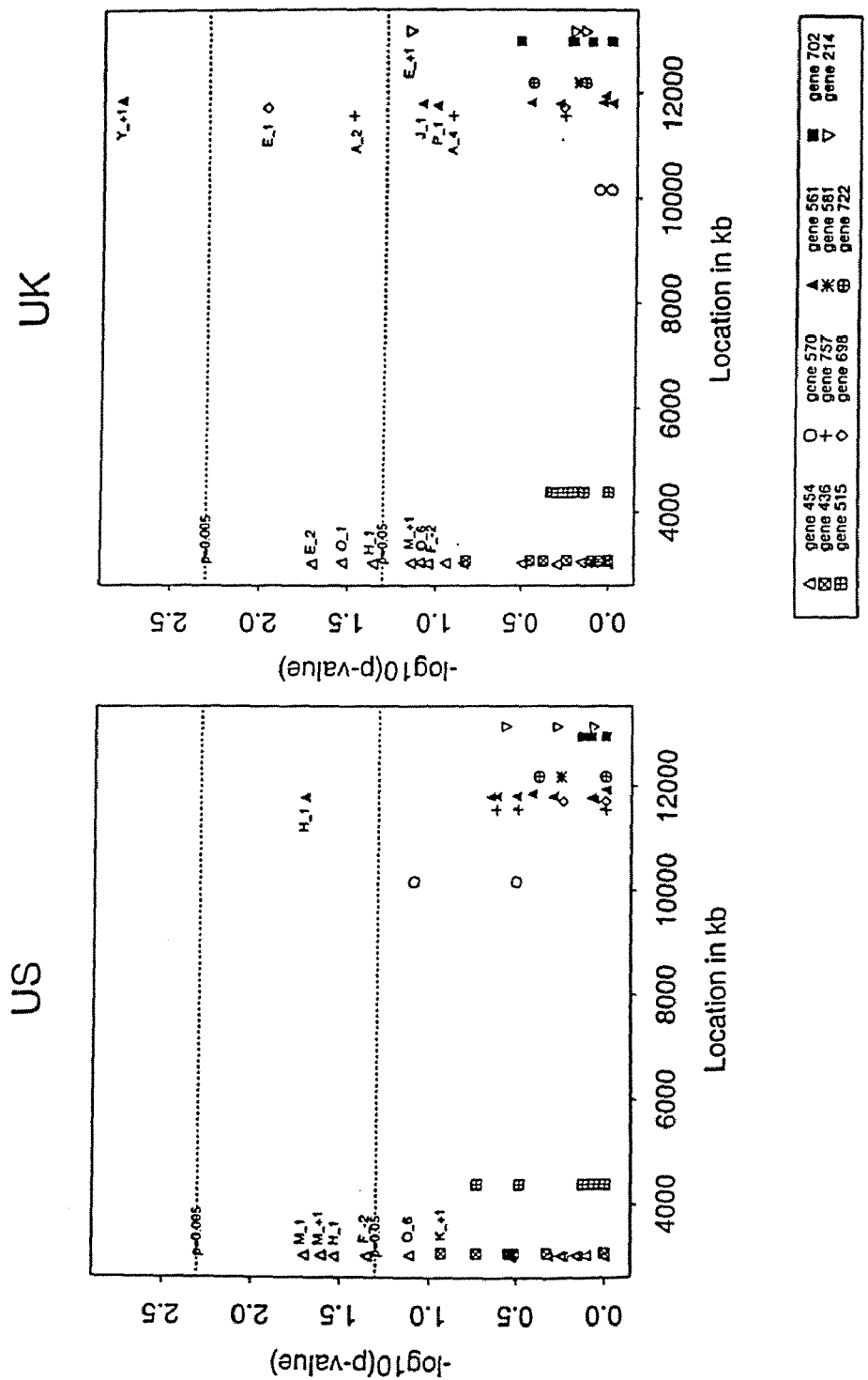
FIG. 12 shows the significance ($-\log_{10}$(p-value)) for the comparison of SNP allele frequencies in cases (asthma) and controls in the US and UK populations against the relative location (Kb) of SNPs along chromosome 12.

The significance levels (p-values) for allelic association of all typed SNPs to the asthma phenotype are plotted in FIG. 11 (combined population) and FIG. 12 (US and UK populations, separately). Frequencies and p-values for SNPs associated with the asthma phenotype are shown in Tables 12A, 12B, and 12C for the combined population and for the UK and US populations, separately. Column 1 lists the SNP names, which were derived from the gene numbers and closest exons. Columns 2 and 3 list the control ("CNTL") allele frequencies and sample sizes ("N"), respectively. Columns 4 and 5 list the affected individuals ("CASE") allele frequencies and sample sizes ("N"), respectively. Columns 6 and 7 list the p-value for the comparison between the case and control allele and genotype frequencies, respectively.

SNPs in Gene 454, Gene 757, Gene 561, and Gene 214 showed a significant association with the asthma phenotype in the combined population, when comparing the allele frequency in the case and control groups (Table 12A). When analyzing the population separately, SNPs in Gene 454, Gene 757, Gene 698 and Gene 561 showed a significant association in the UK population alone (Table 12B), while SNPs in Gene 454 and Gene 561 showed a similar association with the phenotype in the US population (Table 12C). Additional significant results emerged when comparing the genotype frequency of the control and case groups. SNPs in Gene 436 in the combined population, and in Gene 515 and Gene 570 in the US population, also reached statistical significance.

Seven SNPs in Gene 454 showed allelic frequencies significantly different in the cases versus the controls in the combined population. Two SNPs in exon were more frequent in the controls (19% and 42%, respectively) than in the cases (12% and 33%, respectively). These differences were statistically significant (p=0.03 and p=0.02), with similar p-values obtained for the genotype comparison (p=0.03 and p=0.01). The first SNP also reached statistical significance in the UK population (p=0.03), while the second SNP had a significant genotype p-value (p=0.02) in the UK population. The first SNP in exon results in an amino acid change of glutamine to arginine. In addition, one SNP in exon M, and one just outside exon M, reached statistical significance in both the US and combined population. These two SNPs showed high linkage disequilibrium and had similar allele frequencies. For the exonic SNP, the p-value was 0.01 for the combined population, and the allele frequencies were 42% in controls versus 32% in cases. The p-value was 0.02 for the US sample, and the allele frequencies were 41% in controls versus 23% of cases. The genotype comparison was significant (p=0.02) in the combined population. The intronic SNP showed significance for both the allele and genotype tests in the combined population (p=0.007), for the allele comparison in the US (p=0.02), and for the genotype comparison in the UK (p=0.03).

Three other SNPs reach statistical significance in the combined population, and in the US or UK populations, alone: 1) SNP E 2, which results in a histidine to tyrosine amino acid change (allele frequencies of 49% in controls and 60% in cases, p=0.006 and p=0.007 for the allele and genotype test respectively, in the combined population; p=0.02 for both allele and genotype tests in the UK population, allele frequencies of 51% in controls and 63% in cases); 2) SNP H 1, an arginine to histidine amino acid change, (p=0.003 for the allele and p=0.002 for the genotype tests in the combined population, allele frequencies of 22% in the controls and 33% in the cases; p=0.04 in the UK population, allele frequencies of 23% in controls and 32% in cases; p=0.03 for the allele and p=0.02 for the genotype test in the US population, allele frequencies of 20% in controls and 36% in cases); and 3) intronic SNP F −2 (p=0.008 for the allele and p=0.003 for the genotype tests in the combined population, allele frequencies of 35% in controls and 24% in cases; p=0.04 for the allele and p=0.03 for the genotype tests in US population, allele frequencies of 37% in cases and 21% in controls).

One SNP in Gene 757 reached statistical significance for the allele test in the combined and UK populations (SNP A 2; p=0.03 in the combined population, allele frequencies of 18% in controls and 26% in cases; p=0.03 in the UK sample, allele frequencies of 17% in controls and 26% in cases). Another SNP in the same Exon (A 4) reached statistical significance for the genotype test in the combined population (p<0.05).

Multiple SNPs in Gene 561 reached statistical significance in either the combined population or in the US or UK populations, separately. SNP J 1 was significant in the combined population (p=0.04, allele frequencies of 15% in controls and 9% in cases); SNP Y +1 was significant in the UK sample (p=0.002, allele frequencies of 5% in controls and not present in cases); and SNP H 1 was significant in the US population (p=0.02, allele frequencies of 10% in controls and 25% in cases). SNP H 1 also showed a significant genotype p-value in the combined population (p=0.03) and in the US population (p=0.01), while SNP Y +1 showed a significant genotype p-value (p=0.001) in the UK population. None of these SNPs resulted in amino acid changes.

A single SNP in Gene 214 reached statistical significance in the combined population (p=0.04, allele frequencies of 28% in controls and 36% in cases).

For Gene 436, one SNP (E 1) showed a significant genotype p-value in the combined population (p=0.04).

One SNP in Gene 698 (E 1) reached statistical significance in the UK population (p=0.01 for the allele test, p=0.02 for the genotype test, allele frequencies of 5% in controls and 12% in cases). This SNP results in an arginine to lysine amino acid change.

SNPs in two genes, Gene 515 and Gene 570, showed significant genotype p-values in the US population alone (515 A 1, p=0.007; 515 A 2, p=0.005; 515 A 4; p=0.001; 570 F 1 p=0.007).

TABLE 12A

ASSOCIATION ANALYSIS OF ASTHMA PHENOTYPE
COMBINED US/UK POPULATION
Combined US and UK

| GENE_EXON | FREQUENCIES | | | | ALLELE P-VALUE | GENO-TYPE P-VALUE |
|---|---|---|---|---|---|---|
| | CNTL | N | CASE | N | | |
| 454_B_1 | 7.1% | 183 | 4.1% | 98 | 0.1939 | 0.1793 |
| 454_E_−1 | 25.8% | 213 | 27.0% | 113 | 0.7792 | 0.9290 |
| 454_E_1 | 0.8% | 179 | 2.7% | 112 | 0.0939 | 0.2361 |
| 454_E_2 | 49.1% | 217 | 60.3% | 117 | 0.0058 | 0.0070 |
| 454_F_−2 | 34.6% | 211 | 24.3% | 115 | 0.0078 | 0.0030 |
| 454_G_−1 | 8.4% | 215 | 9.7% | 113 | 0.5651 | 0.4447 |
| 454_H_1 | 22.1% | 204 | 33.0% | 112 | 0.0032 | 0.0022 |
| 454_H_2 | 2.0% | 198 | 2.6% | 115 | 0.7801 | 0.7776 |
| 454_K_1 | 1.9% | 215 | 2.6% | 114 | 0.5738 | 0.5698 |
| 454_L_−1 | 6.7% | 217 | 5.5% | 109 | 0.6119 | 0.9390 |
| 454_M_1 | 42.3% | 208 | 31.6% | 98 | 0.0128 | 0.0197 |
| 454_M_2 | 6.8% | 212 | 6.3% | 111 | 0.8691 | 1.0000 |
| 454_M_+1 | 43.2% | 212 | 32.3% | 113 | 0.0071 | 0.0069 |
| 454_O_1 | 19.1% | 215 | 12.2% | 107 | 0.0330 | 0.0287 |
| 454_O_3 | 17.6% | 216 | 19.2% | 112 | 0.6692 | 0.1280 |
| 454_O_5 | 3.0% | 215 | 1.9% | 106 | 0.6018 | 0.5968 |
| 454_O_6 | 42.4% | 198 | 32.9% | 111 | 0.0205 | 0.0138 |
| 436_A_1 | 1.2% | 203 | 1.9% | 106 | 0.5013 | 0.3944 |
| 436_C_−1 | 15.3% | 216 | 13.6% | 114 | 0.6440 | 0.6479 |
| 436_D_1 | 5.0% | 212 | 3.5% | 114 | 0.4336 | 0.7884 |
| 436_E_1 | 46.3% | 214 | 40.6% | 112 | 0.1844 | 0.0382 |
| 436_G_1 | 10.4% | 212 | 10.6% | 109 | 1.0000 | 0.5823 |
| 436_K_−2 | 14.9% | 204 | 10.4% | 111 | 0.1121 | 0.1078 |
| 436_K_+1 | 4.7% | 200 | 3.6% | 112 | 0.5448 | 0.8901 |
| 436_L_−1 | 4.4% | 217 | 7.8% | 115 | 0.0757 | 0.0674 |
| 436_L_1 | 1.9% | 214 | 1.8% | 113 | 1.0000 | 1.0000 |
| 515_A_1 | 43.1% | 211 | 42.0% | 106 | 0.7990 | 0.2609 |
| 515_A_2 | 37.2% | 211 | 35.2% | 105 | 0.6615 | 0.2919 |
| 515_A_3 | 7.4% | 217 | 6.6% | 113 | 0.8734 | 0.8683 |
| 515_A_4 | 43.5% | 208 | 42.1% | 108 | 0.7995 | 0.1089 |
| 515_A_5 | 4.1% | 207 | 2.3% | 108 | 0.3603 | 0.3514 |
| 515_A_7 | 2.4% | 213 | 1.4% | 110 | 0.5583 | 0.5540 |
| 570_C_2 | 9.5% | 215 | 7.7% | 91 | 0.5379 | 0.8353 |
| 570_C_4 | 9.5% | 217 | 7.2% | 90 | 0.4358 | 0.7645 |
| 570_F_1 | 47.9% | 215 | 50.6% | 89 | 0.5929 | 0.5071 |
| 757_A_2 | 18.1% | 210 | 26.3% | 99 | 0.0252 | 0.0756 |
| 757_A_4 | 1.6% | 218 | 4.6% | 98 | 0.0504 | 0.0476 |
| 757_A_+4 | 39.4% | 216 | 37.0% | 104 | 0.6034 | 0.4277 |

TABLE 12A-continued

ASSOCIATION ANALYSIS OF ASTHMA PHENOTYPE COMBINED US/UK POPULATION
Combined US and UK

| GENE_EXON | FREQUENCIES CNTL | N | CASE | N | ALLELE P-VALUE | GENOTYPE P-VALUE |
|---|---|---|---|---|---|---|
| 698_E_1 | 6.9% | 217 | 10.9% | 105 | 0.0925 | 0.1182 |
| 698_I_+1 | 32.5% | 209 | 31.9% | 102 | 0.9273 | 0.8968 |
| 561_P_1 | 34.0% | 209 | 39.4% | 104 | 0.1854 | 0.4550 |
| 561_J_1 | 14.9% | 208 | 9.0% | 105 | 0.0435 | 0.1090 |
| 561_H_1 | 9.0% | 212 | 13.7% | 102 | 0.0722 | 0.0339 |
| 561_E_1 | 0.0% | 178 | 0.6% | 87 | 0.3283 | 0.3283 |
| 561_C_1 | 0.2% | 217 | 1.0% | 104 | 0.2465 | 0.2462 |
| 561_B_+1 | 13.4% | 212 | 16.1% | 90 | 0.4450 | 0.6122 |
| 561_B_1 | 48.3% | 210 | 47.2% | 90 | 0.8585 | 0.9707 |
| 561_Y_+1 | 4.7% | 212 | 1.5% | 100 | 0.0658 | 0.0607 |
| 561_X_-3 | 31.3% | 214 | 30.9% | 105 | 1.0000 | 0.4464 |
| 581_F_+2 | 24.3% | 216 | 21.8% | 110 | 0.4956 | 0.7746 |
| 722_C_1 | 33.0% | 209 | 30.2% | 111 | 0.4779 | 0.8190 |
| 722_F_+1 | 1.4% | 217 | 1.4% | 111 | 1.0000 | 1.0000 |
| 702_A_-1 | 7.0% | 215 | 6.9% | 109 | 1.0000 | 0.9377 |
| 702_C_1 | 49.3% | 213 | 46.4% | 111 | 0.5081 | 0.1817 |
| 702_D_1 | 16.1% | 217 | 14.0% | 111 | 0.4948 | 0.7583 |
| 702_F_1 | 3.7% | 217 | 4.5% | 111 | 0.6734 | 0.6706 |
| 702_I_1 | 18.6% | 204 | 20.8% | 101 | 0.5159 | 0.5125 |
| 702_I_3 | 0.7% | 217 | 0.4% | 111 | 1.0000 | 1.0000 |
| 214_B_1 | 17.8% | 214 | 20.3% | 118 | 0.4666 | 0.1354 |
| 214_E_-1 | 48.8% | 202 | 48.2% | 110 | 0.9332 | 0.8832 |
| 214_E_+1 | 28.3% | 217 | 36.0% | 118 | 0.0445 | 0.1073 |

TABLE 12B

ASSOCIATION ANALYSIS OF ASTHMA PHENOTYPE UK POPULATION
UK population

| GENE_EXON | FREQUENCIES CNTL | N | CASE | N | ALLELE P-VALUE | GENOTYPE P-VALUE |
|---|---|---|---|---|---|---|
| 454_B_1 | 7.3% | 109 | 5.0% | 70 | 0.5085 | 0.4932 |
| 454_E_-1 | 25.2% | 137 | 29.8% | 84 | 0.3206 | 0.5120 |
| 454_E_1 | 1.0% | 104 | 3.7% | 82 | 0.1456 | 0.2293 |
| 454_E_2 | 51.4% | 140 | 62.6% | 87 | 0.0200 | 0.0163 |
| 454_F_-2 | 33.2% | 137 | 25.3% | 87 | 0.0908 | 0.1154 |
| 454_G_-1 | 8.3% | 138 | 11.3% | 84 | 0.3185 | 0.3097 |
| 454_H_1 | 23.0% | 135 | 31.9% | 83 | 0.0441 | 0.0674 |
| 454_H_2 | 2.3% | 131 | 2.3% | 86 | 1.0000 | 1.0000 |
| 454_K_1 | 2.5% | 138 | 3.0% | 84 | 0.7711 | 0.7684 |
| 454_L_-1 | 5.7% | 140 | 5.0% | 80 | 0.8301 | 0.8286 |
| 454_M_1 | 42.9% | 133 | 34.7% | 72 | 0.1144 | 0.1532 |
| 454_M_2 | 5.9% | 136 | 6.1% | 82 | 1.0000 | 1.0000 |
| 454_M_+1 | 44.1% | 136 | 35.1% | 84 | 0.0722 | 0.0317 |
| 454_O_1 | 19.2% | 138 | 11.0% | 77 | 0.0295 | 0.0695 |
| 454_O_3 | 16.9% | 139 | 18.3% | 82 | 0.6994 | 0.3720 |
| 454_O_5 | 2.5% | 139 | 1.9% | 78 | 1.0000 | 1.0000 |
| 454_O_6 | 44.4% | 124 | 35.4% | 82 | 0.0816 | 0.0167 |
| 436_A_1 | 1.8% | 135 | 1.9% | 78 | 1.0000 | 0.7918 |
| 436_C_-1 | 13.7% | 139 | 14.3% | 84 | 0.8881 | 0.8219 |
| 436_D_1 | 3.7% | 136 | 4.2% | 84 | 0.8033 | 0.7996 |
| 436_E_1 | 45.3% | 137 | 41.0% | 83 | 0.4277 | 0.0947 |
| 436_G_1 | 9.8% | 138 | 10.0% | 80 | 1.0000 | 0.8893 |
| 436_K_-2 | 13.0% | 131 | 9.8% | 82 | 0.3556 | 0.5213 |
| 436_K_+1 | 2.8% | 123 | 4.3% | 82 | 0.5802 | 0.5733 |
| 436_L_-1 | 4.6% | 140 | 8.2% | 85 | 0.1513 | 0.1382 |
| 436_L_1 | 1.5% | 137 | 1.8% | 83 | 1.0000 | 1.0000 |
| 515_A_1 | 45.9% | 135 | 42.2% | 77 | 0.4783 | 0.7647 |
| 515_A_2 | 39.6% | 135 | 35.5% | 76 | 0.4651 | 0.7352 |
| 515_A_3 | 7.5% | 140 | 8.4% | 83 | 0.7192 | 0.7076 |
| 515_A_4 | 45.6% | 136 | 42.8% | 83 | 0.6204 | 0.7849 |
| 515_A_5 | 3.4% | 133 | 1.8% | 81 | 0.5477 | 0.5417 |
| 515_A_7 | 1.8% | 138 | 1.8% | 82 | 1.0000 | 1.0000 |

TABLE 12B-continued

ASSOCIATION ANALYSIS OF ASTHMA PHENOTYPE UK POPULATION
UK population

| GENE_EXON | FREQUENCIES CNTL | N | CASE | N | ALLELE P-VALUE | GENOTYPE P-VALUE |
|---|---|---|---|---|---|---|
| 570_C_2 | 8.7% | 138 | 9.6% | 68 | 0.8548 | 0.9286 |
| 570_C_4 | 8.6% | 140 | 9.0% | 67 | 1.0000 | 0.9266 |
| 570_F_1 | 49.3% | 138 | 49.3% | 67 | 1.0000 | 0.7395 |
| 757_A_2 | 17.2% | 137 | 26.0% | 75 | 0.0325 | 0.0965 |
| 757_A_4 | 1.8% | 140 | 4.7% | 74 | 0.1198 | 0.1147 |
| 757_A_+4 | 40.3% | 139 | 36.9% | 80 | 0.5418 | 0.3027 |
| 698_E_1 | 5.4% | 140 | 12.3% | 81 | 0.0106 | 0.0174 |
| 698_I_+1 | 38.4% | 133 | 35.3% | 78 | 0.5336 | 0.8307 |
| 561_P_1 | 33.0% | 135 | 41.3% | 80 | 0.0965 | 0.2473 |
| 561_J_1 | 13.3% | 132 | 7.4% | 81 | 0.0790 | 0.1202 |
| 561_H_1 | 8.6% | 139 | 10.6% | 80 | 0.4995 | 0.2479 |
| 561_E_1 | 0.0% | 110 | 0.0% | 68 | 1.0000 | 1.0000 |
| 561_C_1 | 0.4% | 140 | 0.6% | 80 | 1.0000 | 1.0000 |
| 561_B_+1 | 15.0% | 137 | 15.9% | 66 | 0.8830 | 0.8929 |
| 561_B_1 | 52.2% | 135 | 47.0% | 66 | 0.3404 | 0.6227 |
| 561_Y_+1 | 5.5% | 136 | 0.0% | 78 | 0.0016 | 0.0013 |
| 561_X_-3 | 33.0% | 138 | 32.1% | 81 | 0.9160 | 0.2592 |
| 581_F_+2 | 24.6% | 140 | 22.7% | 86 | 0.6515 | 0.8695 |
| 722_C_1 | 35.0% | 133 | 30.5% | 87 | 0.3523 | 0.5556 |
| 722_F_+1 | 1.8% | 139 | 1.1% | 87 | 0.7121 | 0.7098 |
| 702_A_-1 | 7.2% | 138 | 7.6% | 86 | 1.0000 | 0.5211 |
| 702_C_1 | 47.8% | 136 | 46.0% | 87 | 0.7706 | 0.5005 |
| 702_D_1 | 17.9% | 140 | 13.8% | 87 | 0.2963 | 0.5003 |
| 702_F_1 | 2.9% | 140 | 4.0% | 87 | 0.5914 | 0.3738 |
| 702_I_1 | 18.3% | 131 | 20.8% | 77 | 0.6065 | 0.4616 |
| 702_I_3 | 1.1% | 140 | 0.6% | 87 | 1.0000 | 1.0000 |
| 214_B_1 | 19.2% | 138 | 20.8% | 89 | 0.7181 | 0.1738 |
| 214_E_-1 | 47.9% | 140 | 50.6% | 81 | 0.6218 | 0.8436 |
| 214_E_+1 | 30.7% | 140 | 39.3% | 89 | 0.0686 | 0.1558 |

TABLE 12C

ASSOCIATION ANALYSIS OF ASTHMA PHENOTYPE US POPULATION
US population

| GENE_EXON | FREQUENCIES CNTL | N | CASE | N | ALLELE P-VALUE | GENOTYPE P-VALUE |
|---|---|---|---|---|---|---|
| 454_B_1 | 6.8% | 74 | 1.8% | 28 | 0.2957 | 0.2815 |
| 454_E_-1 | 27.0% | 76 | 19.0% | 29 | 0.2844 | 0.3531 |
| 454_E_1 | 0.7% | 75 | 0.0% | 30 | 1.0000 | 1.0000 |
| 454_E_2 | 44.8% | 77 | 53.3% | 30 | 0.2881 | 0.5554 |
| 454_F_-2 | 37.2% | 74 | 21.4% | 28 | 0.0443 | 0.0288 |
| 454_G_-1 | 8.4% | 77 | 5.2% | 29 | 0.5654 | 0.5481 |
| 454_H_1 | 20.3% | 69 | 36.2% | 29 | 0.0292 | 0.0199 |
| 454_H_2 | 1.5% | 67 | 3.5% | 29 | 0.5856 | 0.5818 |
| 454_K_1 | 0.7% | 77 | 1.7% | 30 | 0.4831 | 0.4840 |
| 454_L_-1 | 8.4% | 77 | 6.9% | 29 | 1.0000 | 0.8698 |
| 454_M_1 | 41.3% | 75 | 23.1% | 26 | 0.0198 | 0.0792 |
| 454_M_2 | 8.6% | 76 | 6.9% | 29 | 0.7854 | 1.0000 |
| 454_M_+1 | 41.4% | 76 | 24.1% | 29 | 0.0247 | 0.0815 |
| 454_O_1 | 18.8% | 77 | 15.0% | 30 | 0.5573 | 0.7174 |
| 454_O_3 | 18.8% | 77 | 21.7% | 30 | 0.7022 | 0.3960 |
| 454_O_5 | 4.0% | 76 | 1.8% | 28 | 0.6772 | 0.6713 |
| 454_O_6 | 39.2% | 74 | 25.9% | 29 | 0.0772 | 0.2334 |
| 436_A_1 | 0.0% | 68 | 1.8% | 28 | 0.2917 | 0.2917 |
| 436_C_-1 | 18.2% | 77 | 11.7% | 30 | 0.3063 | 0.6276 |
| 436_D_1 | 7.2% | 76 | 1.7% | 30 | 0.1856 | 0.4802 |
| 436_E_1 | 48.0% | 77 | 39.7% | 29 | 0.2842 | 0.4465 |
| 436_G_1 | 11.5% | 74 | 12.1% | 29 | 1.0000 | 0.6979 |
| 436_K_-2 | 18.5% | 73 | 12.1% | 29 | 0.3047 | 0.4804 |
| 436_K_+1 | 7.8% | 77 | 1.7% | 30 | 0.1170 | 0.3281 |
| 436_L_-1 | 3.9% | 77 | 6.7% | 30 | 0.4717 | 0.4616 |
| 436_L_1 | 2.6% | 77 | 1.7% | 30 | 1.0000 | 1.0000 |

TABLE 12C-continued

ASSOCIATION ANALYSIS OF ASTHMA PHENOTYPE
US POPULATION
US population

| GENE_EXON | FREQUENCIES | | | | ALLELE | GENOTYPE |
|---|---|---|---|---|---|---|
| | CNTL | N | CASE | N | P-VALUE | P-VALUE |
| 515_A_1 | 38.2% | 76 | 41.4% | 29 | 0.7520 | 0.0067 |
| 515_A_2 | 32.9% | 76 | 34.5% | 29 | 0.8705 | 0.0048 |
| 515_A_3 | 7.1% | 77 | 1.7% | 30 | 0.1858 | 0.1724 |
| 515_A_4 | 39.6% | 72 | 40.0% | 25 | 1.0000 | 0.0010 |
| 515_A_5 | 5.4% | 74 | 3.7% | 27 | 1.0000 | 1.0000 |
| 515_A_7 | 3.3% | 75 | 0.0% | 28 | 0.3262 | 0.3197 |
| 570_C_2 | 11.0% | 77 | 2.2% | 23 | 0.0794 | 0.2617 |
| 570_C_4 | 11.0% | 77 | 2.2% | 23 | 0.0794 | 0.3161 |
| 570_F_1 | 45.5% | 77 | 54.5% | 22 | 0.3085 | 0.0071 |
| 757_A_2 | 19.9% | 73 | 27.1% | 24 | 0.3153 | 0.3078 |
| 757_A_4 | 1.3% | 78 | 4.2% | 24 | 0.2359 | 0.2347 |
| 757_A_+4 | 37.7% | 77 | 37.5% | 24 | 1.0000 | 1.0000 |
| 698_E_1 | 9.7% | 77 | 6.2% | 24 | 0.5723 | 1.0000 |
| 698_I_+1 | 22.4% | 76 | 20.8% | 24 | 1.0000 | 0.8691 |
| 561_P_1 | 35.8% | 74 | 33.3% | 24 | 0.8623 | 0.9473 |
| 561_J_1 | 17.8% | 76 | 14.6% | 24 | 0.8257 | 1.0000 |
| 561_H_1 | 9.6% | 73 | 25.0% | 24 | 0.0192 | 0.0123 |
| 561_E_1 | 0.0% | 68 | 2.6% | 19 | 0.2184 | 0.2184 |
| 561_C_1 | 0.0% | 77 | 2.1% | 24 | 0.2376 | 0.2376 |
| 561_B_+1 | 10.7% | 75 | 16.7% | 24 | 0.3098 | 0.2553 |
| 561_B_1 | 41.3% | 75 | 47.9% | 24 | 0.5032 | 0.6426 |
| 561_Y_+1 | 3.3% | 76 | 6.8% | 22 | 0.3819 | 0.3735 |
| 561_X_-3 | 28.3% | 76 | 27.1% | 24 | 1.0000 | 1.0000 |
| 581_F_+2 | 23.7% | 76 | 18.8% | 24 | 0.5554 | 0.8790 |
| 722_C_1 | 29.6% | 76 | 29.2% | 24 | 1.0000 | 1.0000 |
| 722_F_+1 | 0.6% | 78 | 2.1% | 24 | 0.4161 | 0.4170 |
| 702_A_-1 | 6.5% | 77 | 4.3% | 23 | 0.7370 | 1.0000 |
| 702_C_1 | 52.0% | 77 | 47.9% | 24 | 0.7411 | 0.5438 |
| 702_D_1 | 13.0% | 77 | 14.6% | 24 | 0.8092 | 0.6925 |
| 702_F_1 | 5.2% | 77 | 6.2% | 24 | 0.7249 | 0.7199 |
| 702_I_1 | 19.2% | 73 | 20.8% | 24 | 0.8350 | 0.9140 |
| 702_I_3 | 0.0% | 77 | 0.0% | 24 | 1.0000 | 1.0000 |
| 214_B_1 | 15.1% | 76 | 19.0% | 29 | 0.5320 | 0.4893 |
| 214_E_-1 | 50.8% | 62 | 41.4% | 29 | 0.2668 | 0.4424 |
| 214_E_+1 | 24.0% | 77 | 25.9% | 29 | 0.8581 | 0.7552 | b. Bronchial Hyper-responsiveness: The analyses were repeated using asthmatic children with borderline to severe BHR (PC$_{20}$≦16 mg/ml) or PC$_{20}$(16), as described in the Linkage Analysis section. (Example 3). First, sibling pairs were identified where both sibs were affected and satisfied this new criteria. Of these pairs, one sib was included in the case/control analyses if they showed evidence of linkage at the gene of interest. This phenotype was more restrictive than the Asthma yes/no criteria; hence the number of cases included in the analyses was reduced approximately in half. Where the PC$_{20}$(16) subgroup represented a more genetically homogeneous sample, one could expect an increase in the effect size compared to the one observed in the original set of cases. However, the reduction in sample size could result in estimates that were less accurate. This, in turn, could obscure a trend in allele frequencies in the control group, the original set of cases, and the PC$_{20}$(16) subgroup. In addition, the reduction in sample size could induce a reduction in power (and increase in p-values) in spite of the larger effect size.

Figure 13:
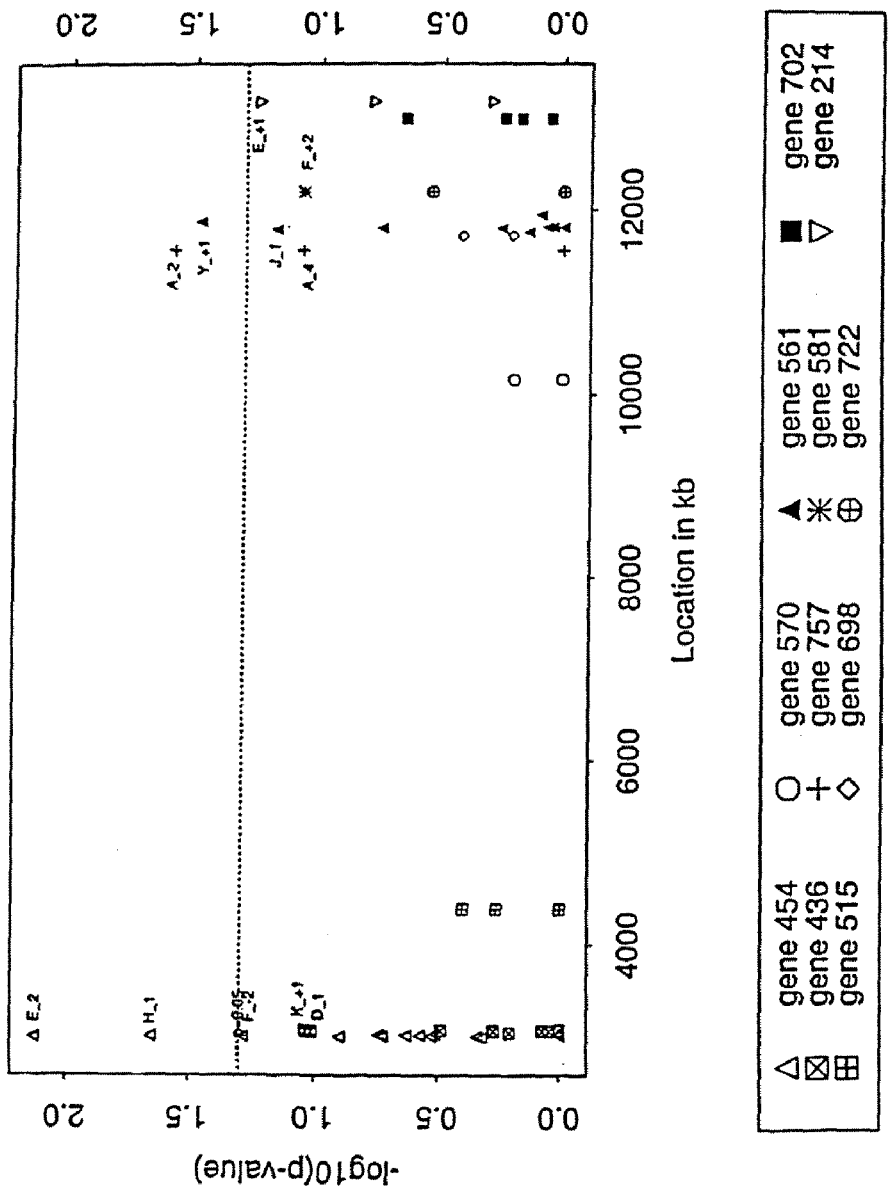
FIG. 13 shows the significance ($-\log_{10}$(p-value)) for the comparison of SNP allele frequencies in cases (BHR ($PC_{20} \leq 16$ mg/ml) and asthma) and controls in the combined population against the relative location (Kb) of SNPs along chromosome 12.
Figure 14:
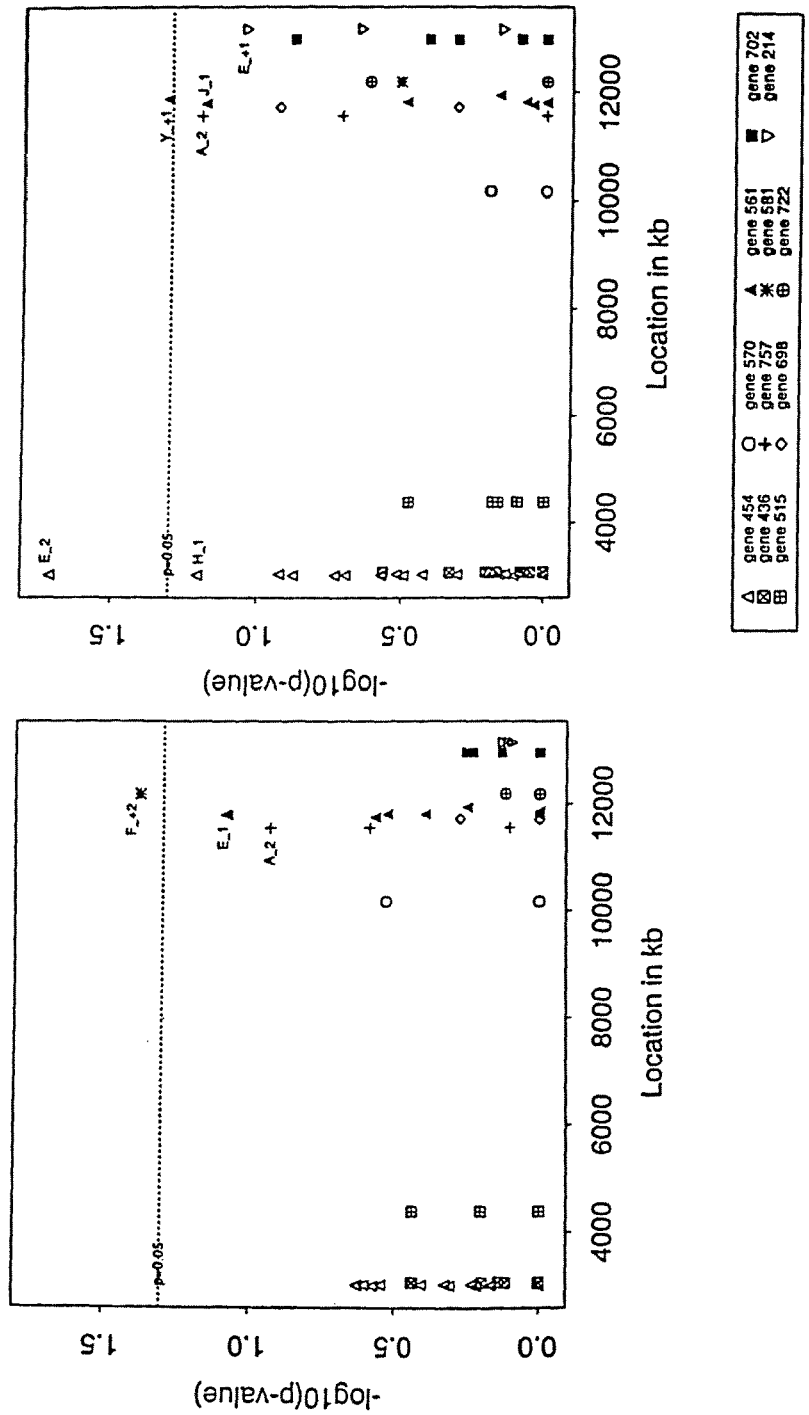
FIG. 14 shows the significance ($-\log_{10}$(p-value)) for the comparison of SNP allele frequencies in cases (BHR ($PC_{20} \leq 16$ mg/ml) and asthma) and controls in the US and UK populations against the relative location (Kb) of SNPs along chromosome 12.

The significance levels (p-values) for allelic association of all typed SNPs to the BHR phenotype are plotted in FIG. 13 (combined population) and FIG. 14 (US and UK populations, separately). Frequencies and p-values for SNPs associated with the BHR phenotype are shown in Tables 13A, 13B, and 13C for the combined population and for the UK and US populations separately.

TABLE 13A

ASSOCIATION ANALYSIS OF BHR PHENOTYPE COMBINED
US/UK POPULATION
Combined US and UK

| GENE_EXON | FREQUENCIES | | | | ALLELE | GENOTYPE |
|---|---|---|---|---|---|---|
| | CNTL | N | CASE | N | P-VALUE | P-VALUE |
| 454_B_1 | 7.1% | 183 | 4.3% | 46 | 0.4798 | 0.4636 |
| 454_E_-1 | 25.8% | 213 | 29.8% | 52 | 0.4577 | 0.5705 |
| 454_E_1 | 0.8% | 179 | 2.9% | 51 | 0.1260 | 0.1246 |
| 454_E_2 | 49.1% | 217 | 63.6% | 55 | 0.0074 | 0.0140 |
| 454_F_-2 | 34.6% | 211 | 24.6% | 55 | 0.0519 | 0.0312 |
| 454_G_-1 | 8.4% | 215 | 12.5% | 52 | 0.1890 | 0.1353 |
| 454_H_1 | 22.1% | 204 | 33.0% | 53 | 0.0223 | 0.0181 |
| 454_H_2 | 2.0% | 198 | 3.7% | 54 | 0.2962 | 0.2923 |
| 454_K_1 | 1.9% | 215 | 3.8% | 53 | 0.2664 | 0.2621 |
| 454_L_-1 | 6.7% | 217 | 6.0% | 50 | 1.0000 | 0.8944 |
| 454_M_1 | 42.3% | 208 | 35.2% | 44 | 0.2349 | 0.4893 |
| 454_M_2 | 6.8% | 212 | 6.9% | 51 | 1.0000 | 0.8043 |
| 454_M_+1 | 43.2% | 212 | 35.9% | 53 | 0.1873 | 0.3681 |
| 454_O_1 | 19.1% | 215 | 12.8% | 47 | 0.1816 | 0.3182 |
| 454_O_3 | 17.6% | 216 | 17.6% | 51 | 1.0000 | 0.2734 |
| 454_O_5 | 3.0% | 215 | 2.1% | 48 | 1.0000 | 1.0000 |
| 454_O_6 | 42.4% | 198 | 36.3% | 51 | 0.3100 | 0.5059 |
| 436_A_1 | 1.2% | 203 | 2.0% | 49 | 0.6263 | 0.3975 |
| 436_C_-1 | 15.3% | 216 | 12.3% | 53 | 0.5402 | 0.7508 |
| 436_D_1 | 5.0% | 212 | 0.9% | 53 | 0.0971 | 0.1825 |
| 436_E_1 | 46.3% | 214 | 45.1% | 51 | 0.9120 | 0.2363 |
| 436_G_1 | 10.4% | 212 | 11.0% | 50 | 0.8565 | 0.4689 |
| 436_K_-2 | 14.9% | 204 | 12.3% | 53 | 0.5378 | 0.5523 |
| 436_K_+1 | 4.7% | 200 | 1.0% | 52 | 0.0925 | 0.3121 |
| 436_L_-1 | 4.4% | 217 | 6.5% | 54 | 0.3256 | 0.4368 |
| 436_L_1 | 1.9% | 214 | 1.9% | 53 | 1.0000 | 1.0000 |
| 515_A_1 | 43.1% | 211 | 43.5% | 46 | 1.0000 | 1.0000 |
| 515_A_2 | 37.2% | 211 | 33.3% | 45 | 0.5472 | 0.7363 |
| 515_A_3 | 7.4% | 217 | 4.7% | 53 | 0.3976 | 0.3791 |
| 515_A_4 | 43.5% | 208 | 42.9% | 49 | 1.0000 | 0.8566 |
| 515_A_5 | 4.1% | 207 | 3.1% | 48 | 1.0000 | 0.7745 |
| 515_A_7 | 2.4% | 213 | 2.0% | 51 | 1.0000 | 1.0000 |
| 570_C_2 | 9.5% | 215 | 9.5% | 42 | 1.0000 | 0.7549 |
| 570_C_4 | 9.5% | 217 | 9.8% | 41 | 1.0000 | 0.9219 |
| 570_F_1 | 47.9% | 215 | 51.2% | 41 | 0.6303 | 0.7776 |
| 757_A_2 | 18.1% | 210 | 29.1% | 43 | 0.0260 | 0.0659 |
| 757_A_4 | 1.6% | 218 | 4.8% | 42 | 0.0849 | 0.0826 |
| 757_A_+4 | 39.4% | 216 | 38.9% | 45 | 1.0000 | 0.7300 |
| 698_E_1 | 6.9% | 217 | 9.8% | 46 | 0.3791 | 0.4289 |
| 698_I_+1 | 32.5% | 209 | 29.1% | 43 | 0.6118 | 0.4244 |
| 561_P_1 | 34.0% | 209 | 31.5% | 46 | 0.7151 | 0.9229 |
| 561_J_1 | 14.9% | 208 | 7.6% | 46 | 0.0661 | 0.2215 |
| 561_H_1 | 9.0% | 212 | 11.1% | 45 | 0.5495 | 0.2181 |
| 561_E_1 | 0.0% | 178 | 1.3% | 38 | 0.1759 | 0.1759 |
| 561_C_1 | 0.2% | 217 | 0.0% | 46 | 1.0000 | 1.0000 |
| 561_B_+1 | 13.4% | 212 | 14.5% | 38 | 0.8557 | 0.2404 |
| 561_B_1 | 48.3% | 210 | 47.4% | 38 | 0.9013 | 0.6065 |
| 561_Y_+1 | 4.7% | 212 | 0.0% | 45 | 0.0329 | 0.0296 |
| 561_X_-3 | 31.3% | 214 | 32.6% | 46 | 0.8057 | 0.2221 |
| 581_F_+2 | 24.3% | 216 | 16.0% | 50 | 0.0852 | 0.1792 |
| 722_C_1 | 33.0% | 209 | 27.0% | 50 | 0.2827 | 0.1568 |
| 722_F_+1 | 1.4% | 217 | 1.0% | 50 | 1.0000 | 1.0000 |
| 702_A_-1 | 7.0% | 215 | 8.2% | 49 | 0.6666 | 0.7105 |
| 702_C_1 | 49.3% | 213 | 42.0% | 50 | 0.2212 | 0.0884 |
| 702_D_1 | 16.1% | 217 | 11.0% | 50 | 0.2193 | 0.5230 |
| 702_F_1 | 3.7% | 217 | 5.0% | 50 | 0.5674 | 0.4866 |
| 702_I_1 | 18.6% | 204 | 19.1% | 47 | 0.8842 | 0.0607 |
| 702_I_3 | 0.7% | 217 | 1.0% | 50 | 0.5648 | 0.5660 |
| 214_B_1 | 17.8% | 214 | 24.0% | 52 | 0.1630 | 0.0098 |
| 214_E_-1 | 48.8% | 202 | 44.9% | 49 | 0.5014 | 0.4228 |
| 214_E_+1 | 28.3% | 217 | 38.5% | 52 | 0.0568 | 0.0629 |

TABLE 13B

ASSOCIATION ANALYSIS OF BHR PHENOTYPE UK POPULATION
UK population

| GENE_EXON | FREQUENCIES CNTL | N | CASE | N | ALLELE P-VALUE | GENOTYPE P-VALUE |
|---|---|---|---|---|---|---|
| 454_B_1 | 7.3% | 109 | 5.6% | 36 | 0.7903 | 0.7821 |
| 454_E_−1 | 25.2% | 137 | 30.9% | 42 | 0.3234 | 0.2916 |
| 454_E_1 | 1.0% | 104 | 3.8% | 40 | 0.1331 | 0.1311 |
| 454_E_2 | 51.4% | 140 | 65.9% | 44 | 0.0196 | 0.0428 |
| 454_F_−2 | 33.2% | 137 | 25.0% | 44 | 0.1858 | 0.2137 |
| 454_G_−1 | 8.3% | 138 | 13.1% | 42 | 0.2033 | 0.1620 |
| 454_H_1 | 23.0% | 135 | 33.3% | 42 | 0.0629 | 0.0498 |
| 454_H_2 | 2.3% | 131 | 4.7% | 43 | 0.2708 | 0.2656 |
| 454_K_1 | 2.5% | 138 | 3.6% | 42 | 0.7041 | 0.7005 |
| 454_L_−1 | 5.7% | 140 | 5.0% | 40 | 1.0000 | 1.0000 |
| 454_M_1 | 42.9% | 133 | 37.5% | 36 | 0.5008 | 0.7446 |
| 454_M_2 | 5.9% | 136 | 6.1% | 41 | 1.0000 | 0.8275 |
| 454_M_+1 | 44.1% | 136 | 38.1% | 42 | 0.3776 | 0.5479 |
| 454_O_1 | 19.2% | 138 | 11.1% | 36 | 0.1197 | 0.3349 |
| 454_O_3 | 16.9% | 139 | 15.0% | 40 | 0.7360 | 0.6730 |
| 454_O_5 | 2.5% | 139 | 1.3% | 38 | 1.0000 | 1.0000 |
| 454_O_6 | 44.4% | 124 | 37.8% | 41 | 0.3068 | 0.4297 |
| 436_A_1 | 1.8% | 135 | 2.6% | 38 | 0.6510 | 0.4579 |
| 436_C_−1 | 13.7% | 139 | 11.9% | 42 | 0.8544 | 1.0000 |
| 436_D_1 | 3.7% | 136 | 1.2% | 42 | 0.4697 | 0.4625 |
| 436_E_1 | 45.3% | 137 | 46.3% | 41 | 0.8998 | 0.2517 |
| 436_G_1 | 9.8% | 138 | 10.3% | 39 | 0.8334 | 0.5314 |
| 436_K_−2 | 13.0% | 131 | 11.9% | 42 | 1.0000 | 1.0000 |
| 436_K_+1 | 2.8% | 123 | 1.2% | 41 | 0.6847 | 0.6807 |
| 436_L_−1 | 4.6% | 140 | 8.1% | 43 | 0.2747 | 0.2611 |
| 436_L_1 | 1.5% | 137 | 2.4% | 42 | 0.6283 | 0.6262 |
| 515_A_1 | 45.9% | 135 | 43.1% | 36 | 0.6912 | 0.5660 |
| 515_A_2 | 39.6% | 135 | 32.9% | 35 | 0.3355 | 0.5485 |
| 515_A_3 | 7.5% | 140 | 5.9% | 42 | 0.8101 | 0.8024 |
| 515_A_4 | 45.6% | 136 | 43.9% | 41 | 0.8016 | 0.9215 |
| 515_A_5 | 3.4% | 133 | 2.5% | 40 | 1.0000 | 1.0000 |
| 515_A_7 | 1.8% | 138 | 2.4% | 41 | 0.6619 | 0.6604 |
| 570_C_2 | 8.7% | 138 | 10.3% | 34 | 0.6413 | 0.5472 |
| 570_C_4 | 8.6% | 140 | 10.6% | 33 | 0.6321 | 0.4646 |
| 570_F_1 | 49.3% | 138 | 48.5% | 33 | 1.0000 | 0.1921 |
| 757_A_2 | 17.2% | 137 | 27.1% | 35 | 0.0632 | 0.1182 |
| 757_A_4 | 1.8% | 140 | 4.4% | 34 | 0.1910 | 0.1890 |
| 757_A_+4 | 40.3% | 139 | 40.5% | 37 | 1.0000 | 0.7080 |
| 698_E_1 | 5.4% | 140 | 10.5% | 38 | 0.1161 | 0.1501 |
| 698_I_+1 | 38.4% | 133 | 32.9% | 35 | 0.4873 | 0.4925 |
| 561_P_1 | 33.0% | 135 | 34.2% | 38 | 0.8906 | 1.0000 |
| 561_J_1 | 13.3% | 132 | 5.3% | 38 | 0.0650 | 0.1740 |
| 561_H_1 | 8.6% | 139 | 8.1% | 37 | 1.0000 | 1.0000 |
| 561_E_1 | 0.0% | 110 | 0.0% | 32 | 1.0000 | 1.0000 |
| 561_C_1 | 0.4% | 140 | 0.0% | 38 | 1.0000 | 1.0000 |
| 561_B_+1 | 15.0% | 137 | 13.3% | 30 | 0.8425 | 0.6278 |
| 561_B_1 | 52.2% | 135 | 45.0% | 30 | 0.3217 | 0.3440 |
| 561_Y_+1 | 5.5% | 136 | 0.0% | 38 | 0.0486 | 0.0437 |
| 561_X_−3 | 33.0% | 138 | 35.5% | 38 | 0.6825 | 0.0827 |
| 581_F_+2 | 24.6% | 140 | 18.6% | 43 | 0.3068 | 0.3581 |
| 722_C_1 | 35.0% | 133 | 27.9% | 43 | 0.2393 | 0.2426 |
| 722_F_+1 | 1.8% | 139 | 1.2% | 43 | 1.0000 | 1.0000 |
| 702_A_−1 | 7.2% | 138 | 8.3% | 42 | 0.8130 | 0.8054 |
| 702_C_1 | 47.8% | 136 | 41.9% | 43 | 0.3856 | 0.3789 |
| 702_D_1 | 17.9% | 140 | 10.5% | 43 | 0.1308 | 0.2813 |
| 702_F_1 | 2.9% | 140 | 4.7% | 43 | 0.4871 | 0.4261 |
| 702_I_1 | 18.3% | 131 | 18.8% | 40 | 1.0000 | 0.1367 |
| 702_I_3 | 1.1% | 140 | 1.2% | 43 | 1.0000 | 1.0000 |
| 214_B_1 | 19.2% | 138 | 25.6% | 43 | 0.2235 | 0.0237 |
| 214_E_−1 | 47.9% | 140 | 45.0% | 40 | 0.7039 | 0.6187 |
| 214_E_+1 | 30.7% | 140 | 40.7% | 43 | 0.0900 | 0.1646 |

TABLE 13C

ASSOCIATION ANALYSIS OF BHR PHENOTYPE US POPULATION
US population

| GENE_EXON | FREQUENCIES CNTL | N | CASE | N | ALLELE P-VALUE | GENOTYPE P-VALUE |
|---|---|---|---|---|---|---|
| 454_B_1 | 6.8% | 74 | 0.0% | 10 | 0.6099 | 0.5997 |
| 454_E_−1 | 27.0% | 76 | 25.0% | 10 | 1.0000 | 0.8773 |
| 454_E_1 | 0.7% | 75 | 0.0% | 11 | 1.0000 | 1.0000 |
| 454_E_2 | 44.8% | 77 | 54.5% | 11 | 0.4939 | 0.6511 |
| 454_F_−2 | 37.2% | 74 | 22.7% | 11 | 0.2356 | 0.3215 |
| 454_G_−1 | 8.4% | 77 | 10.0% | 10 | 0.6842 | 0.6809 |
| 454_H_1 | 20.3% | 69 | 31.8% | 11 | 0.2665 | 0.2593 |
| 454_H_2 | 1.5% | 67 | 0.0% | 11 | 1.0000 | 1.0000 |
| 454_K_1 | 0.7% | 77 | 4.5% | 11 | 0.2350 | 0.2356 |
| 454_L_−1 | 8.4% | 77 | 10.0% | 10 | 0.6842 | 0.6961 |
| 454_M_1 | 41.3% | 75 | 25.0% | 8 | 0.2845 | 0.5385 |
| 454_M_2 | 8.6% | 76 | 10.0% | 10 | 0.6875 | 0.6984 |
| 454_M_+1 | 41.4% | 76 | 27.3% | 11 | 0.2483 | 0.5213 |
| 454_O_1 | 18.8% | 77 | 18.2% | 11 | 1.0000 | 0.8406 |
| 454_O_3 | 18.8% | 77 | 27.3% | 11 | 0.3924 | 0.2974 |
| 454_O_5 | 4.0% | 76 | 5.0% | 10 | 0.5860 | 1.0000 |
| 454_O_6 | 39.2% | 74 | 30.0% | 10 | 0.4733 | 0.8144 |
| 436_A_1 | 0.0% | 68 | 0.0% | 11 | 1.0000 | 1.0000 |
| 436_C_−1 | 18.2% | 77 | 13.6% | 11 | 0.7696 | 1.0000 |
| 436_D_1 | 7.2% | 76 | 0.0% | 11 | 0.3630 | 0.6475 |
| 436_E_1 | 48.0% | 77 | 40.0% | 10 | 0.6353 | 0.8165 |
| 436_G_1 | 11.5% | 74 | 13.6% | 11 | 0.7268 | 0.5735 |
| 436_K_−2 | 18.5% | 73 | 13.6% | 11 | 0.7686 | 1.0000 |
| 436_K_+1 | 7.8% | 77 | 0.0% | 11 | 0.3665 | 0.4304 |
| 436_L_−1 | 3.9% | 77 | 0.0% | 11 | 1.0000 | 1.0000 |
| 436_L_1 | 2.6% | 77 | 0.0% | 11 | 1.0000 | 1.0000 |
| 515_A_1 | 38.2% | 76 | 45.0% | 10 | 0.6283 | 0.2911 |
| 515_A_2 | 32.9% | 76 | 35.0% | 10 | 1.0000 | 0.1469 |
| 515_A_3 | 7.1% | 77 | 0.0% | 11 | 0.3634 | 0.3458 |
| 515_A_4 | 39.6% | 72 | 37.5% | 8 | 1.0000 | 0.1886 |
| 515_A_5 | 5.4% | 74 | 6.2% | 8 | 1.0000 | 1.0000 |
| 515_A_7 | 3.3% | 75 | 0.0% | 10 | 1.0000 | 1.0000 |
| 570_C_2 | 11.0% | 77 | 6.2% | 8 | 1.0000 | 1.0000 |
| 570_C_4 | 11.0% | 77 | 6.2% | 8 | 1.0000 | 1.0000 |
| 570_F_1 | 45.5% | 77 | 62.5% | 8 | 0.2925 | 0.0453 |
| 757_A_2 | 19.9% | 73 | 37.5% | 8 | 0.1158 | 0.2069 |
| 757_A_4 | 1.3% | 78 | 6.2% | 8 | 0.2553 | 0.2566 |
| 757_A_+4 | 37.7% | 77 | 31.3% | 8 | 0.7873 | 1.0000 |
| 698_E_1 | 9.7% | 77 | 6.2% | 8 | 1.0000 | 1.0000 |
| 698_I_+1 | 22.4% | 76 | 12.5% | 8 | 0.5269 | 1.0000 |
| 561_P_1 | 35.8% | 74 | 18.8% | 8 | 0.2668 | 0.6666 |
| 561_J_1 | 17.8% | 76 | 18.8% | 8 | 1.0000 | 0.7579 |
| 561_H_1 | 9.6% | 73 | 25.0% | 8 | 0.0826 | 0.0677 |
| 561_E_1 | 0.0% | 68 | 8.3% | 6 | 0.0811 | 0.0811 |
| 561_C_1 | 0.0% | 77 | 0.0% | 8 | 1.0000 | 1.0000 |
| 561_B_+1 | 10.7% | 75 | 18.8% | 8 | 0.3996 | 0.1039 |
| 561_B_1 | 41.3% | 75 | 56.3% | 8 | 0.2937 | 0.4467 |
| 561_Y_+1 | 3.3% | 76 | 0.0% | 7 | 1.0000 | 1.0000 |
| 561_X_−3 | 28.3% | 76 | 18.8% | 8 | 0.5610 | 1.0000 |
| 581_F_+2 | 23.7% | 76 | 0.0% | 7 | 0.0416 | 0.2351 |
| 722_C_1 | 29.6% | 76 | 21.4% | 7 | 0.7592 | 1.0000 |
| 722_F_+1 | 0.6% | 78 | 0.0% | 7 | 1.0000 | 1.0000 |
| 702_A_−1 | 6.5% | 77 | 7.1% | 7 | 1.0000 | 0.6027 |
| 702_C_1 | 52.0% | 77 | 42.9% | 7 | 0.5841 | 0.1734 |
| 702_D_1 | 13.0% | 77 | 14.3% | 7 | 1.0000 | 0.7000 |
| 702_F_1 | 5.2% | 77 | 7.1% | 7 | 0.5522 | 0.5618 |
| 702_I_1 | 19.2% | 73 | 21.4% | 7 | 0.7357 | 0.3487 |
| 702_I_3 | 0.0% | 77 | 0.0% | 7 | 1.0000 | 1.0000 |
| 214_B_1 | 15.1% | 76 | 16.7% | 9 | 0.7414 | 1.0000 |
| 214_E_−1 | 50.8% | 62 | 44.4% | 9 | 0.8016 | 0.7277 |
| 214_E_+1 | 24.0% | 77 | 27.8% | 9 | 0.7732 | 0.4601 |

The results for the BHR sub-phenotype closely resembled the results observed for the asthma phenotype, described above. Namely, SNPs in Gene 454, Gene 757, and Gene 561 showed a significant association with the BHR phenotype in the combined population when comparing allele frequencies in the control and case populations. When analyzing the populations separately, SNPs in Gene 454 and Gene 561 showed a significant association in the UK population alone, while SNPs in Gene 581 showed a similar association with the phenotype in the US population. In addition, the genotypic comparison yielded significant results for SNPs in Gene 570 in the US population and in Gene 214, Gene 454 and Gene 561 for the UK and combined population (see Tables 13A-13C).

The most significant results were obtained for Gene 454, where SNP E 2 showed a p-value of 0.007 for the allele test and p-value of 0.01 for the genotype test in the combined population (49% in control vs. 64% in cases). SNP E 2 was also significant in the UK population alone for the allele (p=0.02) and genotype (p=0.04) tests. Two more SNPs reached statistical significance in Gene 454 for this sub-phenotype: 1) SNP H 1 (p=0.02 in the combined population, 22% in controls vs. 33% in cases; p<0.05 for genotypic test in the UK population); and 2) SNP F −2 (genotypic p-value of 0.03 in the combined population).

For Gene 757, SNP A 2 was significant with a p-value of 0.03 in the combined population (18% in controls vs. 29% in cases).

One SNP in Gene 561 was significant in both the combined population and in the UK population alone (p=0.03 for both the allele and genotype tests in the combined population, 5% in controls vs. not present in cases; p<0.05 for allele and p=0.04 for genotype in UK, 6% in controls vs. not present in cases).

Gene 214 was significant in both the combined and UK populations when comparing the genotype frequencies between the cases and controls (p=0.01 combined population, p=0.02 UK population).

In the US population, one SNP in Gene 581 reached statistical significance (F +2, p=0.04, 24% in controls vs. not present in cases). The comparison of genotype frequencies also yielded a significant result for Gene 570 (SNP F 1 p<0.05).

c. Total IgE: The analyses were performed using asthmatic children with elevated total IgE levels, as described in the Linkage Analysis section (Example 3). First, sibling pairs were identified where both sibs were affected and satisfied this new criteria. Of these pairs, one sib was included in the case/control analyses if they showed evidence of linkage at the gene of interest. This phenotype was more restrictive than the Asthma yes/no criteria; hence the number of cases included in the analyses was reduced by approximately 41%.

Figure 15:
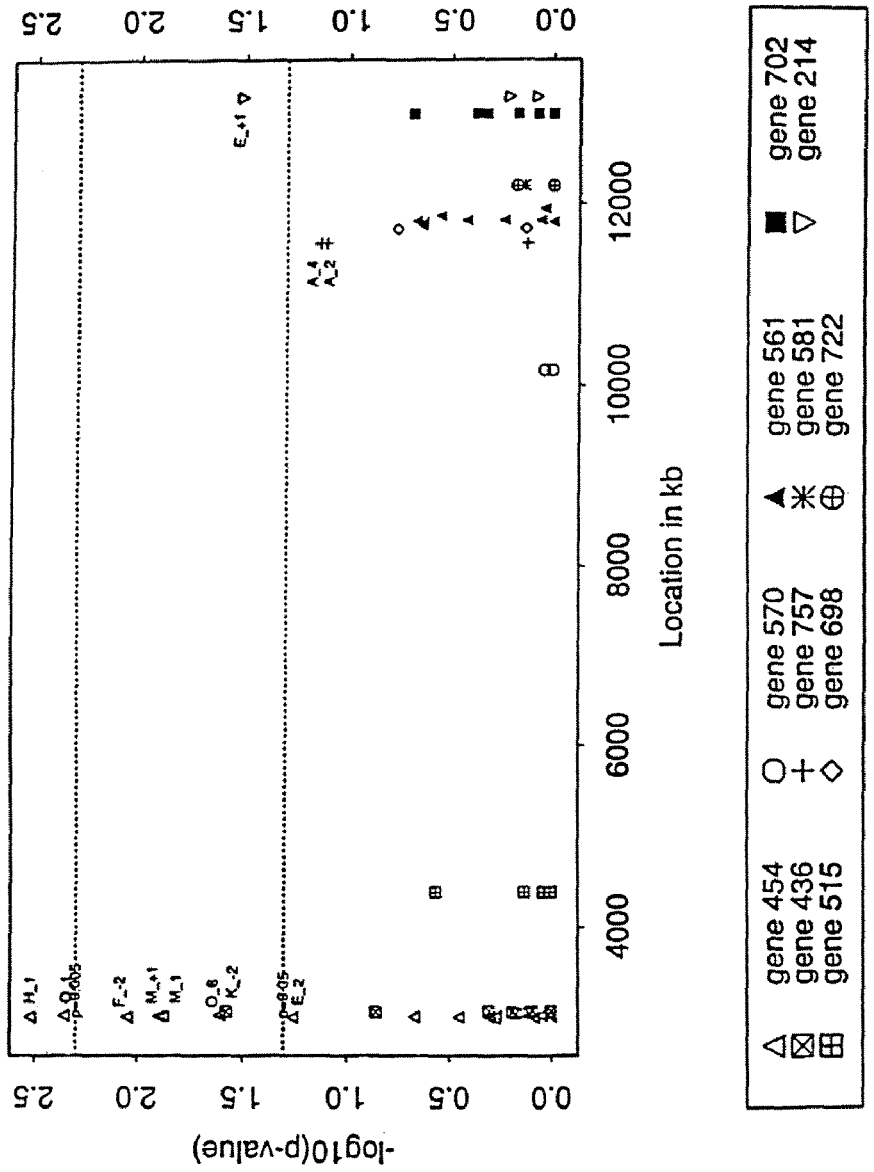
FIG. 15 shows the significance ($-\log_{10}$(p-value)) for the comparison of SNP allele frequencies in cases (total IgE and asthma) and controls in the combined population against the relative location (Kb) of SNPs along chromosome 12.
Figure 16:
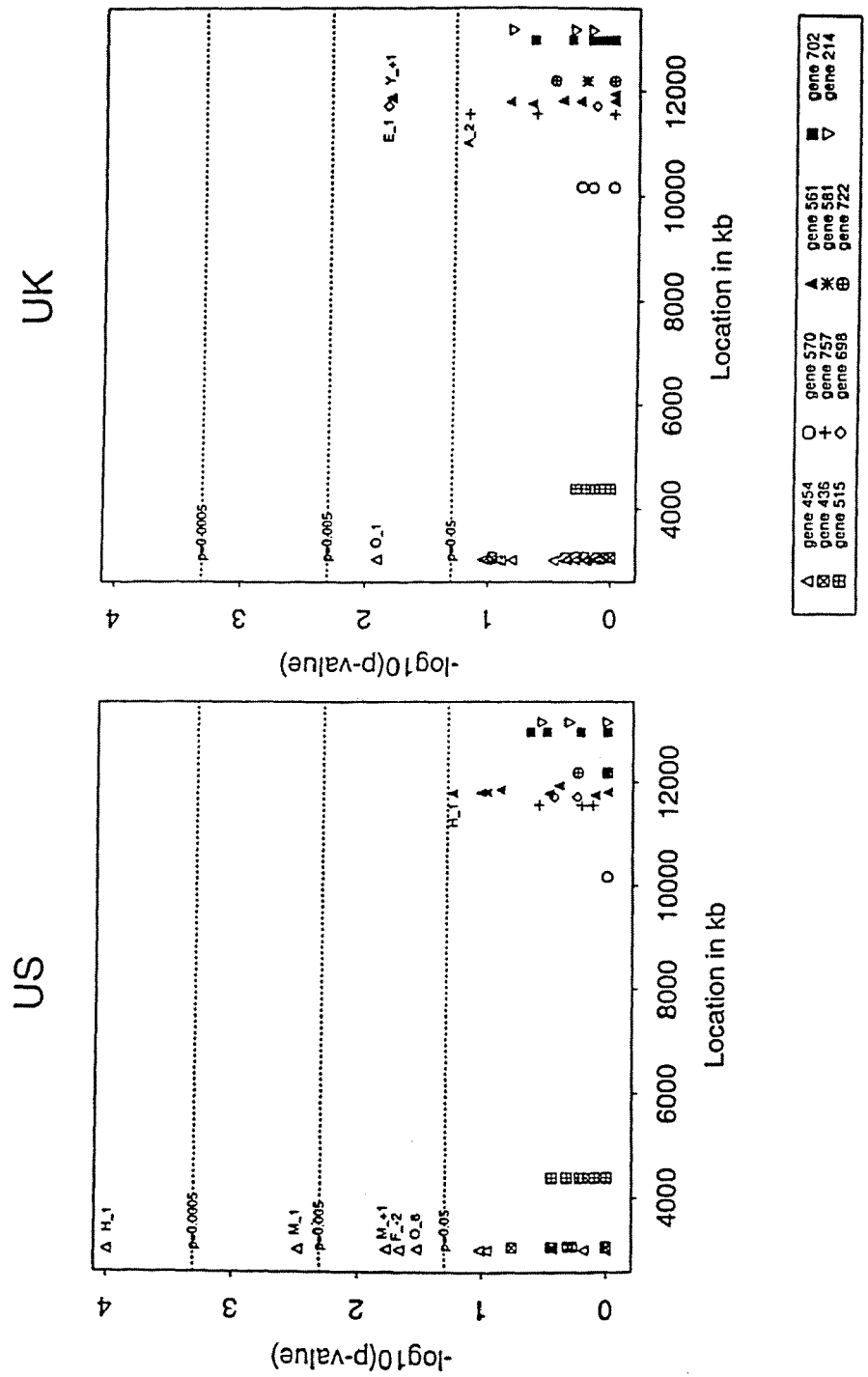
FIG. 16 shows the significance ($-\log_{10}$(p-value)) for the comparison of SNP allele frequencies in cases (total IgE and asthma) and controls in the US and UK populations against the relative location (Kb) of SNPs along chromosome 12.

The significance levels (p-values) for allelic association of all typed SNPs to the IgE phenotype are plotted in FIG. 15 (combined population) and FIG. 16 (US and UK populations, separately). Frequencies and p-values for SNPs associated with the IgE phenotype are shown in Tables 14A, 14B, and 14C for the combined population and for the UK and US populations, separately.

TABLE 14A

ASSOCIATION ANALYSIS OF TOTAL IgE PHENOTYPE
COMBINED US/UK POPULATION
Combined US and UK

| GENE_EXON | FREQUENCIES | | | | ALLELE | GENOTYPE |
| --- | --- | --- | --- | --- | --- | --- |
| | CNTL | N | CASE | N | P-VALUE | P-VALUE |
| 454_B_1 | 7.1% | 183 | 5.2% | 58 | 0.5295 | 0.5138 |
| 454_E_−1 | 25.8% | 213 | 24.6% | 69 | 0.8230 | 0.9474 |
| 454_E_1 | 0.8% | 179 | 2.2% | 67 | 0.3519 | 0.3491 |
| 454_E_2 | 49.1% | 217 | 58.3% | 72 | 0.0552 | 0.0364 |
| 454_F_−2 | 34.6% | 211 | 22.5% | 71 | 0.0089 | 0.0146 |
| 454_G_−1 | 8.4% | 215 | 10.1% | 69 | 0.4950 | 0.3130 |

TABLE 14A-continued

ASSOCIATION ANALYSIS OF TOTAL IgE PHENOTYPE
COMBINED US/UK POPULATION
Combined US and UK

| GENE_EXON | FREQUENCIES | | | | ALLELE | GENOTYPE |
| --- | --- | --- | --- | --- | --- | --- |
| | CNTL | N | CASE | N | P-VALUE | P-VALUE |
| 454_H_1 | 22.1% | 204 | 35.3% | 68 | 0.0030 | 0.0010 |
| 454_H_2 | 2.0% | 198 | 4.2% | 71 | 0.2146 | 0.2088 |
| 454_K_1 | 1.9% | 215 | 2.9% | 69 | 0.4976 | 0.4937 |
| 454_L_−1 | 6.7% | 217 | 6.0% | 67 | 1.0000 | 0.9236 |
| 454_M_1 | 42.3% | 208 | 29.3% | 58 | 0.0133 | 0.0399 |
| 454_M_2 | 6.8% | 212 | 6.6% | 68 | 1.0000 | 1.0000 |
| 454_M_+1 | 43.2% | 212 | 31.2% | 69 | 0.0127 | 0.0283 |
| 454_O_1 | 19.1% | 215 | 8.6% | 64 | 0.0044 | 0.0211 |
| 454_O_3 | 17.6% | 216 | 18.4% | 68 | 0.8977 | 0.1305 |
| 454_O_5 | 3.0% | 215 | 1.6% | 63 | 0.5387 | 0.5327 |
| 454_O_6 | 42.4% | 198 | 31.3% | 67 | 0.0248 | 0.0468 |
| 436_A_1 | 1.2% | 203 | 1.6% | 64 | 0.6751 | 0.6934 |
| 436_C_−1 | 15.3% | 216 | 13.8% | 69 | 0.7838 | 1.0000 |
| 436_D_1 | 5.0% | 212 | 3.6% | 69 | 0.6444 | 0.8539 |
| 436_E_1 | 46.3% | 214 | 39.0% | 68 | 0.1390 | 0.1920 |
| 436_G_1 | 10.4% | 212 | 10.0% | 65 | 1.0000 | 0.9441 |
| 436_K_−2 | 14.9% | 204 | 7.5% | 67 | 0.0266 | 0.1029 |
| 436_K_+1 | 4.7% | 200 | 3.6% | 69 | 0.8111 | 1.0000 |
| 436_L_−1 | 4.4% | 217 | 5.7% | 70 | 0.4967 | 0.4872 |
| 436_L_1 | 1.9% | 214 | 1.5% | 69 | 1.0000 | 1.0000 |
| 515_A_1 | 43.1% | 211 | 43.6% | 63 | 0.9188 | 0.5757 |
| 515_A_2 | 37.2% | 211 | 37.1% | 62 | 1.0000 | 0.6857 |
| 515_A_3 | 7.4% | 217 | 7.2% | 69 | 1.0000 | 1.0000 |
| 515_A_4 | 43.5% | 208 | 43.9% | 66 | 1.0000 | 0.3943 |
| 515_A_5 | 4.1% | 207 | 1.5% | 66 | 0.2720 | 0.1767 |
| 515_A_7 | 2.4% | 213 | 1.5% | 67 | 0.7400 | 0.7370 |
| 570_C_2 | 9.5% | 215 | 9.8% | 51 | 1.0000 | 0.9293 |
| 570_C_4 | 9.5% | 217 | 9.2% | 49 | 1.0000 | 1.0000 |
| 570_F_1 | 47.9% | 215 | 49.0% | 50 | 0.9116 | 0.9785 |
| 757_A_2 | 18.1% | 210 | 25.9% | 54 | 0.0778 | 0.1407 |
| 757_A_4 | 1.6% | 218 | 4.5% | 55 | 0.0723 | 0.0700 |
| 757_A_+4 | 39.4% | 216 | 41.2% | 57 | 0.7473 | 0.0453 |
| 698_E_1 | 6.9% | 217 | 11.2% | 58 | 0.1706 | 0.2526 |
| 698_I_+1 | 32.5% | 209 | 34.5% | 55 | 0.7326 | 0.9308 |
| 561_P_1 | 34.0% | 209 | 40.4% | 57 | 0.2246 | 0.1509 |
| 561_J_1 | 14.9% | 208 | 10.3% | 58 | 0.2286 | 0.4828 |
| 561_H_1 | 9.0% | 212 | 9.1% | 55 | 1.0000 | 1.0000 |
| 561_E_1 | 0.0% | 178 | 1.0% | 48 | 0.2124 | 0.2124 |
| 561_C_1 | 0.2% | 217 | 0.9% | 57 | 0.3731 | 0.3734 |
| 561_B_+1 | 13.4% | 212 | 14.3% | 49 | 0.8701 | 0.8764 |
| 561_B_1 | 48.3% | 210 | 44.9% | 49 | 0.5754 | 0.7216 |
| 561_Y_+1 | 4.7% | 212 | 1.8% | 55 | 0.2788 | 0.2683 |
| 561_X_−3 | 31.3% | 214 | 30.2% | 58 | 0.9100 | 0.9259 |
| 581_F_+2 | 24.3% | 216 | 22.1% | 61 | 0.7182 | 0.7766 |
| 722_C_1 | 33.0% | 209 | 30.3% | 61 | 0.6602 | 0.7945 |
| 722_F_+1 | 1.4% | 217 | 0.8% | 61 | 1.0000 | 1.0000 |
| 702_A_−1 | 7.0% | 215 | 7.5% | 60 | 0.8413 | 0.5612 |
| 702_C_1 | 49.3% | 213 | 45.1% | 61 | 0.4721 | 0.3089 |
| 702_D_1 | 16.1% | 217 | 13.9% | 61 | 0.6723 | 0.7607 |
| 702_F_1 | 3.7% | 217 | 6.6% | 61 | 0.2044 | 0.2132 |
| 702_I_1 | 18.6% | 204 | 22.3% | 56 | 0.4185 | 0.3178 |
| 702_I_3 | 0.7% | 217 | 0.8% | 61 | 1.0000 | 1.0000 |
| 214_B_1 | 17.8% | 214 | 20.0% | 65 | 0.6044 | 0.0517 |
| 214_E_−1 | 48.8% | 202 | 50.0% | 59 | 0.8347 | 0.5796 |
| 214_E_+1 | 28.3% | 217 | 38.5% | 65 | 0.0305 | 0.0637 |

TABLE 14B

ASSOCIATION ANALYSIS OF TOTAL IgE PHENOTYPE
UK POPULATION
UK population

| GENE_EXON | FREQUENCIES | | | | ALLELE | GENOTYPE |
| --- | --- | --- | --- | --- | --- | --- |
| | CNTL | N | CASE | N | P-VALUE | P-VALUE |
| 454_B_1 | 7.3% | 109 | 5.3% | 47 | 0.6272 | 0.6139 |
| 454_E_−1 | 25.2% | 137 | 27.6% | 58 | 0.6154 | 0.8376 |
| 454_E_1 | 1.0% | 104 | 2.7% | 56 | 0.3478 | 0.3443 |

TABLE 14B-continued

ASSOCIATION ANALYSIS OF TOTAL IgE PHENOTYPE
UK POPULATION
UK population

| GENE_EXON | FREQUENCIES CNTL | N | CASE | N | ALLELE P-VALUE | GENOTYPE P-VALUE |
|---|---|---|---|---|---|---|
| 454_E_2 | 51.4% | 140 | 59.8% | 61 | 0.1286 | 0.1334 |
| 454_F_-2 | 33.2% | 137 | 24.6% | 61 | 0.0983 | 0.1632 |
| 454_G_-1 | 8.3% | 138 | 11.2% | 58 | 0.4433 | 0.3051 |
| 454_H_1 | 23.0% | 135 | 29.8% | 57 | 0.1586 | 0.1000 |
| 454_H_2 | 2.3% | 131 | 3.3% | 60 | 0.5130 | 0.5089 |
| 454_K_1 | 2.5% | 138 | 3.5% | 58 | 0.7384 | 0.7348 |
| 454_L_-1 | 5.7% | 140 | 6.2% | 56 | 0.8151 | 0.7942 |
| 454_M_1 | 42.9% | 133 | 33.7% | 49 | 0.1192 | 0.2262 |
| 454_M_2 | 5.9% | 136 | 7.0% | 57 | 0.6502 | 0.8070 |
| 454_M_+1 | 44.1% | 136 | 34.5% | 58 | 0.0911 | 0.0729 |
| 454_O_1 | 19.2% | 138 | 8.5% | 53 | 0.0125 | 0.0413 |
| 454_O_3 | 16.9% | 139 | 18.4% | 57 | 0.7693 | 0.1485 |
| 454_O_5 | 2.5% | 139 | 1.9% | 53 | 1.0000 | 1.0000 |
| 454_O_6 | 44.4% | 124 | 34.8% | 56 | 0.1056 | 0.0462 |
| 436_A_1 | 1.8% | 135 | 1.8% | 54 | 1.0000 | 0.7330 |
| 436_C_-1 | 13.7% | 139 | 14.7% | 58 | 0.8734 | 0.8810 |
| 436_D_1 | 3.7% | 136 | 4.3% | 58 | 0.7771 | 0.7732 |
| 436_E_1 | 45.3% | 137 | 40.4% | 57 | 0.4319 | 0.1736 |
| 436_G_1 | 9.8% | 138 | 10.0% | 55 | 1.0000 | 0.9280 |
| 436_K_-2 | 13.0% | 131 | 7.0% | 57 | 0.1094 | 0.2734 |
| 436_K_+1 | 2.8% | 123 | 4.3% | 58 | 0.5325 | 0.5259 |
| 436_L_-1 | 4.6% | 140 | 5.9% | 59 | 0.6184 | 0.6095 |
| 436_L_1 | 1.5% | 137 | 0.9% | 58 | 1.0000 | 1.0000 |
| 515_A_1 | 45.9% | 135 | 43.3% | 52 | 0.7281 | 0.9116 |
| 515_A_2 | 39.6% | 135 | 36.3% | 51 | 0.6334 | 0.8401 |
| 515_A_3 | 7.5% | 140 | 8.6% | 58 | 0.6854 | 0.6732 |
| 515_A_4 | 45.6% | 136 | 43.9% | 57 | 0.8227 | 0.9364 |
| 515_A_5 | 3.4% | 133 | 1.7% | 57 | 0.5167 | 0.5100 |
| 515_A_7 | 1.8% | 138 | 1.8% | 56 | 1.0000 | 1.0000 |
| 570_C_2 | 8.7% | 138 | 10.6% | 47 | 0.5421 | 0.5764 |
| 570_C_4 | 8.6% | 140 | 10.0% | 45 | 0.6735 | 0.5645 |
| 570_F_1 | 49.3% | 138 | 48.9% | 46 | 1.0000 | 0.6579 |
| 757_A_2 | 17.2% | 137 | 26.7% | 45 | 0.0649 | 0.0752 |
| 757_A_4 | 1.8% | 140 | 4.3% | 46 | 0.2332 | 0.2281 |
| 757_A_+4 | 40.3% | 139 | 40.6% | 48 | 1.0000 | 0.0252 |
| 698_E_1 | 5.4% | 140 | 13.3% | 49 | 0.0140 | 0.0180 |
| 698_I_+1 | 38.4% | 133 | 35.9% | 46 | 0.7094 | 0.6131 |
| 561_P_1 | 33.0% | 135 | 40.6% | 48 | 0.2126 | 0.2794 |
| 561_J_1 | 13.3% | 132 | 7.1% | 49 | 0.1388 | 0.3083 |
| 561_H_1 | 8.6% | 139 | 6.2% | 48 | 0.5218 | 0.5022 |
| 561_E_1 | 0.0% | 110 | 0.0% | 41 | 1.0000 | 1.0000 |
| 561_C_1 | 0.4% | 140 | 0.0% | 48 | 1.0000 | 1.0000 |
| 561_B_+1 | 15.0% | 137 | 15.0% | 40 | 1.0000 | 1.0000 |
| 561_B_1 | 52.2% | 135 | 46.3% | 40 | 0.3744 | 0.5410 |
| 561_Y_+1 | 5.5% | 136 | 0.0% | 47 | 0.0148 | 0.0129 |
| 561_X_-3 | 33.0% | 138 | 32.6% | 49 | 1.0000 | 0.7487 |
| 581_F_+2 | 24.6% | 140 | 21.7% | 53 | 0.5941 | 0.8802 |
| 722_C_1 | 35.0% | 133 | 29.3% | 53 | 0.3304 | 0.4590 |
| 722_F_+1 | 1.8% | 139 | 0.9% | 53 | 1.0000 | 1.0000 |
| 702_A_-1 | 7.2% | 138 | 7.7% | 52 | 0.8294 | 0.2921 |
| 702_C_1 | 47.8% | 136 | 45.3% | 53 | 0.7309 | 0.7299 |
| 702_D_1 | 17.9% | 140 | 14.1% | 53 | 0.4476 | 0.6600 |
| 702_F_1 | 2.9% | 140 | 5.7% | 53 | 0.2227 | 0.1546 |
| 702_I_1 | 18.3% | 131 | 20.8% | 48 | 0.6485 | 0.4405 |
| 702_I_3 | 1.1% | 140 | 0.9% | 53 | 1.0000 | 1.0000 |
| 214_B_1 | 19.2% | 138 | 21.3% | 54 | 0.6700 | 0.1252 |
| 214_E_-1 | 47.9% | 140 | 52.1% | 48 | 0.4807 | 0.5675 |
| 214_E_+1 | 30.7% | 140 | 38.9% | 54 | 0.1482 | 0.2246 |

TABLE 14C

ASSOCIATION ANALYSIS OF TOTAL IgE PHENOTYPE
US POPULATION
US population

| GENE_EXON | FREQUENCIES CNTL | N | CASE | N | ALLELE P-VALUE | GENOTYPE P-VALUE |
|---|---|---|---|---|---|---|
| 454_B_1 | 6.8% | 74 | 4.5% | 11 | 1.0000 | 1.0000 |
| 454_E_-1 | 27.0% | 76 | 9.1% | 11 | 0.1094 | 0.3156 |
| 454_E_1 | 0.7% | 75 | 0.0% | 11 | 1.0000 | 1.0000 |
| 454_E_2 | 44.8% | 77 | 50.0% | 11 | 0.6553 | 0.5025 |
| 454_F_-2 | 37.2% | 74 | 10.0% | 10 | 0.0214 | 0.1140 |
| 454_G_-1 | 8.4% | 77 | 4.5% | 11 | 1.0000 | 1.0000 |
| 454_H_1 | 20.3% | 69 | 63.6% | 11 | 0.0001 | 0.0001 |
| 454_H_2 | 1.5% | 67 | 9.1% | 11 | 0.0957 | 0.0932 |
| 454_K_1 | 0.7% | 77 | 0.0% | 11 | 1.0000 | 1.0000 |
| 454_L_-1 | 8.4% | 77 | 4.5% | 11 | 1.0000 | 1.0000 |
| 454_M_1 | 41.3% | 75 | 5.6% | 9 | 0.0034 | 0.0204 |
| 454_M_2 | 8.6% | 76 | 4.5% | 11 | 1.0000 | 1.0000 |
| 454_M_+1 | 41.4% | 76 | 13.6% | 11 | 0.0170 | 0.0132 |
| 454_O_1 | 18.8% | 77 | 9.1% | 11 | 0.3747 | 0.8371 |
| 454_O_3 | 18.8% | 77 | 18.2% | 11 | 1.0000 | 0.8248 |
| 454_O_5 | 4.0% | 76 | 0.0% | 10 | 1.0000 | 1.0000 |
| 454_O_6 | 39.2% | 74 | 13.6% | 11 | 0.0299 | 0.0138 |
| 436_A_1 | 0.0% | 68 | 0.0% | 10 | 1.0000 | 1.0000 |
| 436_C_-1 | 18.2% | 77 | 9.1% | 11 | 0.3766 | 0.8138 |
| 436_D_1 | 7.2% | 76 | 0.0% | 11 | 0.3630 | 0.6475 |
| 436_E_1 | 48.0% | 77 | 31.8% | 11 | 0.1757 | 0.1728 |
| 436_G_1 | 11.5% | 74 | 10.0% | 10 | 1.0000 | 1.0000 |
| 436_K_-2 | 18.5% | 73 | 10.0% | 10 | 0.5324 | 1.0000 |
| 436_K_+1 | 7.8% | 77 | 0.0% | 11 | 0.3665 | 0.4304 |
| 436_L_-1 | 3.9% | 77 | 4.5% | 11 | 1.0000 | 1.0000 |
| 436_L_1 | 2.6% | 77 | 4.5% | 11 | 0.4913 | 0.4957 |
| 515_A_1 | 38.2% | 76 | 45.5% | 11 | 0.6409 | 0.0155 |
| 515_A_2 | 32.9% | 76 | 40.9% | 11 | 0.4765 | 0.0234 |
| 515_A_3 | 7.1% | 77 | 0.0% | 11 | 0.3634 | 0.3458 |
| 515_A_4 | 39.6% | 72 | 44.4% | 9 | 0.7999 | 0.0332 |
| 515_A_5 | 5.4% | 74 | 0.0% | 9 | 0.6008 | 0.5894 |
| 515_A_7 | 3.3% | 75 | 0.0% | 11 | 1.0000 | 1.0000 |
| 570_C_2 | 11.0% | 77 | 0.0% | 4 | 1.0000 | 1.0000 |
| 570_C_4 | 11.0% | 77 | 0.0% | 4 | 1.0000 | 1.0000 |
| 570_F_1 | 45.5% | 77 | 50.0% | 4 | 1.0000 | 0.0375 |
| 757_A_2 | 19.9% | 73 | 22.2% | 9 | 0.7616 | 0.6620 |
| 757_A_4 | 1.3% | 78 | 5.6% | 9 | 0.2808 | 0.2823 |
| 757_A_+4 | 37.7% | 77 | 44.4% | 9 | 0.6140 | 0.7660 |
| 698_E_1 | 9.7% | 77 | 0.0% | 9 | 0.3721 | 0.6785 |
| 698_I_+1 | 22.4% | 76 | 27.8% | 9 | 0.5652 | 0.3464 |
| 561_P_1 | 35.8% | 74 | 38.9% | 9 | 0.7997 | 0.2279 |
| 561_J_1 | 17.8% | 76 | 27.8% | 9 | 0.3388 | 0.3272 |
| 561_H_1 | 9.6% | 73 | 28.6% | 7 | 0.0550 | 0.0419 |
| 561_E_1 | 0.0% | 68 | 7.1% | 7 | 0.0933 | 0.0933 |
| 561_C_1 | 0.0% | 77 | 5.6% | 9 | 0.1047 | 0.1047 |
| 561_B_+1 | 10.7% | 75 | 11.1% | 9 | 1.0000 | 1.0000 |
| 561_B_1 | 41.3% | 75 | 38.9% | 9 | 1.0000 | 1.0000 |
| 561_Y_+1 | 3.3% | 76 | 12.5% | 8 | 0.1348 | 0.1312 |
| 561_X_-3 | 28.3% | 76 | 16.7% | 9 | 0.4045 | 0.7647 |
| 581_F_+2 | 23.7% | 76 | 25.0% | 8 | 1.0000 | 0.1246 |
| 722_C_1 | 29.6% | 76 | 37.5% | 8 | 0.5706 | 0.6624 |
| 722_F_+1 | 0.6% | 78 | 0.0% | 8 | 1.0000 | 1.0000 |
| 702_A_-1 | 6.5% | 77 | 6.2% | 8 | 1.0000 | 1.0000 |
| 702_C_1 | 52.0% | 77 | 43.8% | 8 | 0.6050 | 0.4101 |
| 702_D_1 | 13.0% | 77 | 12.5% | 8 | 1.0000 | 1.0000 |
| 702_F_1 | 5.2% | 77 | 12.5% | 8 | 0.2393 | 0.2370 |
| 702_I_1 | 19.2% | 73 | 31.3% | 8 | 0.3233 | 0.3168 |
| 702_I_3 | 0.0% | 77 | 0.0% | 8 | 1.0000 | 1.0000 |
| 214_B_1 | 15.1% | 76 | 13.6% | 11 | 1.0000 | 1.0000 |
| 214_E_-1 | 50.8% | 62 | 40.9% | 11 | 0.4894 | 0.5711 |
| 214_E_+1 | 24.0% | 77 | 36.4% | 11 | 0.2943 | 0.2456 |

For the total IgE phenotype, SNPs in Gene 454, Gene 436 and Gene 214 showed a significant association in the combined population when comparing the allele frequencies in the case and control groups. When analyzing the population separately, SNPs in gene 454 were significant in both the UK and US populations, separately, while SNPs in Gene 698 and Gene 561 showed a significant association in the UK population. Additional significant results were identified when comparing the genotype frequencies in the case and control groups. SNPs in Gene 454 (US, UK, and combined), Gene 515 (US), Gene 570 (US), Gene 757 (UK and combined), Gene 698 (UK), and Gene 561 (US, and UK), reached statistical significance.

The most significant results were obtained for Gene 454, where 6 SNPs showed significant association with the phenotype at the allelic level in the combined population and in one of the subpopulations. SNP H 1 showed highly significant results in the combined and US populations (p=0.003 for the allele test and p=0.001 for the genotype test in the combined population, 22% in control vs. 35% in cases, p=0.0001 in US for both tests, 20% in controls vs. 64% in cases). Two other SNPs had p-values <0.01 in the combined population: 1) SNP F −2 (p=0.009 for the allele test and p=0.01 for the genotype test in the combined population, 35% in controls vs. 23% in cases; p=0.02 in US, 37% in controls vs. 10% in cases); and 2) SNP O 1 (p=0.004 for the allele test and p=0.02 for the genotype test in the combined population, 19% in controls vs. 9% in cases; p=0.01 and p=0.04 for the allele and genotype tests respectively in UK, 19% in controls vs. 8% in cases). Another SNP in exon O (O 6) had a p-value in the significant range (p=0.02 and p<0.05 for the allele and genotype tests respectively, in the combined population, 42% of controls vs. 31% of cases; p=0.03 for the allele test and p=0.01 for the genotype test in US, 39% of controls vs. 14% of cases; p<0.05 in UK for genotype test). In addition, two SNPs in high linkage disequilibrium with each other reached statistical significance in exon M: 1) M 1 (p=0.01 and p=0.04 for the allele and genotype tests, respectively, in the combined population, 42% in controls vs. 29% in cases; p=0.003 for the allele test and p=0.02 for the genotype test in US, 41% in controls vs. 6% in cases); and 2) M +1 (p=0.01 for the allele test and p=0.03 for the genotype test in the combined population, 43% in controls vs. 31% in cases; p=0.02 and p=0.01 for the allele and genotype tests respectively, in US, 41% of controls vs. 14% of cases).

Gene 436 and Gene 214 both showed a single SNP that reached statistical significance in the combined population only. In Gene 436, which is adjacent to Gene 454, SNP K −2 was significant (p=0.03, 15% in controls vs. 7% of cases), while in Gene 214, SNP E +1 reached a similar level of significance (p=0.03, 28% in controls vs. 38% of cases).

For Gene 561, SNP Y +1 reached statistical significance in the UK population (p=0.01 for both the allele and genotype tests, 6% in controls vs. no occurrence in cases) while SNP H 1 showed a significant genotype test in the US population (p=0.04).

A single SNP in Gene 698 showed a significant association with the total IgE subphenotype in the UK population (p=0.01 for the allele test and p=0.02 for the genotype test, 5% of controls vs. 13% of cases).

For Gene 757, SNP A +4 showed a significant genotype test in both the combined and the UK samples (p<0.05 combined, p=0.03 UK). SNPs in two genes, Gene 515 and Gene 570, had significant genotype p-values in the US population alone (515 A 1, p=0.02; 515 A 2, p=0.02; 515 A 4; p=0.03; 570 F 1, p=0.04).

d. Specific IgE: The analyses were performed using asthmatic children with elevated specific IgE levels for at least one allergen, as described in the Linkage Analysis section (Example 3). First, sibling pairs were identified where both sibs were affected and satisfied this new criteria. Of these pairs, one sib was included in the case/control analyses if they showed evidence of linkage at the gene of interest. This phenotype was more restrictive than the Asthma yes/no criteria; hence the number of cases included in the analyses was reduced by approximately 38%.

Figure 17:
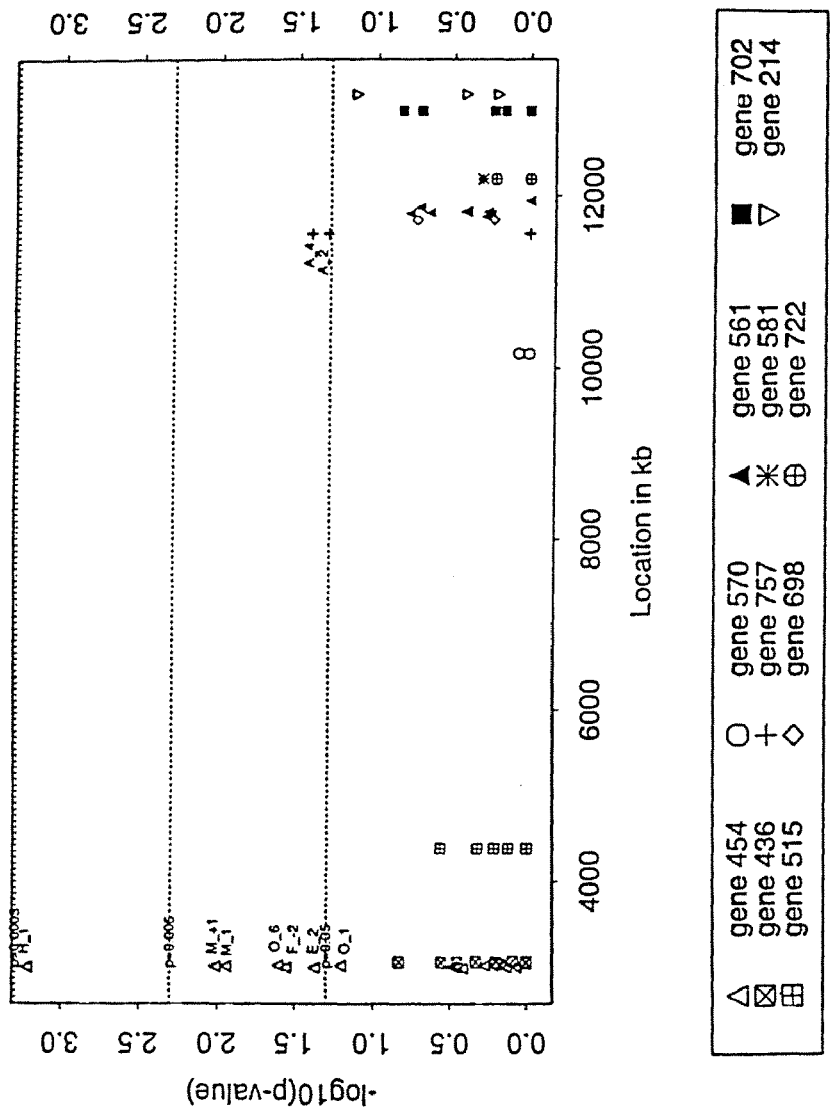
FIG. 17 shows the significance ($-\log_{10}$(p-value)) for the comparison of SNP allele frequencies in cases (specific IgE and asthma) and controls in the combined population against the relative location (Kb) of SNPs along chromosome 12.
Figure 18:
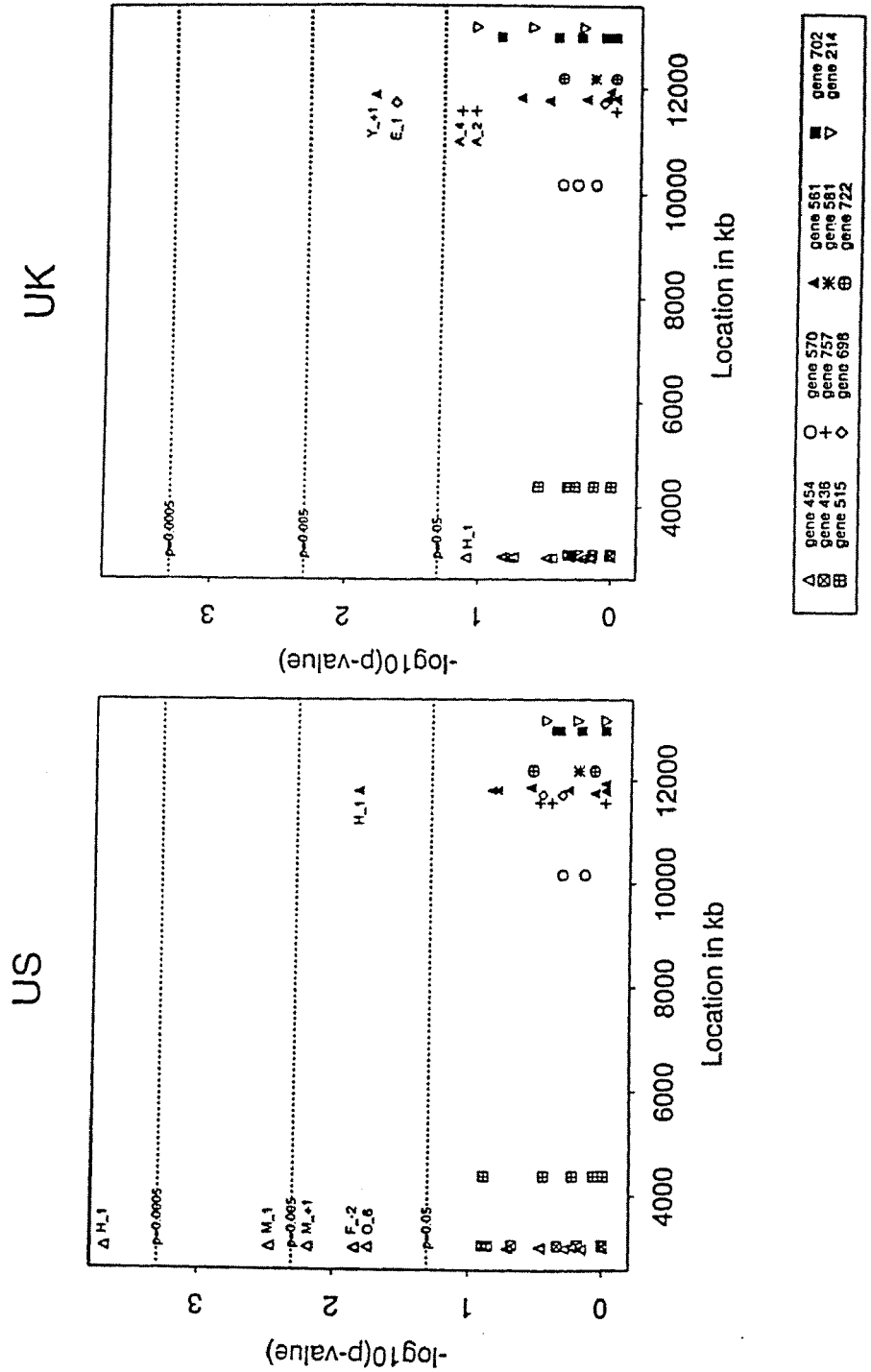
FIG. 18 shows the significance ($-\log_{10}$(p-value)) for the comparison of SNP allele frequencies in cases (specific IgE and asthma) and controls in the US and UK populations against the relative location (Kb) of SNPs along chromosome 12.

The significance levels (p-values) for allelic association of the typed SNPs to the specific IgE phenotype are plotted in FIG. 17 (combined population) and FIG. 18 (US and UK populations, separately). Frequencies and p-values for SNPs associated with the specific IgE phenotype are shown in Tables 15A, 15B, and 15C for the combined population and for the UK and US populations, separately.

TABLE 15A

ASSOCIATION ANALYSIS OF SPECIFIC IgE PHENOTYPE COMBINED US/UK POPULATIONS
Combined US and UK

| GENE_EXON | FREQUENCIES | | | | ALLELE | GENOTYPE |
|---|---|---|---|---|---|---|
| | CNTL | N | CASE | N | P-VALUE | P-VALUE |
| 454_B_1 | 7.1% | 183 | 4.4% | 57 | 0.3858 | 0.3685 |
| 454_E_−1 | 25.8% | 213 | 27.5% | 69 | 0.7385 | 0.8563 |
| 454_E_1 | 0.8% | 179 | 2.2% | 69 | 0.3551 | 0.3524 |
| 454_E_2 | 49.1% | 217 | 59.2% | 71 | 0.0422 | 0.0191 |
| 454_F_−2 | 34.6% | 211 | 24.3% | 70 | 0.0279 | 0.0078 |
| 454_G_−1 | 8.4% | 215 | 8.7% | 69 | 0.8621 | 0.3087 |
| 454_H_1 | 22.1% | 204 | 37.5% | 68 | 0.0006 | 0.0003 |
| 454_H_2 | 2.0% | 198 | 3.6% | 70 | 0.3392 | 0.3340 |
| 454_K_1 | 1.9% | 215 | 3.6% | 70 | 0.3240 | 0.3186 |
| 454_L_−1 | 6.7% | 217 | 7.4% | 68 | 0.8457 | 0.9252 |
| 454_M_1 | 42.3% | 208 | 29.5% | 61 | 0.0115 | 0.0316 |
| 454_M_2 | 6.8% | 212 | 8.0% | 69 | 0.7032 | 0.8558 |
| 454_M_+1 | 43.2% | 212 | 30.7% | 70 | 0.0097 | 0.0245 |
| 454_O_1 | 19.1% | 215 | 11.7% | 64 | 0.0625 | 0.1300 |
| 454_O_3 | 17.6% | 216 | 19.6% | 69 | 0.6122 | 0.3714 |
| 454_O_5 | 3.0% | 215 | 1.5% | 65 | 0.5384 | 0.5325 |
| 454_O_6 | 42.4% | 198 | 31.3% | 67 | 0.0248 | 0.0468 |
| 436_A_1 | 1.2% | 203 | 1.5% | 65 | 0.6786 | 0.6956 |
| 436_C_−1 | 15.3% | 216 | 15.0% | 70 | 1.0000 | 0.8439 |
| 436_D_1 | 5.0% | 212 | 2.9% | 70 | 0.3531 | 0.5945 |
| 436_E_1 | 46.3% | 214 | 40.6% | 69 | 0.2791 | 0.1703 |
| 436_G_1 | 10.4% | 212 | 11.9% | 67 | 0.6320 | 0.6418 |
| 436_K_−2 | 14.9% | 204 | 9.6% | 68 | 0.1478 | 0.2662 |
| 436_K_+1 | 4.7% | 200 | 2.9% | 69 | 0.4675 | 0.7077 |
| 436_L_−1 | 4.4% | 217 | 4.9% | 71 | 0.8164 | 0.8123 |
| 436_L_1 | 1.9% | 214 | 1.4% | 70 | 1.0000 | 1.0000 |
| 515_A_1 | 43.1% | 211 | 39.1% | 64 | 0.4746 | 0.4804 |
| 515_A_2 | 37.2% | 211 | 35.2% | 64 | 0.7536 | 0.7931 |
| 515_A_3 | 7.4% | 217 | 7.1% | 70 | 1.0000 | 1.0000 |
| 515_A_4 | 43.5% | 208 | 40.8% | 65 | 0.6126 | 0.3468 |
| 515_A_5 | 4.1% | 207 | 1.5% | 66 | 0.2720 | 0.1767 |
| 515_A_7 | 2.4% | 213 | 0.8% | 67 | 0.4735 | 0.4692 |
| 570_C_2 | 9.5% | 215 | 10.4% | 53 | 0.8545 | 0.8669 |
| 570_C_4 | 9.5% | 217 | 9.6% | 52 | 1.0000 | 1.0000 |
| 570_F_1 | 47.9% | 215 | 48.1% | 52 | 1.0000 | 0.7607 |
| 757_A_2 | 18.1% | 210 | 26.7% | 58 | 0.0486 | 0.1177 |
| 757_A_4 | 1.6% | 218 | 5.1% | 59 | 0.0381 | 0.0362 |
| 757_A_+4 | 39.4% | 216 | 39.3% | 61 | 1.0000 | 0.2242 |
| 698_E_1 | 6.9% | 217 | 10.7% | 61 | 0.1808 | 0.2696 |
| 698_I_+1 | 32.5% | 209 | 35.6% | 59 | 0.5802 | 0.7116 |
| 561_P_1 | 34.0% | 209 | 37.3% | 59 | 0.5127 | 0.1175 |
| 561_J_1 | 14.9% | 208 | 12.3% | 61 | 0.5571 | 0.7970 |
| 561_H_1 | 9.0% | 212 | 13.6% | 59 | 0.1635 | 0.1228 |
| 561_E_1 | 0.0% | 178 | 1.0% | 50 | 0.2193 | 0.2193 |
| 561_C_1 | 0.2% | 217 | 0.8% | 60 | 0.3866 | 0.3869 |
| 561_B_+1 | 13.4% | 212 | 15.7% | 51 | 0.5276 | 0.6102 |
| 561_B_1 | 48.3% | 210 | 43.1% | 51 | 0.3773 | 0.6088 |
| 561_Y_+1 | 4.7% | 212 | 1.7% | 59 | 0.1892 | 0.1797 |
| 561_X_−3 | 31.3% | 214 | 31.1% | 61 | 1.0000 | 0.8639 |
| 581_F_+2 | 24.3% | 216 | 21.2% | 66 | 0.4850 | 0.7321 |
| 722_C_1 | 33.0% | 209 | 30.3% | 66 | 0.5949 | 0.5842 |
| 722_F_+1 | 1.4% | 217 | 1.5% | 66 | 1.0000 | 1.0000 |
| 702_A_−1 | 7.0% | 215 | 5.4% | 65 | 0.6871 | 0.8700 |
| 702_C_1 | 49.3% | 213 | 42.4% | 66 | 0.1948 | 0.2350 |
| 702_D_1 | 16.1% | 217 | 13.6% | 66 | 0.5835 | 0.7346 |
| 702_F_1 | 3.7% | 217 | 6.8% | 66 | 0.1457 | 0.1282 |
| 702_I_1 | 18.6% | 204 | 18.9% | 61 | 1.0000 | 0.9620 |
| 702_I_3 | 0.7% | 217 | 0.8% | 66 | 1.0000 | 1.0000 |

TABLE 15A-continued

ASSOCIATION ANALYSIS OF SPECIFIC IgE PHENOTYPE
COMBINED US/UK POPULATIONS
Combined US and UK

| GENE_EXON | FREQUENCIES CNTL | N | CASE | N | ALLELE P-VALUE | GENOTYPE P-VALUE |
|---|---|---|---|---|---|---|
| 214_B_1 | 17.8% | 214 | 21.4% | 70 | 0.3816 | 0.1069 |
| 214_E_-1 | 48.8% | 202 | 51.5% | 65 | 0.6147 | 0.4246 |
| 214_E_+1 | 28.3% | 217 | 36.4% | 70 | 0.0732 | 0.1699 |

TABLE 15B

ASSOCIATION ANALYSIS OF SPECIFIC IgE PHENOTYPE
UK POPULATION
UK population

| GENE_EXON | FREQUENCIES CNTL | N | CASE | N | ALLELE P-VALUE | GENOTYPE P-VALUE |
|---|---|---|---|---|---|---|
| 454_B_1 | 7.3% | 109 | 4.9% | 41 | 0.6057 | 0.5919 |
| 454_E_-1 | 25.2% | 137 | 29.8% | 52 | 0.3638 | 0.5956 |
| 454_E_1 | 1.0% | 104 | 2.9% | 51 | 0.3357 | 0.3319 |
| 454_E_2 | 51.4% | 140 | 59.4% | 53 | 0.1712 | 0.0812 |
| 454_F_-2 | 33.2% | 137 | 27.4% | 53 | 0.3250 | 0.1607 |
| 454_G_-1 | 8.3% | 138 | 9.6% | 52 | 0.6859 | 0.4084 |
| 454_H_1 | 23.0% | 135 | 32.0% | 50 | 0.0817 | 0.0497 |
| 454_H_2 | 2.3% | 131 | 2.9% | 52 | 0.7176 | 0.7151 |
| 454_K_1 | 2.5% | 138 | 3.9% | 52 | 0.5014 | 0.4963 |
| 454_L_-1 | 5.7% | 140 | 6.9% | 51 | 0.6346 | 0.6851 |
| 454_M_1 | 42.9% | 133 | 34.8% | 46 | 0.1789 | 0.2977 |
| 454_M_2 | 5.9% | 136 | 7.8% | 51 | 0.4836 | 0.6185 |
| 454_M_+1 | 44.1% | 136 | 35.6% | 52 | 0.1606 | 0.1308 |
| 454_O_1 | 19.2% | 138 | 12.0% | 46 | 0.1520 | 0.3074 |
| 454_O_3 | 16.9% | 139 | 19.6% | 51 | 0.5458 | 0.5276 |
| 454_O_5 | 2.5% | 139 | 2.1% | 48 | 1.0000 | 1.0000 |
| 454_O_6 | 44.4% | 124 | 36.0% | 50 | 0.1866 | 0.0843 |
| 436_A_1 | 1.8% | 135 | 2.1% | 48 | 1.0000 | 0.7112 |
| 436_C_-1 | 13.7% | 139 | 16.3% | 52 | 0.5150 | 0.7671 |
| 436_D_1 | 3.7% | 136 | 3.9% | 52 | 1.0000 | 1.0000 |
| 436_E_1 | 45.3% | 137 | 43.1% | 51 | 0.7279 | 0.1848 |
| 436_G_1 | 9.8% | 138 | 12.0% | 50 | 0.5669 | 0.7893 |
| 436_K_-2 | 13.0% | 131 | 9.8% | 51 | 0.4765 | 0.8412 |
| 436_K_+1 | 2.8% | 123 | 3.9% | 51 | 0.7370 | 0.7329 |
| 436_L_-1 | 4.6% | 140 | 4.7% | 53 | 1.0000 | 1.0000 |
| 436_L_1 | 1.5% | 137 | 1.0% | 52 | 1.0000 | 1.0000 |
| 515_A_1 | 45.9% | 135 | 39.4% | 47 | 0.2805 | 0.4975 |
| 515_A_2 | 39.6% | 135 | 35.1% | 47 | 0.4624 | 0.5032 |
| 515_A_3 | 7.5% | 140 | 9.6% | 52 | 0.5288 | 0.5106 |
| 515_A_4 | 45.6% | 136 | 41.2% | 51 | 0.4841 | 0.7514 |
| 515_A_5 | 3.4% | 133 | 2.0% | 50 | 0.7340 | 0.7298 |
| 515_A_7 | 1.8% | 138 | 1.0% | 50 | 1.0000 | 1.0000 |
| 570_C_2 | 8.7% | 138 | 11.9% | 42 | 0.3960 | 0.4214 |
| 570_C_4 | 8.6% | 140 | 11.0% | 41 | 0.5152 | 0.5345 |
| 570_F_1 | 49.3% | 138 | 46.4% | 42 | 0.7088 | 0.8441 |
| 757_A_2 | 17.2% | 137 | 26.1% | 44 | 0.0869 | 0.0746 |
| 757_A_4 | 1.8% | 140 | 5.6% | 45 | 0.0678 | 0.0650 |
| 757_A_+4 | 40.3% | 139 | 40.4% | 47 | 1.0000 | 0.1374 |
| 698_E_1 | 5.4% | 140 | 12.8% | 47 | 0.0217 | 0.0283 |
| 698_I_+1 | 38.4% | 133 | 36.7% | 45 | 0.8028 | 0.9428 |
| 561_P_1 | 33.0% | 135 | 38.9% | 45 | 0.3087 | 0.2299 |
| 561_J_1 | 13.3% | 132 | 10.6% | 47 | 0.5897 | 0.5133 |
| 561_H_1 | 8.6% | 139 | 9.6% | 47 | 0.8341 | 0.8259 |
| 561_E_1 | 0.0% | 110 | 0.0% | 39 | 1.0000 | 1.0000 |
| 561_C_1 | 0.4% | 140 | 0.0% | 46 | 1.0000 | 1.0000 |
| 561_B_+1 | 15.0% | 137 | 16.2% | 37 | 0.8554 | 0.9302 |
| 561_B_1 | 52.2% | 135 | 43.2% | 37 | 0.1905 | 0.3461 |
| 561_Y_+1 | 5.5% | 136 | 0.0% | 46 | 0.0152 | 0.0133 |
| 561_X_-3 | 33.0% | 138 | 31.9% | 47 | 0.8992 | 0.6051 |
| 581_F_+2 | 24.6% | 140 | 22.1% | 52 | 0.6870 | 0.9085 |
| 722_C_1 | 35.0% | 133 | 29.8% | 52 | 0.3918 | 0.5778 |
| 722_F_+1 | 1.8% | 139 | 1.0% | 52 | 1.0000 | 1.0000 |
| 702_A_-1 | 7.2% | 138 | 5.9% | 51 | 0.8196 | 0.8126 |
| 702_C_1 | 47.8% | 136 | 42.3% | 52 | 0.3570 | 0.6439 |
| 702_D_1 | 17.9% | 140 | 14.4% | 52 | 0.5402 | 0.6574 |

TABLE 15B-continued

ASSOCIATION ANALYSIS OF SPECIFIC IgE PHENOTYPE
UK POPULATION
UK population

| GENE_EXON | FREQUENCIES CNTL | N | CASE | N | ALLELE P-VALUE | GENOTYPE P-VALUE |
|---|---|---|---|---|---|---|
| 702_F_1 | 2.9% | 140 | 6.7% | 52 | 0.1328 | 0.0644 |
| 702_I_1 | 18.3% | 131 | 17.0% | 47 | 0.8760 | 1.0000 |
| 702_I_3 | 1.1% | 140 | 1.0% | 52 | 1.0000 | 1.0000 |
| 214_B_1 | 19.2% | 138 | 22.1% | 52 | 0.5656 | 0.1256 |
| 214_E_-1 | 47.9% | 140 | 55.3% | 47 | 0.2340 | 0.2996 |
| 214_E_+1 | 30.7% | 140 | 40.4% | 52 | 0.0880 | 0.1988 |

TABLE 15C

ASSOCIATION ANALYSIS OF SPECIFIC IgE PHENOTYPE
US POPULATION
US population

| GENE_EXON | FREQUENCIES CNTL | N | CASE | N | ALLELE P-VALUE | GENOTYPE P-VALUE |
|---|---|---|---|---|---|---|
| 454_B_1 | 6.8% | 74 | 3.1% | 16 | 0.6918 | 0.6812 |
| 454_E_-1 | 27.0% | 76 | 20.6% | 17 | 0.5205 | 0.6956 |
| 454_E_1 | 0.7% | 75 | 0.0% | 18 | 1.0000 | 1.0000 |
| 454_E_2 | 44.8% | 77 | 58.3% | 18 | 0.1940 | 0.3576 |
| 454_F_-2 | 37.2% | 74 | 14.7% | 17 | 0.0144 | 0.0720 |
| 454_G_-1 | 8.4% | 75 | 5.9% | 17 | 1.0000 | 1.0000 |
| 454_H_1 | 20.3% | 69 | 52.8% | 18 | 0.0002 | 0.0006 |
| 454_H_2 | 1.5% | 67 | 5.6% | 18 | 0.1974 | 0.1956 |
| 454_K_1 | 0.7% | 77 | 2.8% | 18 | 0.3439 | 0.3447 |
| 454_L_-1 | 8.4% | 77 | 8.8% | 17 | 1.0000 | 0.7920 |
| 454_M_1 | 41.3% | 75 | 13.3% | 15 | 0.0034 | 0.0214 |
| 454_M_2 | 8.6% | 76 | 8.3% | 18 | 1.0000 | 0.8025 |
| 454_M_+1 | 41.4% | 76 | 16.7% | 18 | 0.0066 | 0.0220 |
| 454_O_1 | 18.8% | 77 | 11.1% | 18 | 0.3355 | 0.7150 |
| 454_O_3 | 18.8% | 77 | 19.4% | 18 | 1.0000 | 0.7780 |
| 454_O_5 | 4.0% | 76 | 0.0% | 17 | 0.5942 | 0.5880 |
| 454_O_6 | 39.2% | 74 | 17.6% | 17 | 0.0177 | 0.0437 |
| 436_A_1 | 0.0% | 68 | 0.0% | 17 | 1.0000 | 1.0000 |
| 436_C_-1 | 18.2% | 77 | 11.1% | 18 | 0.4578 | 0.8790 |
| 436_D_1 | 7.2% | 76 | 0.0% | 18 | 0.1275 | 0.3513 |
| 436_E_1 | 48.0% | 77 | 33.3% | 18 | 0.1373 | 0.2901 |
| 436_G_1 | 11.5% | 74 | 11.8% | 17 | 1.0000 | 0.8232 |
| 436_K_-2 | 18.5% | 73 | 8.8% | 17 | 0.2097 | 0.7103 |
| 436_K_+1 | 7.8% | 77 | 0.0% | 18 | 0.1272 | 0.3516 |
| 436_L_-1 | 3.9% | 77 | 5.6% | 18 | 0.6478 | 0.6439 |
| 436_L_1 | 2.6% | 77 | 2.8% | 18 | 1.0000 | 1.0000 |
| 515_A_1 | 38.2% | 76 | 38.2% | 17 | 1.0000 | 0.0236 |
| 515_A_2 | 32.9% | 76 | 35.3% | 17 | 0.8414 | 0.0275 |
| 515_A_3 | 7.1% | 77 | 0.0% | 18 | 0.1286 | 0.1169 |
| 515_A_4 | 39.6% | 72 | 39.3% | 14 | 1.0000 | 0.0307 |
| 515_A_5 | 5.4% | 74 | 0.0% | 16 | 0.3538 | 0.3418 |
| 515_A_7 | 3.3% | 75 | 0.0% | 17 | 0.5860 | 0.5798 |
| 570_C_2 | 11.0% | 77 | 4.5% | 11 | 0.7043 | 0.7580 |
| 570_C_4 | 11.0% | 77 | 4.5% | 11 | 0.7043 | 1.0000 |
| 570_F_1 | 45.5% | 77 | 55.0% | 10 | 0.4796 | 0.1204 |
| 757_A_2 | 19.9% | 73 | 28.6% | 14 | 0.3178 | 0.1027 |
| 757_A_4 | 1.3% | 78 | 3.6% | 14 | 0.3924 | 0.3942 |
| 757_A_+4 | 37.7% | 77 | 35.7% | 14 | 1.0000 | 1.0000 |
| 698_E_1 | 9.7% | 77 | 3.6% | 14 | 0.4729 | 0.7729 |
| 698_I_+1 | 22.4% | 76 | 32.1% | 14 | 0.3337 | 0.2961 |
| 561_P_1 | 35.8% | 74 | 32.1% | 14 | 0.8304 | 0.2910 |
| 561_J_1 | 17.8% | 76 | 17.9% | 14 | 1.0000 | 0.8292 |
| 561_H_1 | 9.6% | 73 | 29.2% | 12 | 0.0142 | 0.0197 |
| 561_E_1 | 0.0% | 68 | 4.5% | 11 | 0.1392 | 0.1392 |
| 561_C_1 | 0.0% | 77 | 3.6% | 14 | 0.1538 | 0.1538 |
| 561_B_+1 | 10.7% | 75 | 14.3% | 14 | 0.5260 | 0.5082 |
| 561_B_1 | 41.3% | 75 | 42.9% | 14 | 1.0000 | 1.0000 |
| 561_Y_+1 | 3.3% | 76 | 7.7% | 13 | 0.2714 | 0.2702 |
| 561_X_-3 | 28.3% | 76 | 28.6% | 14 | 1.0000 | 1.0000 |
| 581_F_+2 | 23.7% | 76 | 17.9% | 14 | 0.6274 | 0.3029 |
| 722_C_1 | 29.6% | 76 | 32.1% | 14 | 0.8239 | 0.7629 |
| 722_F_+1 | 0.6% | 78 | 3.6% | 14 | 0.2819 | 0.2826 |

TABLE 15C-continued

ASSOCIATION ANALYSIS OF SPECIFIC IgE PHENOTYPE
US POPULATION
US population

| GENE_EXON | FREQUENCIES | | | | ALLELE P-VALUE | GENOTYPE P-VALUE |
|---|---|---|---|---|---|---|
| | CNTL | N | CASE | N | | |
| 702__A__−1 | 6.5% | 77 | 3.6% | 14 | 1.0000 | 1.0000 |
| 702__C__1 | 52.0% | 77 | 42.9% | 14 | 0.4162 | 0.0825 |
| 702__D__1 | 13.0% | 77 | 10.7% | 14 | 1.0000 | 1.0000 |
| 702__F__1 | 5.2% | 77 | 7.1% | 14 | 0.6533 | 0.6486 |
| 702__I__1 | 19.2% | 73 | 25.0% | 14 | 0.4519 | 0.6731 |
| 702__I__3 | 0.0% | 77 | 0.0% | 14 | 1.0000 | 1.0000 |
| 214__B__1 | 15.1% | 76 | 19.4% | 18 | 0.6124 | 0.5757 |
| 214__E__−1 | 50.8% | 62 | 41.7% | 18 | 0.3509 | 0.4623 |
| 214__E__+1 | 24.0% | 77 | 25.0% | 18 | 1.0000 | 1.0000 |

For the specific IgE subphenotype, SNPs in Gene 454 and Gene 757 showed a significant association in the combined population when comparing the allele frequencies in the case and control groups. When analyzing the populations separately, SNPs in Gene 561 showed a significant association in both the US and UK populations. In addition, five SNPs in Gene 454 showed association with the subphenotype in the US population. Gene 698 contained a SNP reaching statistical significance in the UK population only. Additional significant results were identified when comparing the genotype frequencies in the case and control groups. SNPs in Gene 515, Gene 561, and Gene 454 reached statistical significance in the US population. SNPs in Gene 454, Gene 561, and Gene 698 were significant in the UK and in the combined population. In addition, a SNP in gene 757 was significant at the 0.05 level in the combined population.

The most significant results were found in Gene 454, where 6 SNPs yield significant association with the subphenotype in the combined population. SNP H 1 showed highly significant results in the combined and US populations (p=0.0006 and 0.0003 for the allele and genotype tests respectively in the combined population, 22% in control vs. 38% in cases; p=0.0002 for the allele test and p=0.0006 for the genotype test in the US population, 20% in controls vs. 53% in cases; genotypic test p<0.05 in the UK population). Two SNPs in exon M gave significant results: 1) M 1 (p=0.01 and p=0.03 for the allele and genotype tests in the combined population, 42% in controls vs. 30% in cases; p=0.003 for the allele and p=0.02 for the genotype test in US, 41% in controls vs. 13% in cases); and 2) M +1 (p=0.01 and p=0.02 for the allele and genotype tests respectively, in the combined population, 43% in controls vs. 31% in cases; p=0.007 for the allele and p=0.02 for the genotype test in US, 41% of controls vs. 17% of cases). Three other SNPs had p-values <0.05 in the combined population: 1) SNP E 2 (p=0.04 and p=0.02 for the allele and genotype tests respectively, in the combined population, 49% in controls vs. 59% in cases); 2) SNP F −2 (p=0.03 and p=0.008 for the allele and genotype tests respectively, in the combined population, 35% in controls vs. 24% in cases; p=0.01 for the allele test in US, 37% in controls vs. 15% in cases); and 3) SNP O 6 (p=0.02 and p<0.05 for the allele and genotype tests respectively, in the combined population, 42% in controls vs. 31% in cases; p=0.02 for the allele test and p=0.04 for the genotype test in US, 39% in controls vs. 18% in cases).

For Gene 561, SNP Y +1 reached statistical significance in the UK population (p=0.02 and p=0.01 for the allele and genotype tests respectively, 6% in controls vs. no occurrence in cases) while SNP H 1 had a significant p-value in the US population (p=0.01 and p=0.02 for the allele and genotype tests respectively, 10% in controls vs. 29% in cases).

A single SNP in Gene 698 showed a significant association with the specific IgE subphenotype in the UK population (p=0.02 and p=0.03 for the allele and genotype tests respectively, 5% of controls vs. 13% of cases).

For Gene 757, SNPs A 2 and A 4 showed a significant association with the subphenotype in the combined population (A 2 p<0.05, 18% in controls vs. 27% in cases; A 4 p=0.04 for both the allele and genotype tests, 2% in controls vs. 5% in cases).

Additionally, three SNPs in Gene 515 had significant genotype p-values in the US population alone (A 1, p=0.02; A 2, p=0.03; A 4; p=0.03).

In summary, evidence obtained from association studies implicated several genes in the 12q23-ter region as being involved in respiratory diseases. This was supported by analysis of the asthma (yes/no) phenotype, BHR phenotype, total IgE phenotype, and specific IgE phenotype in asthmatic individuals. Thus, chromosome 12q23-ter encompassed genes involved in asthma and related diseases thereof.

Example 12

Haplotype Analyses

In addition to the analysis of individual SNPs, haplotype frequencies between the case and control groups were also compared. The haplotypes were constructed using a maximum likelihood approach. Since existing software for predicting haplotypes was unable to utilize individuals with missing data, a program was developed to analyze all individuals. This provided more accurate haplotype frequency estimates. Haplotype analysis based on multiple SNPs in a gene was expected to provide increased evidence for an association between a given phenotype and that gene if all haplotyped SNPs were involved in the manifestation of the phenotype. In other words, allelic variation involving the haplotyped SNPs was expected to be associated with different risks of or susceptibilities to the phenotype.

The estimated frequency of each haplotype was compared between cases and controls by a permutation test. An overall comparison of the distribution of all haplotypes between the two groups was also performed. For each gene with two SNPs or more, all 2-at-a-time haplotypes were constructed, and their frequencies were compared between the case and control groups. P-values for the overall comparisons were plotted against a coordinate system based on genomic sequence (average location of the two SNPs in the haplotype). This was used to visualize regions where haplotype association was present. A small p-value (or a large value of −log(p) as plotted in the figures described below) was indicative of an association between the haplotyped SNPs and the disease phenotype. The analysis was repeated for the US and UK population, separately, to adjust for the possibility of genetic heterogeneity.

Figure 19:
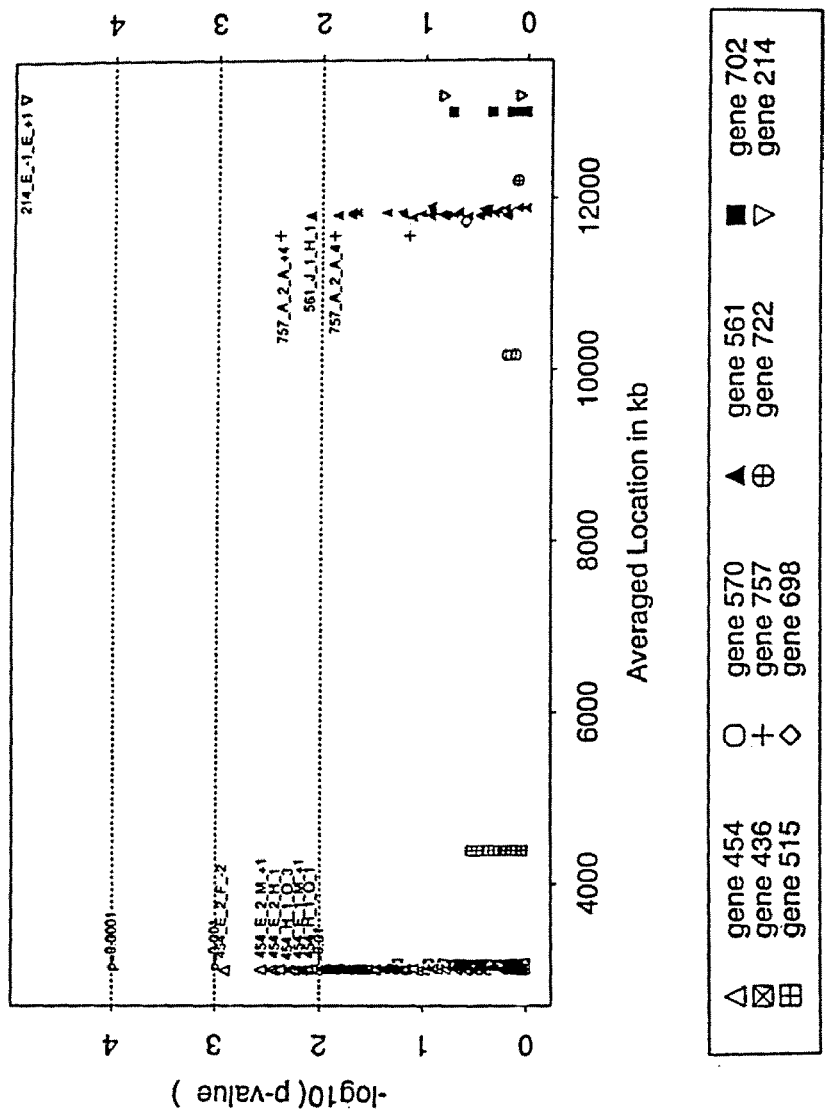
FIG. 19 shows the significance ($-\log_{10}$(p-value)) for the comparison of haplotype frequencies (2-SNP-at-a-time) in cases (asthma) and controls in the combined population against the relative location (Kb) of SNPs along chromosome 12.
Figure 20:
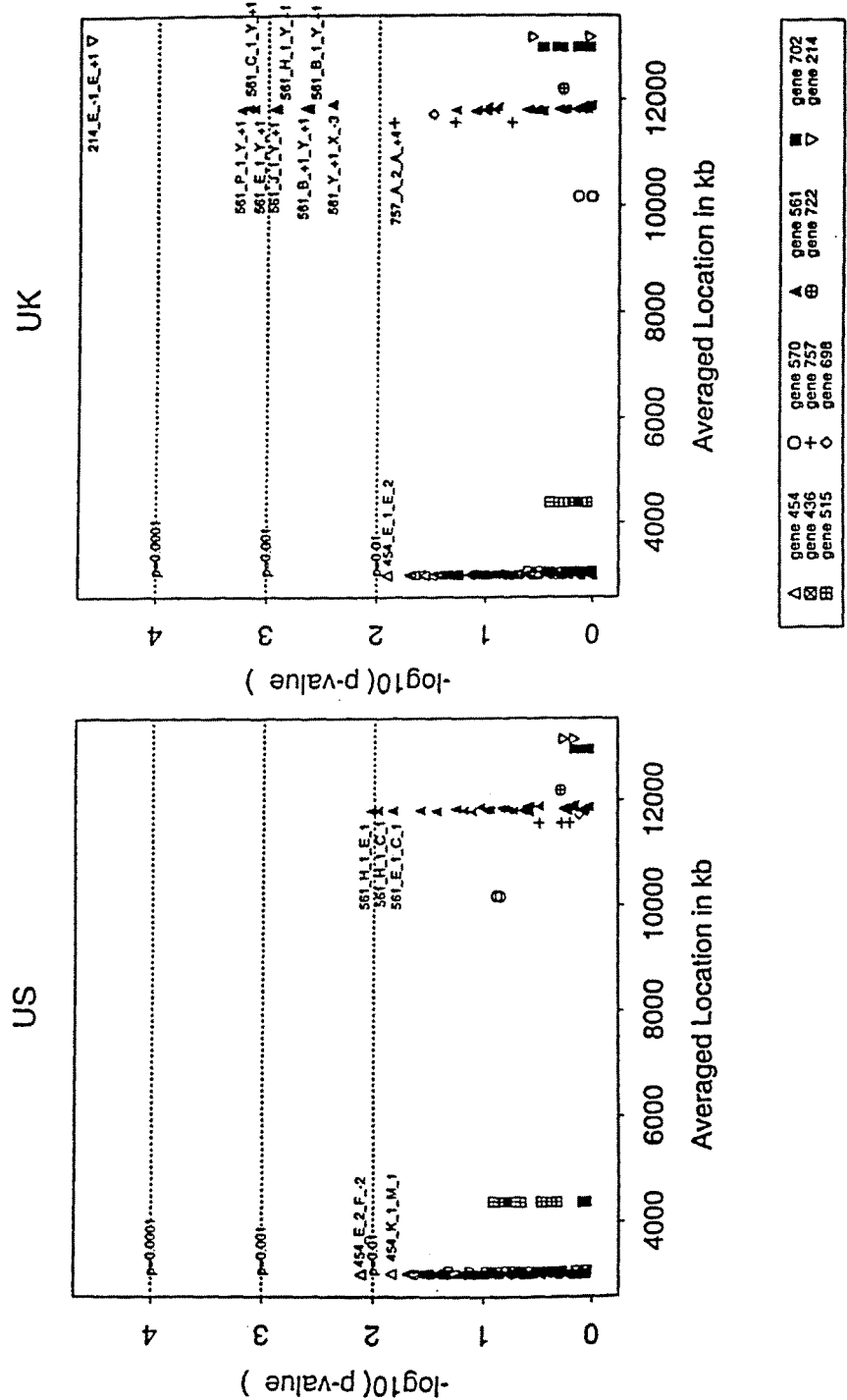
FIG. 20 shows the significance ($-\log_{10}$(p-value)) for the comparison of haplotype frequencies (2-SNP-at-a-time) in cases (asthma) and controls in the US and UK populations against the relative location (Kb) of SNPs along chromosome 12.

1. Asthma phenotype: FIG. 19 (combined population) and FIG. 20 (US and UK populations separately) shows the results for the haplotype analysis (2-at-a-time) for all SNPs in Gene 214, Gene 436, Gene 454, Gene 515, Gene 561, Gene 570, Gene 698, Gene 702, Gene 722, and Gene 757.

The most significant associated haplotype was formed by SNPs E −1 and E +1 from Gene 214, which had a p-value of 0.00001 in the combined population (p=0.00002 in UK, non-significant in US). This SNP combination was much more significant than the analysis of these SNPs alone (combined population p=0.04 for E +1 and p=0.93 for E −1). Eighteen SNP combinations had p-values <0.01 in gene 454 in the combined population, with the most significant haplotype consisting of SNP E 2 and F −2. This haplotype had a p-value of 0.001 in the combined population (p=0.008 in the US, p<0.05 in UK). Although this result was more significant than the analysis of these SNPs alone, the levels of significance found in the haplotypes of Gene 454 were comparable to the significance obtained from the analysis of the SNPs alone (in the combined population: E 2 and M +1, p=0.003; G −1 and M +1, p=0.004; E −1 and E 2, p=0.004; E 2 and H 1, p=0.004; E 2 and O 6, p=0.004; E 2 and M 1, p=0.004; H 1 and O 3, p=0.005; E 1 and E 2, p=0.005; B 1 and H 1, p=0.006; E 1 and H 1, p=0.006; E 1 and M +1 p=0.007; E 1 and F −2, p=0.007; B 1 and E 2, p=0.007; G −1 and H 1, p=0.008; H 1 and O 1, p=0.008; F −2 and M −1, p=0.009; E 2 and G −1, p=0.01).

In Gene 561, a single haplotype (J 1 and H 1) reached statistical significance at the 0.01 level in the combined population (p=0.008), while all seven haplotype combinations with SNP Y +1 yield significant results at the 0.01 level in the UK population (P 1 and Y +1, p=0.0006; C 1 and Y +1, p=0.0007; E 1 and Y +1, p=0.0008; J 1 and Y +1, p=0.001; H 1 and Y +1 p=0.001; B +1 and Y +1, p=0.002; B 1 and Y +1 p=0.002; Y +1 and X −3, p=0.004). The SNP combination of H 1 and E 1 had a significant association in the US population (p=0.009). In addition, in the combined population, the haplotypes formed by SNPs A2 and A +4 in gene 757 were more significantly associated with the disease (p=0.004) than any of these SNPs alone (p=0.03 for A 2, p=0.60 for A +4).

Figure 21:
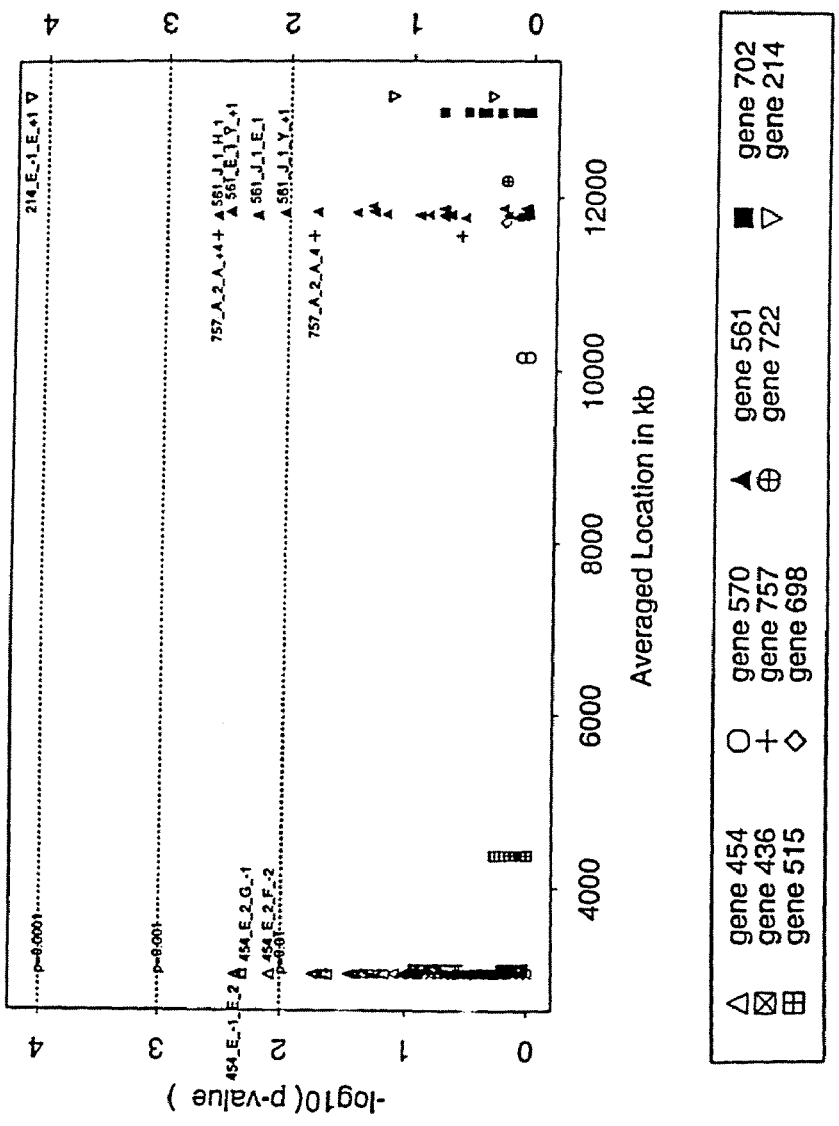
FIG. 21 shows the significance ($-\log_{10}$(p-value)) for the comparison of haplotype frequencies (2-SNP-at-a-time) in cases (BHR(PC$_{20}$≦16 mg/ml) and asthma) and controls in the combined population against the relative location (Kb) of SNPs along chromosome 12.
Figure 22:
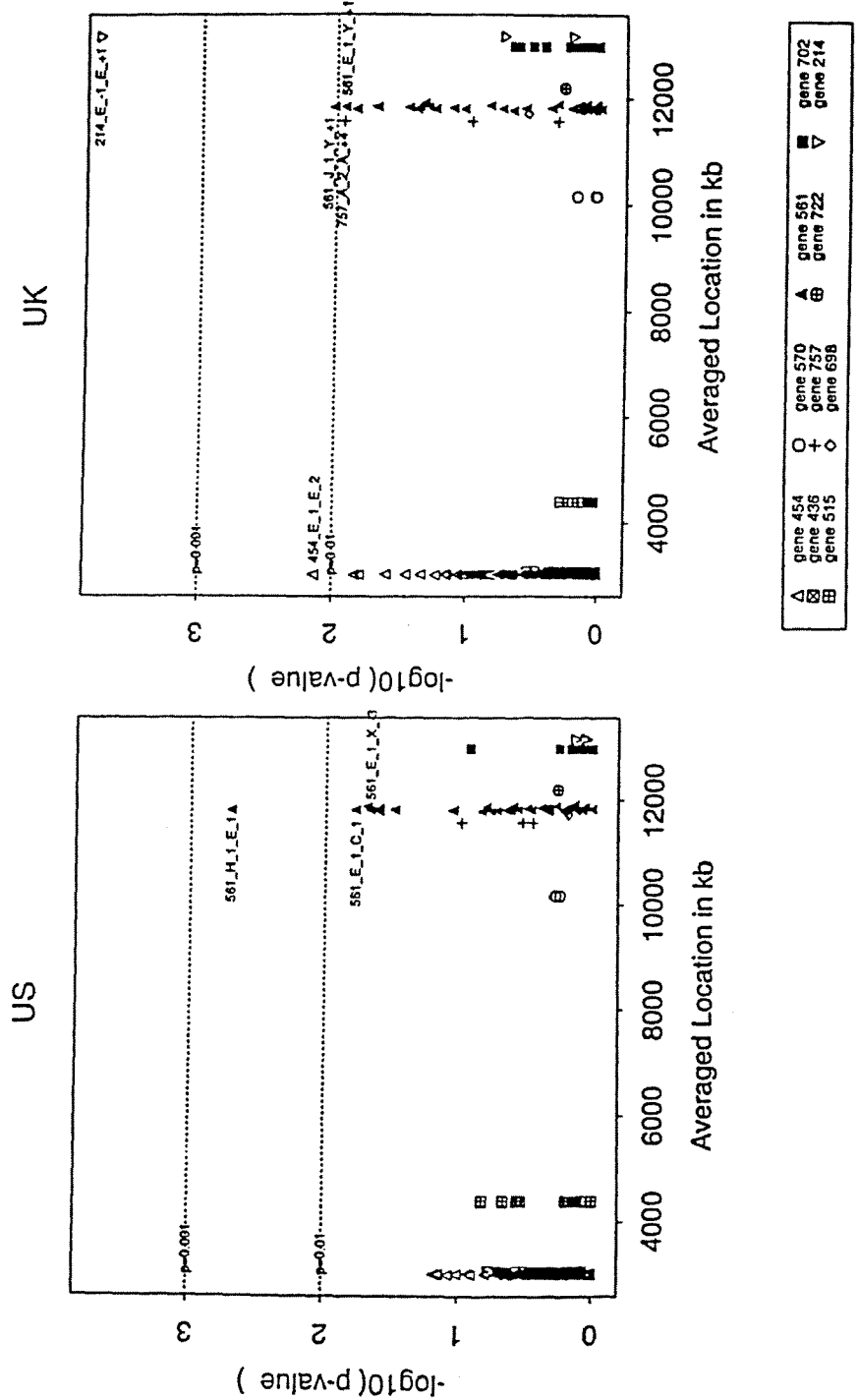
FIG. 22 shows the significance ($-\log_{10}$(p-value)) for the comparison of haplotype frequencies (2-SNP-at-a-time) in cases (BHR(PC$_{20}$≦16 mg/ml) and asthma) and controls in the US and UK populations against the relative location (Kb) of SNPs along chromosome 12.

2. Bronchial Hyper-responsiveness: A similar test for association of 2-SNP-at-a-time haplotypes with BHR($PC_{20} \leq 16$ mg/ml) was performed. In FIGS. 21 and 22, the haplotype analysis (2-at-a-time) for all SNPs in Gene 214, Gene 436, Gene 454, Gene 515, Gene 561, Gene 570, Gene 698, Gene 702, Gene 722, and Gene 757 is shown for the combined population, and for the UK and the US populations, respectively.

The most significant associated haplotype was formed by SNPs E −1 and E +1 from Gene 214, which had a p-value of 0.00007 in the combined population (p=0.0002 in UK, non-significant in US). Four SNP combinations had p-values <0.01 in Gene 454 in the combined population, (E −1 and E 2, p=0.004; E 1 and E 2, p=0.004; E 2 and G −1, p=0.005; E 2 and F −2, p=0.008), and one SNP combination in the UK (E 1 and E 2, p=0.007). In Gene 561, four haplotypes reached statistical significance at the 0.01 level in the combined population (J 1 and H 1, p=0.003; E 1 and Y +1, p=0.003; J 1 and E 1, p=0.006; J 1 and Y +1, p=0.009), one in the UK population (J 1 and Y +1, p=0.01), and one in the US (H 1 and E 1, p=0.002). In addition, in the combined population, a haplotype formed by SNPs in Gene 757 (A2 and A +4, p=0.003) was significant at the 0.01 level.

Figure 23:
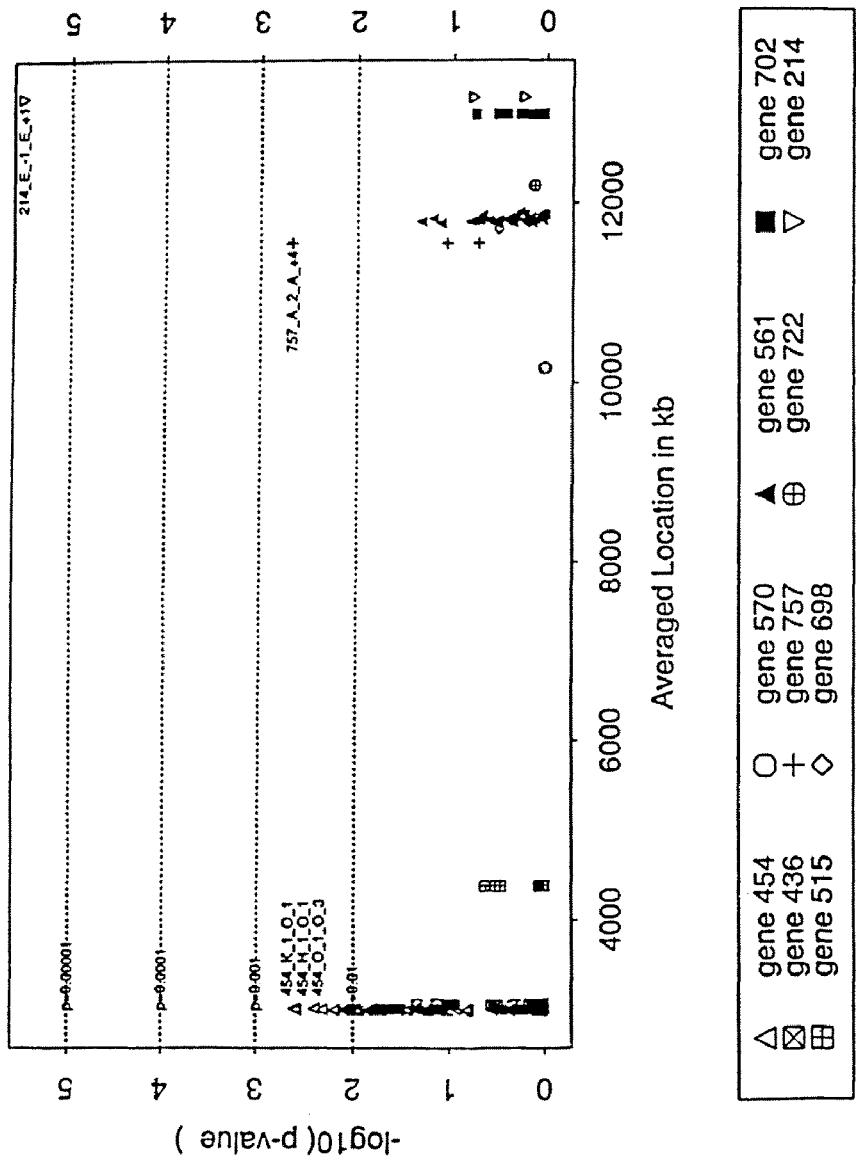
FIG. 23 shows the significance ($-\log_{10}$(p-value)) for the comparison of haplotype frequencies (2-SNP-at-a-time) in cases (total IgE and asthma) and controls in the combined population against the relative location (Kb) of SNPs along chromosome 12.
Figure 24:
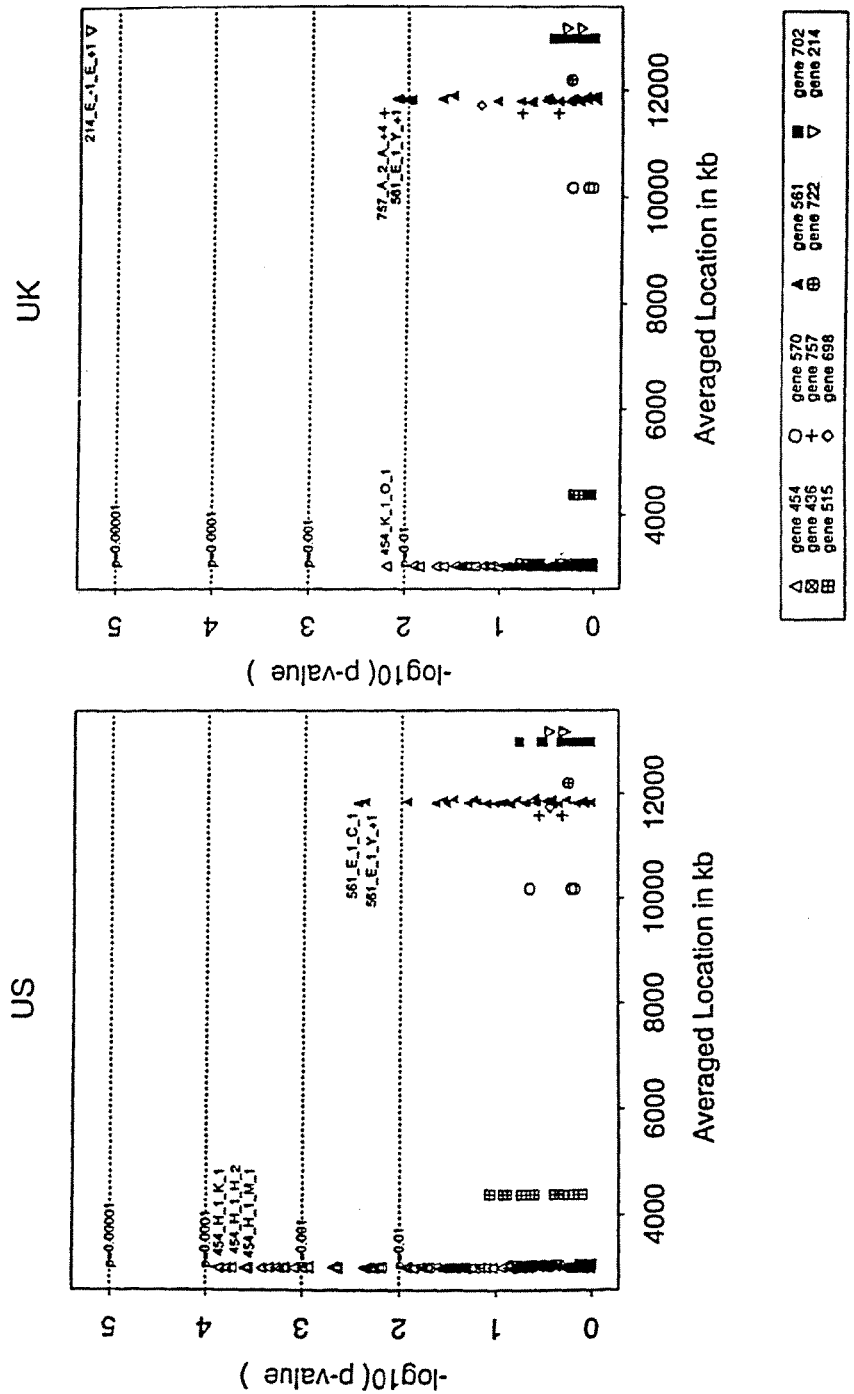
FIG. 24 shows the significance ($-\log_{10}$(p-value)) for the comparison of haplotype frequencies (2-SNP-at-a-time) in cases (total IgE and asthma) and controls in the US and UK populations against the relative location (Kb) of SNPs along chromosome 12.

3. Total IgE: A similar test for association of 2-SNP-at-a-time haplotypes with elevated levels of total IgE was performed. In FIGS. 23 and 24, the haplotype analysis (2-at-a-time) for all SNPs in Gene 214, Gene 436, Gene 454, Gene 515, Gene 561, Gene 570, Gene 698, Gene 702, Gene 722, and Gene 757 is shown for the combined and for the UK and the US populations, respectively.

The most significant associated haplotype was formed by SNPs E −1 and E +1 from Gene 214, with a p-value of 0.000003 in the combined population (p=0.000005 in UK, non-significant in US). Thirteen SNP combinations had p-values <0.01 in gene 454 in the combined population (K 1 and O 1, p=0.002; H 1 and O 1, p=0.002; O 1 and O 3, p=0.004; E 1 and O 1, p=0.005; G −1 and O 1, p=0.006; H 1 and O 3, p=0.007; F −2 and M 1 p=0.008; H 2 and O 1, p=0.008; B 1 and O 1, p=0.009; M 1 and O 1, p=0.009; G −1 and M +1, p=0.009; E 2 and O 1, p=0.009; F −2 and H 1, p=0.01), one SNP combination in the UK (K 1 and O 1, p=0.007), and twenty-nine SNP combinations in the US (H 1 and K 1, p=0.0001; E 1 and H 1, p=0.0002; H 1 and H 2, p=0.0002; E 2 and H 1, p=0.0003; B 1 and H 1, p=0.0003; H 1 and M 1, p=0.0003; G −1 and H 1, p=0.0004; H 1 and O 5, p=0.0004; H 1 and O 3, p=0.0004; H 1 and O 6, p=0.0005; E −1 and H 1, p=0.0006; F −2 and H 1, p=0.0006; H 1 and M +1, p=0.0006; H 1 and O 1, p=0.0007; H 1 and L −1, p=0.0008; H 1 and M 2, p=0.001; M 1 and O 3, p=0.001; M 1 and O 5, p=0.002; H 2 and M 1, p=0.002; E 1 and M 1, p=0.002; K 1 and M 1, p=0.002; F −2 and M 1, p=0.004; L −1 and M 1, p=0.005; M 1 and M 2, p=0.005; B 1 and M 1, p=0.005; F −2 and G −1, p=0.005; M 1 and O 1, p=0.006; E 2 and M 1, p=0.006; M 1 and M +1, p=0.007). In Gene 561, three haplotypes reached statistical significance at the 0.01 level in the UK sample (E 1 and Y +1, p=0.008; C 1 and Y +1, p=0.008; H 1 and Y +1 p=0.009), and two reached statistical significance in the US sample (E 1 and C 1, p=0.004; E 1 and Y +1, p=0.004). In Gene 757, the haplotype formed with SNP A2 and SNP A +4 was significant at the 0.01 level in the combined population (p=0.002), and in the UK population (p=0.006).

Figure 25:
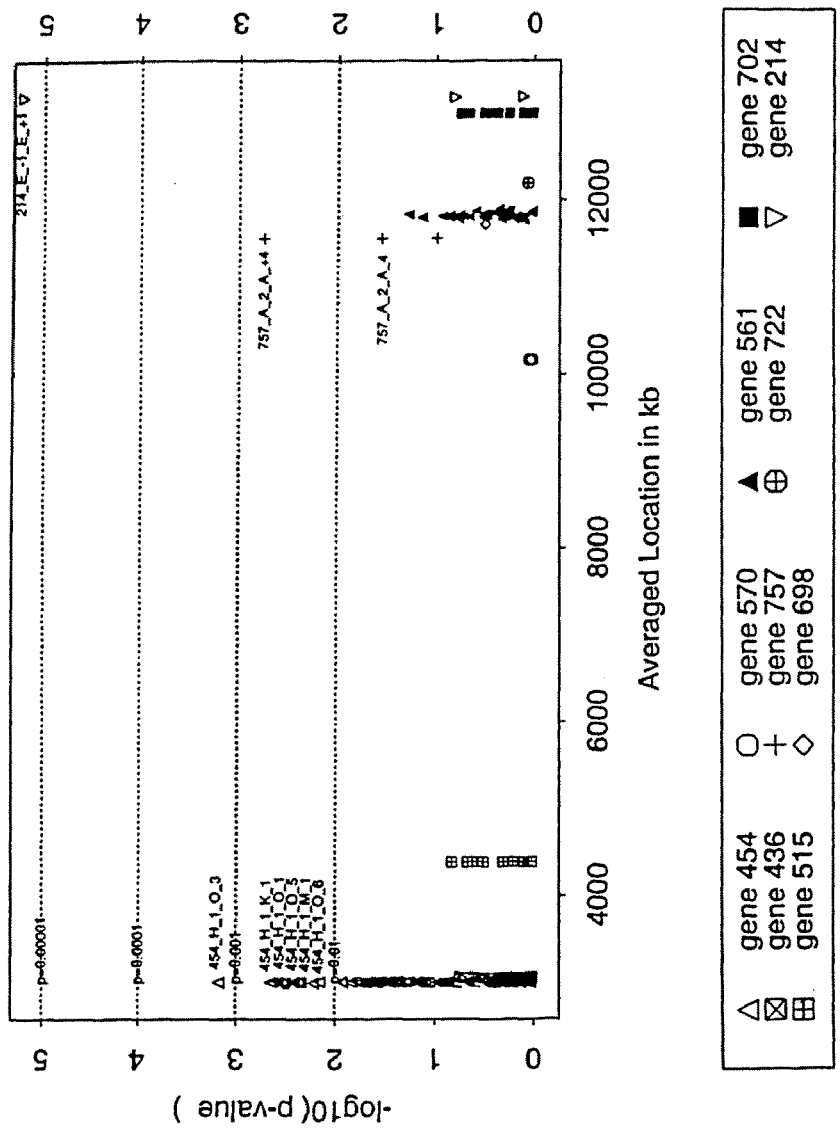
FIG. 25 shows the significance ($-\log_{10}$(p-value)) for the comparison of haplotype frequencies (2-SNP-at-a-time) in cases (specific IgE and asthma) and controls in the combined population against the relative location (Kb) of SNPs along chromosome 12.
Figure 26:
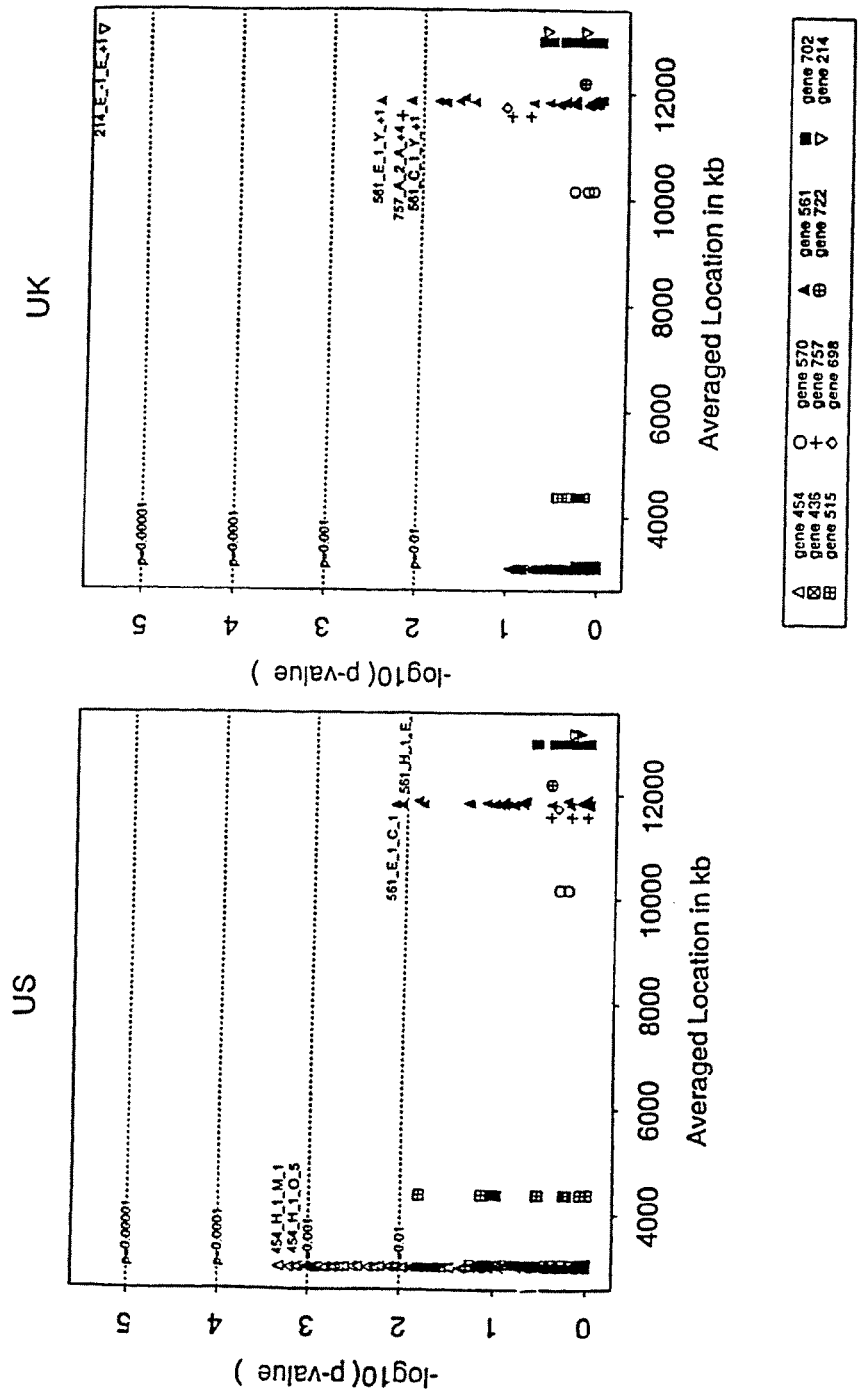
FIG. 26 shows the significance ($-\log_{10}$(p-value)) for the comparison of haplotype frequencies (2-SNP-at-a-time) in cases (specific IgE and asthma) and controls in the US and UK populations against the relative location (Kb) of SNPs along chromosome 12.

4. Specific IgE: A similar test for association of 2-SNP-at-a-time haplotypes with elevated levels of specific IgE was performed. In FIGS. 25 and 26, the haplotype analysis (2-at-a-time) for all SNPs in Genes 214, 436, 454, 515, 561, 570, 698, 702, 722 and 757 is shown for the combined and for the UK and the US populations, respectively.

The most significant associated haplotype was formed by SNPs E −1 and E +1 from Gene 214, with a p-value of 0.000006 in the combined population (p=0.000003 in UK, non-significant in US). Sixteen SNP combinations had p-values <0.01 in gene 454 in the combined population (H 1 and O 3, p=0.0007; H 1 and K 1, p=0.002; G −1 and H 1, p=0.002; H 1 and O 1, p=0.003; E 2 and H 1, p=0.003; H 1 and H 2, p=0.003; E 1 and H 1, p=0.003; B 1 and H 1, p=0.003; H 1 and M 2, p=0.003; H 1 and O 5, p=0.004; H 1 and M +1, p=0.004; H 1 and L −1, p=0.004; F −2 and H 1, p=0.004; H 1 and M 1, p=0.005; E −1 and H 1, p=0.006; H 1 and O 6, p=0.007), and thirty-three SNP combinations in the US (H 1 and M 1, p=0.0005; E 1 and H 1, p=0.0006; H 1 and O 5, p=0.0007; H 1 and O 6, p=0.0008; H 1 and M +1, p=0.0009; H 1 and K 1, p=0.001; F −2 and H 1, p=0.001; K 1 and M 1, p=0.001; H 1 and H 2, p=0.001; M 1 and O 3, p=0.001; G −1 and H 1, p=0.001; H 1 and O 3, p=0.001; B 1 and H 1, p=0.001; H 1 and L −1, p=0.002; E −1 and H 1, p=0.002; E 2 and H 1, p=0.002; H 1 and M 2, p=0.002; H 1 and O 1, p=0.002; M 1 and M +1, p=0.002; K 1 and M +1, p=0.003; M 1 and O 5, p=0.003; M +1 and O 5, p=0.004; E 2 and M 1, p=0.005; F −2 and K 1, p=0.005; E 1 and M 1, p=0.005; K 1 and O 6, p=0.006; M +1 and O 6, p=0.006; H 2 and M 1, p=0.007; F −2 and O 3, p=0.008; M +1 and O 3, p=0.008; E 2 and M +1, p=0.009; M 1 and O 1, p=0.009; O 5 and O 6, p=0.009). In Gene 561, two haplotypes reached statistical significance at the 0.01 level in the UK population (E 1 and Y +1, p=0.003; C 1 and Y +1, p=0.007), and two reached statistical significance in the US population (E 1 and C 1, p=0.007; H 1 and E 1, p=0.009). In Gene 757, the haplotype formed with SNP A2 and SNP A +4 was significant at the 0.01 level in the combined population (p=0.002) and in the UK sample (p=0.006).

In summary, haplotype analysis of the SNPs provided additional evidence demonstrating the presence of asthma susceptibility genes on chromosome 12. In some SNP combinations, the level of significance of the association was increased by an order of magnitude.

Example 13

Transmission Disequilibrium Test (TDT)

A family based test of association, the transmission disequilibrium test (TDT), was conducted for Gene 454. By selecting a single affected offspring in each family, the TDT test performed a test of association (due to linkage disequilibrium) in the presence of linkage. The test determined whether a particular allele or genotype was preferentially transmitted to an affected individual over what would be expected by chance. Only heterozygote parents were considered informative for the TDT. In addition, to increase power, heterozygote parents transmitting a different allele to two affected offspring were ignored. Accordingly, the TDT would be based on the same families that contributed to the linkage signal. The significance levels were estimated by Markov Chain Monte Carlo simulation methods as implemented in TDTEX from the S.A.G.E. program (1997, Department of Epidemiology and Biostatistics, Rammelkamp Center for Education and Research, MetroHealth Campus, Case Western Reserve University, Cleveland, Ohio). As only heterozygote parents contributed information to the TDT test, SNP haplotypes (all 2-at-a-time and all 3-at-a-time) were also constructed based on family data with the program GENEHUNTER (Kruglyak et al., 1996). This served to increase the informativeness of the single SNPs. These haplotypes were then used as "alleles" in future TDT analyses. In addition, p-values obtained from the TDT analyses were compared to the p-values obtained from the haplotyping in the case/control setting. To check for consistency, p-values, associated with testing frequencies in cases and controls, were examined when selecting the overtransmitted alleles or genotypes identified in the TDT test.

1. Asthma Phenotype: Three candidate SNPs for Gene 454 were typed in the extended population in order to investigate further the association seen in the case-control study. All three SNPs result in amino acid changes (E 2, histidine to tyrosine (C→T); H 1 and H 2, arginine to histidine (G→A)). Results are shown in Table 16. Column 1 lists the exon(s) containing the SNP(s) of interest. Column 2 lists the overtransmitted alleles or genotypes. Column 3 lists the TDT p-values. Columns 4, 5, and 6 list the p-values, the frequencies in the cases, and the frequencies in the controls of the overtransmitted alleles or genotypes, respectively.

Since the TDT was not influenced by admixture, it was performed using the combined US and UK populations. For SNPs E 2 and H 1, the genotype formed by the CA/CA haplotypes was significantly overtransmitted to the affected individuals (p=0.04). In addition, this genotype was found in only 2% of the controls while 12% of the cases harbor this genotype. This difference was highly significant (p=0.0002). For the SNP combination comprising H 1 and H 2, the AG/AG genotypes were overtransmitted to affected individuals. This result approached the statistical level of 0.05 (p=0.06). Moreover, this genotype was more frequent in the cases (14%) compared to the controls (2%), and this difference was highly significant (p=0.00005). The TDT results supported the association previously observed in the case-control studies for Gene 454. The results also pointed to a recessive mechanism of transmission, as the genotype test showed the strongest evidence of association.

TABLE 16

TDT ANALYSIS OF ASTHMA PHENOTYPE
Asthma Yes/No
Combined US and UK

| Exon | | TDT p-value | Case/Control p-value | Control Freq | Case Freq |
|---|---|---|---|---|---|
| | Over-Transmitted Allele | | | | |
| 454_E_2 | T | 1.0000 | 0.0058 | 50.9% | 39.7% |
| 454_H_1 | A | 0.3484 | 0.0032 | 22.1% | 33.0% |
| 454_H_2 | G | 0.1094 | 0.7801 | 98.0% | 97.4% |
| 454_E_2_H_1 | CA | 0.3874 | 0.0008 | 15.4% | 27.6% |
| 454_E_2_H_2 | CG | 0.4612 | 0.0097 | 48.4% | 59.4% |
| 454_H_1_H_2 | G | 0.0900 | 0.0036 | 20.0% | 30.4% |
| 454_E_2_H_1_H_2 | CAG | 0.2167 | 0.0015 | 15.3% | 26.8% |
| | Over-Transmitted Genotype | | | | |
| 454_E_2 | TT | 0.8375 | 0.0070 | 28.6% | 13.7% |
| 454_H_1 | AA | 0.1057 | 0.0022 | 4.9% | 17.0% |
| 454_H_2 | GG | 0.1107 | 0.7776 | 96.0% | 94.8% |
| 454_E_2_H_1 | CA/CA | 0.0359 | 0.0002 | 1.5% | 11.6% |
| 454_E_2_H_2 | CG/CG | 0.2829 | 0.2477 | 26.8% | 33.0% |
| 454_E_2_H_2 | TG/TG | 0.2829 | 0.0038 | 26.3% | 12.2% |
| 454_H_1_H_2 | AG/AG | 0.0637 | 0.00005 | 2.0% | 14.3% |
| 454_E_2_H_1_H_2 | CAG/CAG | 0.0877 | 0.0001 | 1.0% | 10.7% |

2. Bronchial Hyper-responsiveness: The TDT analyses were repeated using only the asthmatic pairs that satisfied the additional criteria of having a $PC_{20} \leq 16$ mg/ml (Table 17). As for the case of the asthma yes/no phenotype, significance was reached with the genotypic TDT test. For this subphenotype, genotype AA of SNP H 1 was overtransmitted to affected individuals (p=0.04). This genotype was also present more often in the cases than in the controls (17% cases, 5% controls, p=0.02). Two haplotype combinations had overtransmitted genotypes that approached statistically significant levels: genotype CA/CA for SNPs E 2 and H 1 (p=0.06) and genotype CAG/CAG for SNPs E2, H1 and H2 (p=0.06). Both of these genotypes were found more often in the cases (CA/CA 13%, CAG/CAG 11%) than in the controls (CA/CA 2%, CAG/CAG 1%), and these differences were highly significant (p=0.0008 for CA/CA, p=0.0014 for CAG/CAG).

TABLE 17

TDT ANALYSIS OF BHR PHENOTYPE
Combined US and UK

| Exon | | TDT p-value | Case/Control p-value | Control Freq | Case Freq |
|---|---|---|---|---|---|
| | Over-Transmitted Allele | | | | |
| 454_E_2 | C | 1.0000 | 0.0074 | 49.1% | 63.6% |
| 454_H_1 | A | 0.7974 | 0.0223 | 22.1% | 33.0% |
| 454_H_2 | G | 0.6252 | 0.2962 | 98.0% | 96.3% |
| 454_E_2_H_1 | CA | 0.7986 | 0.0037 | 15.4% | 28.8% |
| 454_E_2_H_2 | CG | 0.7156 | 0.0274 | 48.4% | 61.4% |
| 454_H_1_H_2 | AG | 0.5338 | 0.0442 | 20.0% | 29.3% |
| 454_E_2_H_1_H_2 | CAG | 0.9090 | 0.0192 | 15.3% | 26.4% |
| | Over-Transmitted Genotype | | | | |
| 454_E_2 | TT | 0.7917 | 0.0140 | 28.6% | 10.9% |
| 454_H_1 | AA | 0.0429 | 0.0181 | 4.9% | 17.0% |
| 454_H_2 | GG | 0.6235 | 0.2923 | 96.0% | 92.6% |
| 454_E_2_H_1 | CA/CA | 0.0601 | 0.0008 | 1.5% | 13.2% |
| 454_E_2_H_2 | CG/CG | 0.7211 | 0.2373 | 26.8% | 35.2% |
| 454_H_1_H_2 | AG/AG | 0.1319 | 0.0022 | 2.0% | 13.2% |
| 454_E_2_H_1_H_2 | CAG/CAG | 0.0632 | 0.0014 | 1.0% | 11.3% |

3. Total IgE The TDT analyses were also performed using the phenotype previous described for total IgE (Table 18). Again, significance was reached with the genotypic TDT test. For this subphenotype, genotype AA of SNP H 1 was over-transmitted to affected individuals (p=0.03). This genotype was also present more often in the cases than in the controls (21% cases, 5% controls, p=0.0001). Two genotypes for the SNP combination formed by E2 and H1 had statistically significant overtransmission: genotype CA/CA and genotype CA/TA (p<0.05). Both genotypes were found more often in the cases (CA/CA 12%, CA/TA 9%) than in the controls (CA/CA 2%, CA/TA 3%), and these differences were significant (p=0.0009 for CA/CA, p=0.03 for CA/CT).

TABLE 18

TDT ANALYSIS OF TOTAL IgE PHENOTYPE
Combined US and UK

| Exon | | TDT p-value | Case/Control p-value | Control Freq | Case Freq |
|---|---|---|---|---|---|
| | Over-Transmitted Allele | | | | |
| 454_E_2 | C | 1.0000 | 0.0552 | 49.1% | 58.3% |
| 454_H_1 | A | 0.0821 | 0.0030 | 22.1% | 35.3% |
| 454_H_2 | G | 0.2896 | 0.2146 | 98.0% | 95.8% |
| 454_E_2_H_1 | CA | 0.5439 | 0.0040 | 15.4% | 27.3% |
| 454_E_2_H_2 | CG | 0.6807 | 0.1055 | 48.4% | 56.8% |
| 454_H_1_H_2 | AG | 0.3460 | 0.0116 | 20.0% | 30.9% |
| 454_E_2_H_1_H_2 | CAG | 0.3447 | 0.0101 | 15.3% | 25.8% |
| | Over-Transmitted Genotype | | | | |
| 454_H_1 | AA | 0.0349 | 0.0001 | 4.9% | 20.6% |
| 454_H_2 | GG | 0.2888 | 0.2088 | 96.0% | 91.6% |
| 454_E_2_H_1 | CA, CA | 0.0477 | 0.0009 | 1.5% | 11.8% |
| 454_E_2_H_1 | CA, TA | 0.0477 | 0.0314 | 2.5% | 8.8% |
| 454_E_2_H_2 | CG, CG | 0.7049 | 0.8766 | 26.8% | 28.2% |
| 454_H_1_H_2 | AG, AG | 0.1707 | 0.00009 | 2.0% | 16.2% |
| 454_E_2_H_1_H_2 | CAG, CAG | 0.1457 | 0.0013 | 1.0% | 10.3% |

4. Specific IgE: The TDT analyses were performed using the phenotype previous described for specific IgE (Table 19). There were no alleles or genotypes that were significantly overtransmitted at the 0.05 level. However, the test for the overtransmission of genotype AA SNP H 1 had a p-value <0.1. This genotype was present more often in the cases than in the controls (22% cases, 5% controls, p=0.0003).

TABLE 19

TDT ANALYSIS OF SPECIFIC IgE PHENOTYPE
Combined US and UK

| Exon | | TDT p-value | Case/Control p-value | Control Freq | Case Freq |
|---|---|---|---|---|---|
| | Over-Transmitted Allele | | | | |
| 454_H_1 | A | 0.1555 | 0.00006 | 22.1% | 37.5% |
| 454_H_2 | G | 0.3757 | 0.3392 | 98.0% | 96.4% |
| 454_E_2_H_1 | CA | 0.7101 | 0.0006 | 15.4% | 30.2% |
| 454_E_2_H_2 | TG | 0.8317 | 0.0332 | 49.5% | 38.6% |
| 454_H_1_H_2 | AG | 0.1369 | 0.0012 | 20.0% | 33.9% |
| 454_E_2_H_1_H_2 | CAG | 0.6602 | 0.0012 | 15.3% | 29.3% |

TABLE 19-continued

TDT ANALYSIS OF SPECIFIC IgE PHENOTYPE
Combined US and UK

| Exon | Over-Transmitted Genotype | TDT p-value | Case/Control p-value | Control Freq | Case Freq |
|---|---|---|---|---|---|
| 454_H_1 | AA | 0.0910 | 0.00003 | 4.9% | 22.1% |
| 454_H_2 | GG | 0.3740 | 0.3340 | 96.0% | 92.9% |
| 454_E_2_H_1 | CA/TA | 0.2586 | 0.0314 | 2.5% | 8.8% |
| 454_E_2_H_2 | TG/TG | 0.7369 | 0.0118 | 26.3% | 11.4% |
| 454_H_1_H_2 | AG/AG | 0.1104 | 0.00003 | 2.0% | 17.7% |
| 454_E_2_H_1_H_2 | CAG/CAG | 0.3841 | 0.0004 | 1.0% | 11.8% |
| 454_E_2_H_1_H_2 | CGA/CGA | 0.3841 | 1.0000 | 0.0% | 0.0% |

Example 14

Gene Analysis and Potential Function

Figure 6:
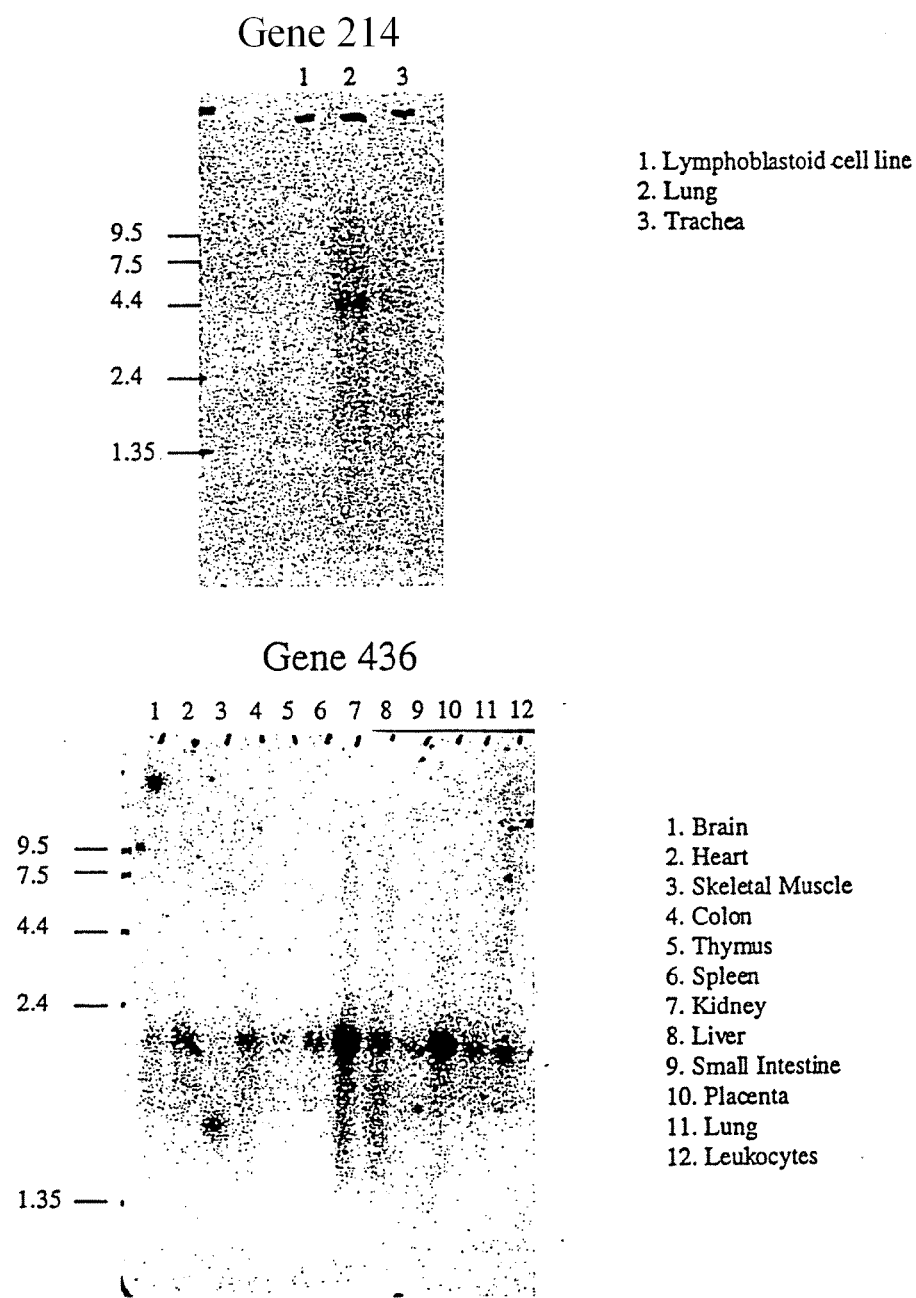
FIGS. 6A-6U show the results of Northern blot analysis of the Genes of 12q23-qter in various tissues.

1. Functional Role of Gene 454 in Asthma and Related Diseases Extracellular ATP triggers a variety of responses in several cell types, including contraction of smooth muscles, regulation of nitric oxide production from endothelium, stimulation of cytokine release from immune cells, and modulation of several other metabolic pathways. The receptors that mediate these diverse effects are the P2 purinoreceptors, which are divided into two subgroups: P2Y and P2X receptors. The P2X receptors are a family of multimeric ligand-gated ion channels activated solely by extracellular ATP and structurally distinct from other ligand-gated channels. Gene 454 represents the seventh member of the P2X receptor family, P2X7. The nucleic acid sequence of Gene 454 corresponds to SEQ ID NO:19, and the encoded amino acid sequence corresponds to SEQ ID NO:111, as disclosed herein (see FIGS. 7A-7H). The Gene 454 transcript is 5.087 Kb, the gene is ~55 Kb in size, and includes 13 exons. The Gene 454 ORF is 1788 bp long and encodes a 596 amino acid protein. The 5' and 3' untranslated regions are 69 bp and 3230 bp in length, respectively. As determined by the experiments described herein, Gene 454 is expressed in brain, heart, skeletal muscle, spleen, kidney, liver, placenta, lung, leukocytes, lymph and fetal liver tissues (FIG. 6).

Data have indicated that the P2X7 receptor is involved in cell death, cytokine release, and the shedding of surface antigens. The P2X7 receptor also mediates activation of the transcription factors NF-K-beta and NFAT. The P2X7 receptor displays unique permeability properties. At low ATP concentrations P2X7 forms small ATP-gated cation channels, allowing the influx of small cations, including $Ca^{2+}$, into the intracellular environment. Notably, in rat peritoneal mast cells, there is a direct correlation between the influx of $Ca^{2+}$ and the release of histamine as a consequence of ATP levels (Schulman et al., 1999, *Am. J. Respir. Cell Mol. Biol.* 20:530-537). In addition, at these levels of ATP, various proteases are activated including membrane metalloproteases and intracellular caspases (Gu et al., 1998, *Blood* 92:946-951).

At high ATP concentrations, the P2X7 receptor pore size increases allowing the passage of anions as well as cations up to 900 daltons in size (Nihei et al., 2000, *Mem. Inst. Oswaldo Cruz* 95:415-428). Interestingly, inhalation of aerosolized ATP has been shown to trigger bronchoconstriction in healthy and asthmatic individuals. In asthmatics, ATP was 50 times more potent than methacholine, and 87-fold more potent than histamine, in producing a 15% decrease in $FEV_1$. (Schulman et al., 1999, *Am. J. Respir. Cell Mol. Biol.* 20:530-537). This suggests that extracellular ATP acts as an important modulator of pro-inflammatory regulation via the P2X7 receptor.

Figure 10:
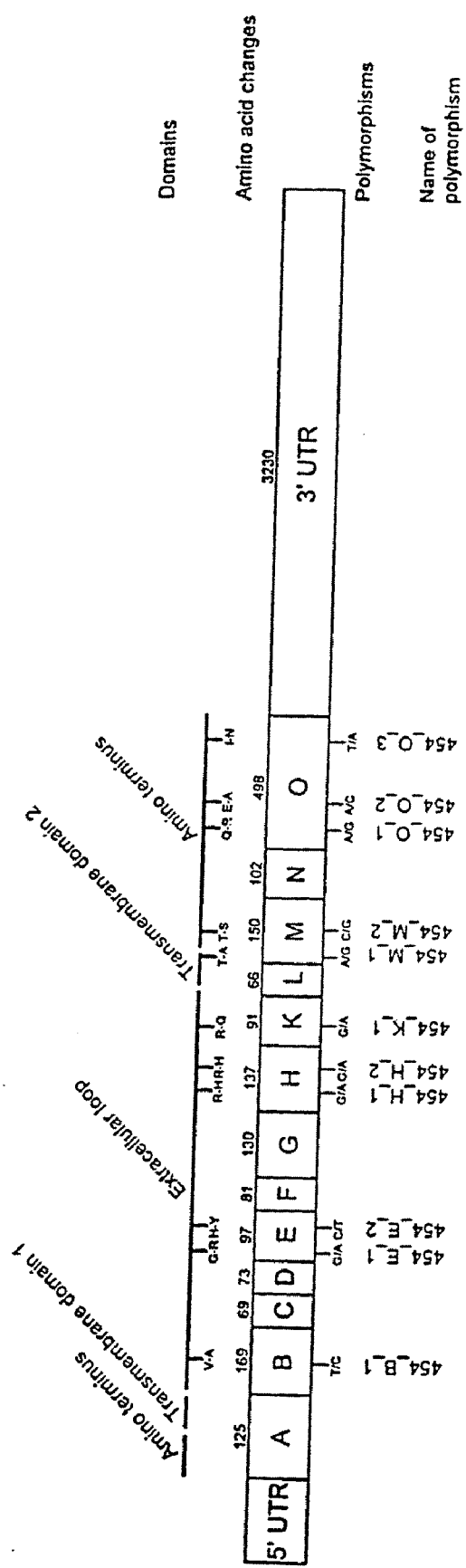
FIG. 10 shows the domain structure of Gene 454 and the exon location of the corresponding SNPs.

The P2X7 protein contains two transmembrane domains connected by a large extracellular loop, and intracellular N-terminal and C-terminal domains (FIG. 10). P2X7 shares significant amino acid identity with the other members of the P2X receptor family (30-40%), except in the C-terminus domain, which is 240 amino acids long. P2X7 contains a long unique carboxyl terminus, which appears to be involved in the permeability properties of the P2X7 receptor. Truncation of the cytoplasmic tail abolishes ATP-induced uptake of the fluorescent dye YoPro-1 and ethidium bromide (Gu et al., 2001, *JBC* 276:11135-11142). Further, a SNP (A→C) in the cytoplasmic tail was identified in the Caucasian population. The SNP results in a glutamic acid to alanine change at amino acid 496. This amino acid substitution results in a loss of functional P2X7 in homozygotes, and results a 50% loss of function in heterozygotes (Gu et al., 2001, *JBC* 276:11135-11142). The expression of P2X7 has been observed mainly in cells of the immune and hematopoietic system, and P2X7 has been shown to mediate the ATP-induced apoptotic death in monocytes, macrophages, and lymphocytes. However, P2X7 expression has been observed in other cell-types at lower levels. In particular, fibroblasts express P2X7, and are responsive to ATP.

Fibroblasts are non-excitable cells that play a role in the modulation of a variety of microenvironmental situations to which these cells are exposed. In the lung, fibroblasts lie in the lamina propria under the basement membrane. The bronchial epithelium lies above the basement membrane, and is attached thereto. In accordance with one model of respiratory diseases, allergens cause the cells of the bronchial epithelium to release their cytoplasmic contents. The cellular ATP concentration of each cell is estimated to be 5-10 mM. The released ATP immediately passes through the basement membrane by passive diffusion. This triggers the P2X7 receptors on the surface of the fibroblast cells to dilate, forming an open channel. The P2X7 receptors allow the influx of cations and anions up to 900 daltons. One of these ions triggers a signal transduction cascade that induces the final step in the post-translational processing of pro-IL-1β, a multipotential inflammatory mediator (Solle et al., *JBC* 276:125-132). The mature IL-1β binds to receptors on target cells that elicit signaling cascades. This leads to the up-regulation of gene products such as matrix metalloproteases, cyclooxygenase-2, IL-6 and cellular adhesion molecules, which contribute to inflammation.

IL-6 is an important pro-inflammatory cytokine that is secreted by mononuclear phagocytes, antigen-presenting cells, and fibroblasts. In accordance with the current knowledge in the art, secretion of IL-6 creates a pro-inflammatory microenvironment that induces the release of other factors such as growth factors, cytokines, and prostaglandins. This, in turn, enhances the stimulation and propagation of fibroblasts, and leads to an increase in the release of pro-inflammatory molecules. Fibroblasts also play a role in exuding extracellular matrix. Notably, in asthmatics, the basement membrane is thicker than in normal individuals due to the abnormal repair of the bronchial epithelium by fibroblasts. Further, myofibroblasts are also in abundance in asthmatic individuals, due in part to pro-inflammatory stimulation.

The Gene 454 SNPs (Table 10; FIGS. 7A-7H, and 10) identified by the experiments described herein result in nucleotide changes that may disrupt the intracellular function, stability, splicing, or expression of the encoded protein. It is possible that the nucleotide changes cause an increase or decrease in the normal activities or levels the P2X7 receptor, thereby affecting the pro-inflammatory response triggered by ATP, and resulting in asthmatic symptoms. The sum of these data indicates that Gene 454 (P2X7) is involved in the pathophysiology of respiratory disorders, including asthma.

2. Functional Role of Gene 561 in Asthma and Related Diseases

Gene 561 is the human ortholog of rat RIMBP2, a scaffold protein. RIMBP2 protein binds to RIM, a putative effector of Rab3, and appears to recruit synaptic vesicles by a tethering reaction. RIMBP2 is an intracellular protein that contains an SH3 domain, which is thought to be involved in binding to RIM. RIMBP2 also contains fibronectin type III repeats, which are rarely observed in intracellular proteins (Wang et al., 2000, *JBC* 275:20033-2044).

Figure 8:
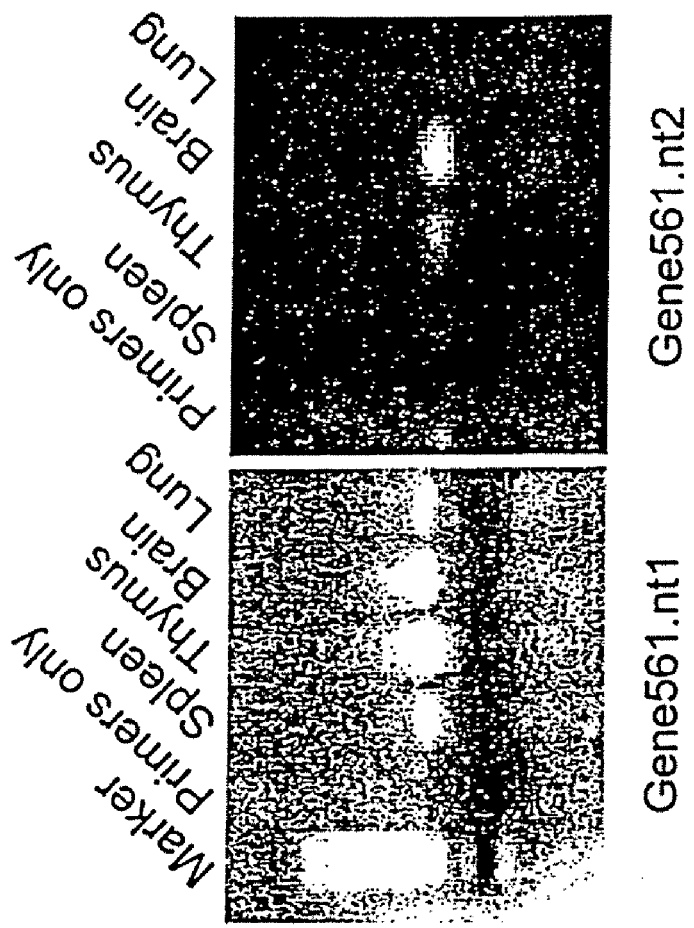
FIG. 8 shows the results of RT-PCR analysis of Gene 561.1 and Gene 561.2.

The nucleotide sequence of Gene 561.1 alternate splice variant (also referred to as 561.nt1), corresponds to SEQ ID NO:31 (FIGS. 27A-27K), and the encoded amino acid sequence (also referred to as Gene 561.aa1) corresponds to SEQ ID NO:6161. The nucleotide sequence of Gene 561.2 alternate splice variant (also referred to as 561.nt2) corresponds to SEQ ID NO:32 (FIGS. 28A-28C), and the encoded amino acid sequence (also referred to as Gene 561.aa2) corresponds to SEQ ID NO:120. As determined by the experiments described herein, the transcript size of Gene561.nt1 and Gene561.nt2 is 7.9 and 6.1 Kb, respectively (FIG. 8). An alternative splice site has been identified at a position in the 3'UTR, between exons J and I (FIG. 8). RT-PCR data indicate that Gene 561.nt1 is clearly expressed in lung at low levels, but Gene561.nt2 is not (FIG. 8). The genomic structure of Gene 561 comprises 21 exons and spans ~200 Kb.

ATP has been shown to stimulate vagal afferent nerve terminals in the lung. This can lead to local axon and central vagal reflexes, which are known to play a major role in neurogenic inflammation and bronchoconstriction. Nocturnal asthma characterized by acute bronchoconstriction in the morning has been associated with platelet activation, which releases large amounts of ATP, and augmentation of vagal tone (Schulman et al., 1999, *Am. J. Respir. Cell Mol. Biol.* 20:530-537). It is possible that Gene 561 recruits synaptic vesicles for neurotransmitter release at the afferent nerve terminals in lung. This, in turn, may be important for bronchoconstriction/dilation. Accordingly, the Gene 561 SNPs that show association with asthma (Table 10, FIGS. 27A-27K, and FIGS. 28A-28C) may disrupt the function, stability, or expression of the encoded protein. The altered Gene 561 protein may cause an increase or decrease of neurotransmitter, resulting in augmentation of the vagal tone, and leading to bronchoconstriction. The sum of these data indicates that Gene 561 is involved in the pathophysiology of respiratory disorders including asthma.

3. Functional Role of Gene 757 in Asthma and Related Diseases

Immunocytochemical studies have shown that both TGF-β (transforming growth factor β) and EGFR1 (epidermal growth factor receptor) are highly expressed in areas of bronchial epithelial injury, and that these parallel pathways operate to repair epithelial cells (Puddicombe et al., 2000, *FASEB J.* 14:1362-1374). EGFR1 stimulates epithelial repair, while TGF-β regulates the production of profibrogenic growth factors and proinflammatory cytokines leading to extracellular matrix synthesis. TGF-β also acts in the WNT signaling pathway, which functions in a variety developmental processes, including cell differentiation, cell polarity, cell migration, and cell proliferation (Calvo et al., 2000, *PNAS* 97:12776-12781). The WNT components activate the frizzled receptors, which stabilize β-catenin. This, in turn, activates the expression of target genes in the nucleus (Kühl et al., 2000, *TIG* 16:279-283).

Gene 757 is frizzled 10 (FZD10), a putative receptor for Wnt-7a (Kawakami et al., 2000, *Develop. Growth Differ.* 42:561-569). The nucleic acid sequence of Gene 757 corresponds to SEQ ID NO: 90, and the encoded amino acid sequence corresponds to SEQ ID NO: 153 (FIGS. 9A-9F). As determined by the experiments described herein, Gene 757 is expressed in brain, heart, skeletal muscle, colon, thymus, spleen, kidney, small intestine, placenta, and lung (FIG. 6). The transcript size of Gene 757 is 3.6 Kb, of which 3253 bp have been identified (FIG. 6). The transcript is contiguous with genomic DNA, indicating that Gene 757 is an intronless gene. The Gene 757 ORF is 1746 bp long and encodes a 581 amino acid protein. The 3' untranslated region is 1052 bp long, and 456 bp of the 51 UTR has been sequenced.

The FZD10 protein is a receptor composed of a seven-transmembrane repeat with an N-terminal cysteine-rich domain and a C-terminal Ser/Thr-XXX-Val motif. FZD10 shares 65.7% overall amino acid identity with FZD9 (Koike et al., 1999, *Biochem. Biophys. Res. Commun.* 262:39-43). Frizzled 10 is a cell surface receptor for the secreted glycoprotein Wnt-7a. In accordance with one model of respiratory diseases, the WNT signaling gene acts in concert with the frizzled 10 receptor to trigger a signal transduction pathway leading to the activation of genes involved in bronchial epithelial repair. Thus, Gene 757 SNPs that are associated with the asthma phenotype (Table 10 and FIGS. 9A-9F) may alter the signal transduction pathway, causing either the over- or underexpression of genes involved in bronchial epithelium repair. This alteration, in turn, may result in the activation of the epithelial-mesenchymal trophic unit in the lung, placing the bronchial epithelium in a "state of repair" mode, and leading to airway remodeling (Holgate et al., 1999, *Clin. Exp. Allergy. Suppl* 2:90-95). The sum of these data indicate that Gene 757 (FZD10) is directly involved in the pathophysiology of respiratory disorders including asthma.

Example 15

Protein Expression and Purification

Expression and purification of the chromosome 12q23-qter proteins of the invention can be performed essentially as follows. Nucleotide sequences (e.g., one or more of SEQ ID NO:1 to SEQ ID NO:92 and SEQ ID NO:156 to SEQ ID NO:4684) are prepared by polymerase chain reaction (PCR). Synthetic oligonucleotide primers specific for the 5' and 3' ends of the nucleotide sequences are designed and purchased from Life Technologies (Gaithersburg, Md.). All forward primers (specific for the 5' end of the sequence) are designed to include an NcoI cloning site at the 5' terminus. These primers are designed to permit initiation of protein translation at the methionine residue encoded within the NcoI site followed by a valine residue and the protein encoded by the nucleotide sequence. All reverse primers (specific for the 3' end of the sequence) include an EcoRI site at the 5' terminus to permit cloning of the sequence into the reading frame of the pET-28b expression vector (Novagen). The pET-28b vector provides a sequence encoding an additional 20 carboxyl-terminal amino acids including six histidine residues, which comprise the His-Tap affinity tag.

Genomic DNA prepared from the 12q23-qter including the BAC sequences including RPCI-11_0899A17, RPCI-11_0666B20, RPCI-11_0723P10, RPCI-11_0831E18, RPCI-11_0932D22 and RPCI-11_0702C13 (SEQ ID NO:719 to SEQ ID NO:978; Table 3A) and BAC end sequence (SEQ ID NO:156 to SEQ ID NO:693) region is used as the template for PCR amplification (Ausubel et al, 1994). For PCR amplification, cDNA (50 ng) is introduced into a reaction vial containing 2 mM $MgCl_2$, 1 µM synthetic primers (forward and reverse primers complementary to and flanking a defined 12q23-qter region), 0.2 mM of each of dNTP (dATP, dGTP, dCTP, and dTTP), and 2.5 U heat stable DNA polymerase (Amplitaq, Roche Molecular Systems, Inc., Branchburg, N.J.) in a final volume of 100 µl.

Upon completion of thermal cycling reactions, each sample of amplified DNA is purified using the Qiaquick Spin PCR purification kit (QIAGEN, Gaithersburg, Md.). PCR products are subjected to digestion with the restriction endonucleases, e.g., NcoI and EcoRI (New England BioLabs, Beverly, Mass.) (Ausubel et al, 1994). The digested DNA is subjected to electrophoresis on 1.0% NuSeive (FMC Bio-Products, Rockland, Me.) agarose gels. The gel is incubated with ethidium bromide, and the digested DNA is visualized with long-wave UV irradiation. The DNA fragments are isolated from the agarose gel, and are purified using the GeneClean Kit protocol (BIO 101, Vista, Calif.).

The pET-28b vector is prepared for cloning by digestion with restriction endonucleases, e.g., NcoI and EcoRI (New England BioLabs, Beverly, Mass.) (Ausubel et al, 1994). The digested pET-28b expression vector is ligated to the gel-isolated DNA fragments (Ausubel et al., 1994). The ligated product is used to transform E. coli (e.g., BL21) (Ausubel et al, 1994) as follows. Briefly, 1 µl of ligation reaction is mixed with 50 µl of electrocompetent BL21 cells, and the cells are subjected to a high voltage pulse. Following this, cells are incubated in 0.45 ml SOC medium (0.5% yeast extract, 2.0% tryptone, 10 mM NaCl, 2.5 mM KCl, 10 mM $MgCl_2$, 10 mM $MgSO_4$, and 20 mM glucose) at 37° C. with shaking for 1 hr. Cells are then spread on LB agar plates containing 25 µg/ml kanamycin sulfate, and grown overnight. Transformant BL21 colonies are then isolated and analyzed to evaluate cloned inserts, as described below.

Individual BL21 tranformant colonies are analyzed by PCR amplification. The PCR reaction uses the same forward and reverse primers specific for the 12q23-qter region sequences that are used in the cloning step. Successful amplification verifies the ligation of the sequence in the expression vector (Ausubel et al., 1994). Individual BL21 colonies containing pET-28b vectors with 12q23-qter region nucleotide sequences are inoculated into 5 ml of LB broth plus 25 µg/ml kanamycin sulfate, and grown overnight. The following day, plasmid DNA is isolated and purified using the QIAGEN plasmid purification protocol (QIAGEN Inc., Chatsworth, Calif.).

The pET vector can be propagated in any E. coli K-12 strain, e.g., HMS174, HB101, JM109, DH5, and the like, for purposes of cloning or plasmid preparation. Hosts for expression include E. coli strains containing a chromosomal copy of the gene for T7 RNA polymerase. These hosts are lysogens of bacteriophage DE3, a lambda derivative that carries the lad gene, the lacUV5 promoter, and the gene for T7 RNA polymerase. T7 RNA polymerase is induced by addition of isopropyl-β-D-thiogalactoside (IPTG), and the T7 RNA polymerase transcribes any target plasmid containing a functional T7 promoter, such as pET-28b, carrying its gene of interest. Strains include, for example, BL21(DE3) (Studier et al., 1990, *Meth. Enzymol.*, 185:60-89).

To express the recombinant sequence, 50 ng of plasmid DNA are isolated as described above to transform competent BL21 (DE3) bacteria as described above (provided by Novagen as part of the pET expression kit). The lacZ gene (β-galactosidase) is expressed in the pET-System as described for the 12q23-qter region recombinant constructions. Transformed cells are grown in SOC medium for 1 hr, and then plated on LB plates containing 25 µg/ml kanamycin sulfate. The following day, the colonies are pooled and grown in LB medium containing kanamycin sulfate (25 µg/ml) to an optical density at 600 nM of 0.5 to 1.0 OD units. At that point, 1 mM IPTG is added to the culture for 3 hr to induce gene expression of the 12q23-qter sequences.

After induction of gene expression with IPTG, cells are collected by centrifugation in a Sorvall RC-3B centrifuge at 3500×g for 15 min at 4° C. Pellets are resuspended in 50 ml of cold mM Tris-HCl, pH 8.0, 0.1 M NaCl, and 0.1 mM EDTA (STE buffer). Cells are then centrifuged at 2000×g for 20 minutes at 4° C. Wet pellets are weighed and frozen at −80° C. until ready for protein purification.

The disclosure of each of the patents, patent applications, and publications cited in the specification is hereby incorporated by reference herein in its entirety.

Although the invention has been set forth in detail, one skilled in the art will recognize that numerous changes and modifications can be made, and that such changes and modifications may be made without departing from the spirit and scope of the invention.

SEQUENCE LISTING (6161 sequences)

SEQ ID NO: 1 - DNA, 1413 bp, Homo sapiens
tcacgagctgcccacgtcctctccaggaagggaccccgggttcacgagctgcccacgtcgtctccaggaagggacccgggtccacgagctgcccacgtcctctccaggaaaggacccgggtccacgagctggccacgtcctctgcaggaagggaccccgggtccacgagctgcccacgtcctctccaggaagggaccccgggttcacgagctgcccacgtcctctccaggaagggaccccgggtccacgagctgcccacgtcctctccaggaagggaccccgggtccacgaactgcccacgtcctctccaggaagggaccccgggttcacgagctgcccacgtcctctccaggaggggacaccgggttcacgagctgcccacgccctctccaggaagggaccccgggttcatgagctgcccacgtcctctccaggaagggacccgggtccacgaactgcccacgccctctccaggaggggacccgggtccacgagctgcccacgtcgtcaacgggaagggacccgggtccacgagctgcccacgtcctctccaggaagggacccgggtccacgaactgcccacgcgctctccaggaggggacaccgggttcacgagctgcccacgccctctccaggaagggaccccgggttcacgagctgcccacgtcctctccaggaggggacaccgggttcacgagctgcccacgtcctctccaggaggggacaccgggttcacgagctgcccacgccctctccaggaggggacaccgggttcacgagctgcccacgtcctctccaggaagggacccgggtccacgagctgcccacgtcctctccaggaggggacaccgggttcacgagctgcccacgcactttccaggaagggaccccgggttcaggtctcctgccggcccacatcgtgcctttgtgtaaatcagaagaaagatgaggaacaggccctcctctctctccaggcaggctttggtggaggggctggatctcctgccgcaccttccctggcagggcaccctgtgcttgagccccagaactgcaggcggccggcagagaaggggtccatgatggcgcctcggtgcgcagccttggacctgcccccatggacctggagacagggtttctcctcattggccaggctggtctcgaactcctgacctcagacgatccacctgcctcagcctcccgaagtgttgggattacaggcacgagccactgtgcccggccatcattcctttttactgctgactaatagtctgctgtgtgaatccaccgctagaaacccactcatcagttgatggtcatgtgggttgcttctgctattcgcttattatgaacagtgctggaataaacgttcctgtgcactcttgggcatacgcctaggagtggaactgctgggtc

SEQ ID NO: 2 - DNA, 1553 bp, Homo sapiens
tcacgagctgcccacgtcctctccaggaagggaccccgggttcacgagctgcccacgtcgtctccaggaagggacccgggtccacgagctgcccacgtcctctccaggaaaggacccgggtccacgagctggccacgtcctctgcaggaagggaccccgggtccacgagctgcccacgtcctctccaggaagggaccccgggttcacgagctgcccacgtcctctccaggaagggaccccgggtccacgagctgcccacgtcctctccaggaagggaccccgggtccacgaactgcccacgtcctctccaggaagggaccccgggttcacgagctgcccacgtcctctccaggaggggacaccgggttcacgagctgcccacgccctctccaggaagggaccccgggttcatgagctgcccacgtcctctccaggaagggacccgggtccacgaactgcccacgccctctccaggaggggacccgggtccacgagctgcccacgtcgtcaacgggaagggacccgggtccacgagctgcccacgtcctctccaggaagggacccgggtccacgaactgcccacgcgctctccaggaggggacaccgggttcacgagctgcccacgccctctccaggaagggaccccgggttcacgagctgcccacgtcctctccaggaggggacaccgggttcacgagctgcccacgtcctctccaggaggggacaccgggttcacgagctgcccacgccctctccaggaggggacaccgggttcacgagctgcccacgtcctctccaggaagggacccgggtccacgagctgcccacgtcctctccaggaggggacaccgggttcacgagctgcccacgcactttccaggaagggaccccgggttcaggtctcctgccggcccacatcgtgcctttgtgtaaatcagaagaaagatgaggaacaggccctcctctctctccaggcaggctttggtggaggggctggatctcctgccgcaccttccctggcagggcaccctgtgcttgagccccagaactgcaggcggccggcagagaaggggtccatgatggcgcctcggtgcgcagccttggacctgcccccatggacctgggaacctcccggctcttcccactcgggaaaggaaggctctgggcatggaggtcggccaggccccatccccgtaccctggcccttcttcctgcttcctgtttgtcactgccccggggcctttgcacctgcattccctctctctagacagggtttctcctcattggccaggctggtctcgaactcctgacctcagacgatccacctgcctcagcctcccgaagtgttgggattacaggcacgagccactgtgcccggccatcattcctttttactgctgactaatagtctgctgtgtgaatccaccgctagaaacccactcatcagttgatggtcatgtgggttgcttctgctattcgcttattatgaacagtgctggaataaacgttcctgtgcactcttgggcatacgcctaggagtggaactgctgggt

SEQ ID NO: 3 - DNA, 1990 bp, Homo sapiens
tcacgagctgcccacgtcctctccaggaagggaccccgggttcacgagctgcccacgtcgtctccaggaagggacccgggtccacgagctgcccacgtcctctccaggaaaggacccgggtccacgagctggccacgtcctctgcaggaagggaccccgggtccacgagctgcccacgtcctctccaggaagggaccccgggttcacgagctgcccacgtcctctccaggaagggaccccgggtccacgagctgcccacgtcctctccaggaagggaccccgggtccacgaactgcccacgtcctctccaggaagggaccccgggttcacgagctgcccacgtcctctccaggaggggacaccgggttcacgagctgcccacgccctctccaggaagggaccccgggttcatgagctgcccacgtcctctccaggaagggacccgggtccacgaactgcccacgccctctccaggaggggacccgggtccacgagctgcccacgtcgtcaacgggaagggacccgggtccacgagctgcccacgtcctctccaggaagggacccgggtccacgaactgcccacgcgctctccaggaggggacaccgggttcacgagctgcccacgccctctccaggaagggaccccgggttcacgagctgcccacgtcctctccaggaggggacaccgggttcacgagctgcccacgtcctctccaggaggggacaccgggttcacgagctgcccacgccctctccaggaggggacaccgggttcacgagctgcccacgtcctctccaggaagggacccgggtccacgagctgcccacgtcctctccaggaggggacaccgggttcacgagctgcccacgcactttccaggaagggaccccgggttcaggtctcctgccggcccacatcgtgcctttgtgtaaatcagaagaaagatgaggaacaggccctcctctctctccaggcaggctttggtggaggggctggatctcctgccgcaccttccctggcagggcaccctgtgcttgagccccagaactgcaggcggccggcagagaaggggtccatgatggcgcctcggtgcgcagccttggacctgcccccatggacctggatgccagtgatgcctgaggtctgcagggcagtgcatacgctcaccgcctggccgctcaggagcctgtgcttgacccccaaatccgccccccaactccctgttaccggctcactccttccatgaggggccttccccagggacagccgatgctctcctgatggctcctgcccttgcagagtgctgcccccgcctgcccacctggcctggaccctcgcctgagccccctcagggctctgcgccacctcaacccaggcgtttgttccgcaggaacctcccggctcttcccactcgggaaaggaaggctctgggcatggaggtcggccaggccccatccccgtaccctggcccttcttcctgcttcctgtttgtcactgccccggggcctttgcacctgcattccctctctctgtgagtgtcctggggcccgttacccacgtcaccgtcccaggataccttttcttttctttctctctctccagctttattgaggtatagttgacaattcaggacggtgtgcactcaaggtatgcagcatcacaacctgacacacgtaggcattgtgaaatgagtcccacaattgggctaattaacacacccatcaccttacatggttacttctttctgtggtgagaacactaaattttaaatagaggacacacagcctgggcaacatagtgagaccctgtctctacaaatataaaaaaattatctggacgtggtggtgcacacctgtggtcccagctacttgggaagctgaggctggagaatcacttgagcctgggaggcggaggttgcggtgcactccagcctgggcgacagagggaggccctatctcaaaataaataaataaaggacacattcttatc

SEQ ID NO: 4 - DNA, 1560 bp, Homo sapiens
tcacgagctgcccacgtcctctccaggaagggaccccgggttcacgagctgcccacgtcgtctccaggaagggacccgggtccacgagctgcccacgtcctctccaggaaaggacccgggtccacgagctggccacgtcctctgcaggaagggaccccgggtccacgagctgcccacgtcctctccaggaagggaccccgggttcacgagctgcccacgtcctctccaggaagggaccccgggtccacgagctgcccacgtcctctccaggaagggaccccgggtccacgaactgcccacgtcctctccaggaagggaccccgggttcacgagctgcccacgtcctctccaggaggggacaccgggttcacgagctgcccacgccctctccaggaagggaccccgggttcatgagctgcccacgtcctctccaggaagggacccgggtccacgaactgcccacgccctctccaggaggggacccgggtccacgagctgcccacgtcgtcaacgggaagggacccgggtccacgagctgcccacgtcctctccaggaagggacccgggtccacgaactgcccacgcgctctccaggaggggacaccgggttcacgagctgcccacgccctctccaggaagggaccccgggttcacgagctgcccacgtcctctccaggaggggacaccgggttcacgagctgcccacgtcctctccaggaggggacaccgggttcacgagctgcccacgccctctccaggaggggacaccgggttcacgagctgcccacgtcctctccaggaagggacccgggtccacgagctgcccacgtcctctccaggaggggacaccgggttcacgagctgcccacgcactttccaggaagggaccccgggttcaggtctcctgccggcccacatcgtgcctttgtgtaaatcagaagaaagatgaggaacaggccctcctctctctccaggcaggctttggtggaggggctggatctcctgccgcaccttccctggcagggcaccctgtgcttgagccccagaactgcaggcggccggcagagaaggggtccatgatggcgcctcggtgcgcagccttggacctgcccccatggacctgggaacctcccggctcttcccactcgggaaaggaaggctctgggcatggagctttattgaggtatagttgacaattcaggacggtgtgcactcaaggtatgcagcatcacaacctgacacacgtaggcattgtgaaatgagtcccacaattgggctaattaacacacccatcaccttacatggttacttctttctgtggtgagaacactaaattttaaatagaggacacacagcctgggcaacatagtgagaccctgtctctacaaatataaaaaaattatctggacgtggtggtgcacacctgtggtcccagctacttgggaagctgaggctggagaatcacttgagcctgggaggcggaggttgcggtgcactccagcctgggcgacagagggaggccctatctcaaaataaataaataaaggacacattcttatc

SEQ ID NO: 5 - DNA, 1723 bp, Homo sapiens
tcacgagctgcccacgtcctctccaggaagggaccccgggttcacgagctgcccacgtcgtctccaggaagggacccgggtccacgagctgcccacgtcctctccaggaaaggacccgggtccacgagctggccacgtcctctgcaggaagggaccccgggtccacgagctgcccacgtcctctccaggaagggaccccgggttcacgagctgcccacgtcctctccaggaagggaccccgggtccacgagctgcccacgtcctctccaggaagggaccccgggtccacgaactgcccacgtcctctccaggaagggaccccgggttcacgagctgcccacgtcctctccaggaggggacaccgggttcacgagctgcccacgccctctccaggaagggaccccgggttcatgagctgcccacgtcctctccaggaagggacccgggtccacgaactgcccacgccctctccaggaggggacccgggtccacgagctgcccacgtcgtcaacgggaagggacccgggtccacgagctgcccacgtcctctccaggaagggacccgggtccacgaactgcccacgcgctctccaggaggggacaccgggttcacgagctgcccacgccctctccaggaagggaccccgggttcacgagctgcccacgtcctctccaggaggggacaccgggttcacgagctgcccacgtcctctccaggaggggacaccgggttcacgagctgcccacgccctctccaggaggggacaccgggttcacgagctgcccacgtcctctccaggaagggacccgggtccacgagctgcccacgtcctctccaggaggggacaccgggttcacgagctgcccacgcactttccaggaagggaccccgggttcaggtctcctgccggcccacatcgtgcctttgtgtaaatcagaagaaagatgaggaacaggccctcctctctctccaggcaggctttggtggaggggctggatctcctgccgcaccttccctggcagggcaccctgtgcttgagccccagaactgcaggcggccggcagagaaggggtccatgatggcgcctcggtgcgcagccttggacctgcccccatggacctgggaacctcccggctcttcccactcgggaaaggaaggctctgggcatggaggtcggccaggccccatccccgtaccctggcccttcttcctgcttcctgtttgtcactgccccggggcctttgcacctgcattccctctctctgtgagtgtcctggggcccgttacccacgtcaccgtcccaggataccttttcttttctttctctctctccagctttattgaggtatagttgacaattcaggacggtgtgcactcaaggtatgcagcatcacaacctgacacacgtaggcattgtgaaatgagtcccacaattgggctaattaacacacccatcaccttacatggttacttctttctgtggtgagaacactaaattttaaatagaggacacacagcctgggcaacatagtgagaccctgtctctacaaatataaaaaaattatctggacgtggtggtgcacacctgtggtcccagctacttgggaagctgaggctggagaatcacttgagcctgggaggcggaggttgcggtgcactccagcctgggcgacagagggaggccctatctcaaaataaataaataaaggacacattcttatc

SEQ ID NO: 6 - DNA, 1116 bp, Homo sapiens
atggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtctgcaaactgcaccgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttga

SEQ ID NO: 7 - DNA, 7124 bp, Homo sapiens
agagcggctcttttaatgagggttgcgacgtctccctccccacacccataaaccagtcgggttggacgtcactgctaattcgtttcagtgatgataggataaaggagggacattaagaaataaattccccctcacgaccctcgctgagctcacggctcagtccctacatatttatgccgcgtttccagccgctgggtgaggagctacttagcgccgcggctcctccgaggggcggccgggcagcgagcagcggccgagcggacgggctcatgatgcctcagatctgatccgcatctaacaggctggcaatgaagatacccagagaatagttcacatctatcatgcgtcacttctagacacagccatcagacgcatctcctcccctttctgcctgaccttaggacacgtcccaccgcctctcttgacgtctgcctggtcaaccatcacttccttagagaataaggagagaggcggatgcaggaaatcatgccaccgacgggccaccagccatgagtgggtgacgctgagctgacgtcaaagacagagagggctgaagccttgtcagcacctgtcaccccggctcctgctctccgtgtagcctgaagcctggatcctcctggtgaaatcatcttggcctgatagcattgtgaggtcttcagacaggacccctcggaagctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccatcggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaagttttgtaagcgcggacagacactgctgaacctttcctctgggaccccctgtggccctcgctctgcctcctgtccttgtcgctgtgccctggtttccctcctcgggcttctcgcccctcagtggtttcctcggccctcctgggtttactccttgagttttcctgctgcgatgcaatgcttttctaatctgcagtggctcttacaaaactctgttcccactccctctcttgccgacaagggcaactcacgggtgcatgaaaccactggaacatggccgtcgctgtgggggtttttttctctggggttcccctggaaaggctgcaggaactaggcacaagctctctgagccagtccctcagccactgaagtccccctttctccttttttatgatgacattttggttgtgcgtgcctgtgtgtgtgtgtgtgtgtgtgtgtgtgtgtgtgatgggccaggtctctgtccgtcctcttccctgcacaagtgtgtcgatcttagattgccactgctttcattgaagaccctcaatgccaagaaacgtgtccctggcccatattaatccctcgtgtgtccataattagggtccacgcccatgtacctgaaacatttggaagccccataattgttctagttagaaagggttcagggcatggggagaggagtgggaaattgattaaaggggctgtctcccaatgaaagaggcattcccagaatttgctgcatttagattttgataccagtgagcagagccctcatgtgacatgaacccatccaatggattgtgcaaatcccctccccaaacccacccataccagctagaatcacttgactttgccacatccattgactgaccccctcctccagcaatagcatccaaggggcctggaagttatgttgttcaaagaagcctggtggcaataaggatcttcccactttgccactggatgactttggatgggtcacttgtcctcagtttttcctagtcataatgtcatacgaacctaaagaatatgaatggattaaatgttaaagctttggtgcctggaaacaatatcaagtaacaatatgattattatttttttattcccccaaagcgggcttgctgcttcacccttggggatgaaataatggaagctggttaaagtggatgaggttggaaagagttgccataatgaggtcccacgtggcttcttcgataggagccacaacttggggtgggaagaacttgtccctcaggcttgttgccctctgcagttgatctccaaagttttaaacctgttaaattaattttgacaaataagttaccctcaactcagatcaaaaatgggcagccaagtcttcggtaggaattggagccggtgtaattcctccctaagaggcaacctgttgaatttactctctcagagtaaatggtgggaagggatccctttgtatacttttttaaatactacaaattagtgtcaggcagttcccagaaagagacaagaaatcctagtggcctcccagactgcagggtccccaaggatggaaagggaatgttctgctggttctaccctgtttgttgtgtcttgctatacagaaaaaccacatttcttttatatactgtacgtgggcatatcttgttgttcagtttgggtgtctgctaaagaggaagtgcactggccctctttgaaagggctttacagtgggggcaccaagaccccaaaggcccaggccaggagactgttaaagtgaaaaggcaatctatgactcaccttgctctgccatccctggcagcccccaccggtgtcctgttcctgccacatggagcttgacttcatgccagctataatctcccctgccttcctttaatcccaatttcccctgctcactcttccacagatataaagaacaaacacttagcatcccacactcaccccttctaatcctgaagggaagcccattctaaactcctttcctgcaaacccatttccagctcctagtagctttcctcccaaaggctttctttccaatcctttatagctttggagacgcctccccaattccccagggaaggaaactgttgtgtccaatccccattaaagacaaattgatcagtgcttccc

SEQ ID NO: 8 - DNA, 2263 bp, Homo sapiens
aggaagtagggagcggggtggcaggggggggacccgccgcggctgctgccaccgccgccaccaccgcctctgctcgtggcgtgggaaaggaggtgtgagtcccgggcgcgagccgcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaat

SEQ ID NO: 9 - DNA, 5423 bp, Homo sapiens
cccgggccaccgcctccgcccggctgcccgcccggactgtcgcggcccgcggtggcgacggcggccgctgcaaagtttccccggcggcggcggcccgggggcgcatcctcccgcaactgtcaagcgctggcggcggaaatgatgaggcgctggccattttccgagcccgggtttcctgcctgagccccgctcgagcgagccgcgagcgaggagccggcgggcgggagaggacgcgcccagggcgggggcccgcccgccccctcgggatttcgagggcccgggggcgcgcgacgccatgggccggccgggcccagagctcctgtctctcagcccggccgcaccacctgggtctccgccatgaacgggcctgccctgcagccctcctcgccctcttccgcgccctcagcctccccggcggcggccccgcggggctggagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaagagttcaaggcccaagctacaagcagcttgctccagcatccaggaggtccggtggtgcacacggcttgagatgcctgacaacctttacacctttgtgctgaaggtgaaggaccggacagacatcatctttgaggtgggagacgagcagcagctgaattcatggatggctgagctctcggagtgcacaggccgagggctggagagcacagaagcagagatgcatattccctcagccctagagcctagcacgtccagctccccaaggggcagcacagattcccttaaccaaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggaaggtggcaagaacagttctatcctggtgccttacgaataaaaaactggattctggtttacagcagctttacagtgatagttaaattaactggggctaggggaaaagcaaccaaaaagggaaaaaggactcctaggccctttctattaaatccttcagcaacaaggctggcttggtgccctccaagcatctaatggcttattaaattatcccacaattgggttttaggctccttttttgacccaaaatggaagctgggaatctggtgccataactaatgagaaactcctttaataccccacaatcagtgttctgttctacctggctactgcttcactggattgaaaatctatctatctccttgcacacatgggcacacacaatctccaccatccagggaggtcctgaattcaaatctctatctatccaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggagggcacccacgtccagactgcttcccgtccaagttaccaggacagctcaaaaacatgctgacagaaaactcccatggctctaggaaaaagtgacactaagccaacacctttctttatgtgggagcaaaatcagctgatgaaggggtgggcaccattgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttaaaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgaaattccttcatgctttctattcaggactaattcccttactgcaaatgtgttagctctaacatctcccacaagctaaaggaacttgcaagtatattaacaaggacacatctgacatcctgtgtttggttaaaatatacagcacattgtgataacataaagtggatccatcttgtatcattataggcaaaaggtatttggcaaatttttatgtatggttttatgtactgtacaagtaacttattcttgaataatgcaaattttgctataatgtacaaattgctatatgtgaattaaaaagtttccaaaatcttgaaaaaaaaaaaaaaaaaaaa

SEQ ID NO: 10 - DNA, 1801 bp, Homo sapiens
atgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacggatgatgctgtcaagcaatattgttttatttgtaataaaatatacaaaaatcacttgccagcagtagaaaaaggaccgactataccgacctttctgattagtaaacagttgaatcaaggactctggaaaaaaaaaaaaaaaaaaaaaaa

SEQ ID NO: 11 - DNA, 2543 bp, Homo sapiens
cggccccaggcctggaggggggtctgtgcgcggccggctggctctgccccgcgtccggtcccgagcgggcctccctcgggccagcccgatgtgaccgagcccagcggagcctgagcaaggagcgggtccgtcgcggagccggagggcgggaggaacatgacatcgcggagatggtttcacccaaatatcactggtgtggaggcagaaaacctactgttgacaagaggagttgatggcagttttttggcaaggcctagtaaaagtaaccctggagacttcacactttccgttagaagaaatggagctgtcacccacatcaagattcagaacactggtgattactatgacctgtatggaggggagaaatttgccactttggctgagttggtccagtattacatggaacatcacgggcaattaaaagagaagaatggagatgtcattgagcttaaatatcctctgaactgtgcagatcctacctctgaaaggtggtttcatggacatctctctgggaaagaagcagagaaattattaactgaaaaaggaaaacatggtagttttcttgtacgagagagccagagccaccctggagattttgttctttctgtgcgcactggtgatgacaaaggggagagcaatgacggcaagtctaaagtgacccatgttatgattcgctgtcaggaactgaaatacgacgttggtggaggagaacggtttgattctttgacagatcttgtggaacattataagaagaatcctatggtggaaacattgggtacagtactacaactcaagcagccccttaacacgactcgtataaatgctgctgaaatagaaagcagagttcgagaactaagcaaattagctgagaccacagataaagtcaaacaaggcttttgggaagaatttgagacactacaacaacaggagtgcaaacttctctacagccgaaaagagggtcaaaggcaagaaaacaaaaacaaaaatagatataaaaacatcctgccctttgatcataccagggttgtcctacacgatggtgatcccaatgagcctgtttcagattacatcaatgcaaatatcatcatgcctgaatttgaaaccaagtgcaacaattcaaagcccaaaaagagttacattgccacacaaggctgcctgcaaaacacggtgaatgacttttggcggatggtgttccaagaaaactcccgagtgattgtcatgacaacgaaagaagtggagagaggaaagagtaaatgtgtcaaatactggcctgatgagtatgctctaaaagaatatggcgtcatgcgtgttaggaacgtcaaagaaagcgccgctcatgactatacgctaagagaacttaaactttcaaaggttggacaagggaatacggagagaacggtctggcaataccactttcggacctggccggaccacggcgtgcccagcgaccctgggggcgtgctggacttcctggaggaggtgcaccataagcaggagagcatcatggatgcagggccggtcgtggtgcactgcagtgctggaattggccggacagggacgttcattgtgattgatattcttattgacatcatcagagagaaaggtgttgactgcgatattgacgttcccaaaaccatccagatggtgcggtctcagaggtcagggatggtccagacagaagcacagtaccgatttatctatatggcggtccagcattatattgaaacactacagcgcaggattgaagaagagcagaaaaggaagaggaaagggcacgaatatacaaatattaagtatcctctagcggaccagacgagtggagatcagagccctctcccgccttgtactccaacgccaccctgtgcagaaatgagagaagacagtgctagagtctatgaaaacgtgggcctgatgcaacagcagaaaagtttcagatgagaaaacctgccaaaacttcagcacagaaatagatgtggactttcaccctctccctaaaaagatcaagaacagacgcaagaaagtttatgtgaagacagaatttggatttggaaggcttgcaatgtggttgactaccttttgataagcaaaatttgaaaccatttaaagaccactgtattttaactcaacaatacctgcttcccaattactcatttcctcagataagaagaaatcatctctacaatgtagacaacattatattttatagaatttgtttgaaattgaggaagcagttaaattgtgcgctgtattttgcagattatggggattcaaattctagtaataggcttttttatttttatttttatacccttaaccagtttaattttttttttcctcattgttggggatgatgagaagaaatgatttgggaaaattaagtaacaacgacctagaaaagtgagaacaatctcatttaccatcatgtatccagtagtggataattcattttgatggcttctatttttggccaaatgagaataagccagtgcctgagactgtcagaagttgacctttgcactggcattaaagagtcatagaaaaaa

SEQ ID NO: 12 - DNA, 2618 bp, Homo sapiens
tgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttgcatcactgccttctgttcccgggggagcatggatcttttgtcctcactgctttctaatggggagggctgagggctccctgtccccacagcaggtatgtttgctctgccccagccccacacttgctctgaaaaccaagtgtcagagccccttccccttgtttttattttactgttataataattattaacttccttgtaatagaaataaagtttgtacttggagttcagctc

SEQ ID NO: 13 - DNA, 3739 bp, Homo sapiens
aaaagttgcggggcatagacgagcgccccgggacgcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcggctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagggctcctggcccctggaggaggttgtacttcttgtctccatcagctcatctgtccaggagggagaaaagtacccccatccctgtgctgccagacaccgtaccccgagcctcaggagtcctgaccagccccctccgtgtccacagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgcactccccttttatacctgctcttgttctactgagaaaagcctctccagcaataatgttttctagtcacttcctccgtctccgggacggcgtgcctggacactgtccgactttgatagatttctacactgaggttgaattcatatcgcctgagatgttttacttctctatacaccatgattttgtagagatattaaagacgttcccttttgtatctcttcttcatcaccgccactgggccttcactgatggtgtctggtgtgtagattgctttgtctgtggggtggggtggggaagcaatatgtattttattgtttcttagcacaagcaggtgtgctgggagcagctctgtgactccccctctttcacttcatagctcccaggactgttttataaactgctgctatttggaaaccccttctttacttcccaggccagcaagccttcactgaaactggttgaagagtgttgcacccttttgggcctagaattctgaactttatctgttctgtttctgtgggaggagaaggggaagtatgttttggggggctgcttcctgtctgagtaagccctcaggagcctcttgctcccctgtgaacccctgaaccttctgagcccccctgcttctatggggctctctcttctgccttctcaggaaagctgtgtctgattttggccatcaggactctgacgtctctttggtcttgttgatttacctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaccagaaaggggccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatg

SEQ ID NO: 14 - DNA, 3595 bp, Homo sapiens
aaaagttgcggggcatagacgagcgccccgggacgcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcggctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgcactccccttttatacctgctcttgttctactgagaaaagcctctccagcaataatgttttctagtcacttcctccgtctccgggacggcgtgcctggacactgtccgactttgatagatttctacactgaggttgaattcatatcgcctgagatgttttacttctctatacaccatgattttgtagagatattaaagacgttcccttttgtatctcttcttcatcaccgccactgggccttcactgatggtgtctggtgtgtagattgctttgtctgtggggtggggtggggaagcaatatgtattttattgtttcttagcacaagcaggtgtgctgggagcagctctgtgactccccctctttcacttcatagctcccaggactgttttataaactgctgctatttggaaaccccttctttacttcccaggccagcaagccttcactgaaactggttgaagagtgttgcacccttttgggcctagaattctgaactttatctgttctgtttctgtgggaggagaaggggaagtatgttttggggggctgcttcctgtctgagtaagccctcaggagcctcttgctcccctgtgaacccctgaaccttctgagcccccctgcttctatggggctctctcttctgccttctcaggaaagctgtgtctgattttggccatcaggactctgacgtctctttggtcttgttgatttacctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaccagaaaggggccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatg

SEQ ID NO: 15 - DNA, 3698 bp, Homo sapiens
aaaagttgcggggcatagacgagcgccccgggacgcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcggctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaaggatccaggacctggagcaaagagcggatggggagcggtgctgggcggccggctggcctcgggacggcgggcggagcagccccggagggcaggacgagggagggttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgcactccccttttatacctgctcttgttctactgagaaaagcctctccagcaataatgttttctagtcacttcctccgtctccgggacggcgtgcctggacactgtccgactttgatagatttctacactgaggttgaattcatatcgcctgagatgttttacttctctatacaccatgattttgtagagatattaaagacgttcccttttgtatctcttcttcatcaccgccactgggccttcactgatggtgtctggtgtgtagattgctttgtctgtggggtggggtggggaagcaatatgtattttattgtttcttagcacaagcaggtgtgctgggagcagctctgtgactccccctctttcacttcatagctcccaggactgttttataaactgctgctatttggaaaccccttctttacttcccaggccagcaagccttcactgaaactggttgaagagtgttgcacccttttgggcctagaattctgaactttatctgttctgtttctgtgggaggagaaggggaagtatgttttggggggctgcttcctgtctgagtaagccctcaggagcctcttgctcccctgtgaacccctgaaccttctgagcccccctgcttctatggggctctctcttctgccttctcaggaaagctgtgtctgattttggccatcaggactctgacgtctctttggtcttgttgatttacctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaccagaaaggggccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatg

SEQ ID NO: 16 - DNA, 562 bp, Homo sapiens
tggtcatctcagtttcttttctcaccttgactgcaagatgaaactccttgtgctagctgtgctgctcacagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtgctgccagacacatgacaactgctatgaccaggccaagaagctggacagctgtaaatttctgctggacaacccgtacacccacacctattcatactcgtgctctggctcggcaatcacctgtagcagcaaaaacaaagagtgtgaggccttcatttgcaactgcgaccgcaacgctgccatctgcttttcaaaagctccatataacaaggcacacaagaacctggacaccaagaagtattgtcagagttgaatatcacctctcaaaagcatcacctctatctgcctcatctcacactgtactctccaataaagcaccttgttgaaagaa

SEQ ID NO: 17 - DNA, 2048 bp, Homo sapiens
ccgcaaagtgctgggatgacaggtgtgagccaccgcccccggcccctcgcccgccttttgaaggagcctttcgtcctcaagggagaggccactccccccccgcgagttccatgccccctagagggtcatcgttcccgacggggaggtggcgccctcccccgggccccgggccccgaccgcccgtgctgcctccttccgggccatcatccgcgatgacggcgccgccagcaggccaggcggactgggcggggctccgagcggggactgggacccagaccgactrggggactgggagcgggcggcgcggccatggcgggctgctgckccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtccgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaaaaaaaaaaaaaaaaa

SEQ ID NO: 18 - DNA, 2103 bp, Homo sapiens
ccgcaaagtgctgggatgacaggtgtgagccaccgcccccggcccctcgcccgccttttgaaggagcctttcgtcctcaagggagaggccactccccccccgcgagttccatgccccctagagggtcatcgttcccgacggggaggtggcgccctcccccgggccccgggccccgaccgcccgtgctgcctccttccgggccatcatccgcgatgacggcgccgccagcaggccaggcggactgggcggggctccgagcggggactgggacccagaccgactrggggactgggagcgsgsgssscggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgctaccatctccatttggcagaagtggaaatggagtcccctagaaggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtcygtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaaaaaaaaaaaaaaaaaactcgag

SEQ ID NO: 19 - DNA, 5087 bp, Homo sapiens
gcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgcatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccgtcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggccactgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtttgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagatgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccaaagagtgaagggcagtacagtggcttcaagagtccttactgaagccaggcaccgtggctcacgtctgtaatcccagcgctttgggaggccgaggcaggcagatcacctgagatcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtcccaaaaaaaaaaaaaagagtccttaccaatagcaggggctgcagtagccatgttaacatgacatttaccagcaacttgaacttcacctgcaaagctctgtggccacattttcagccaaagggaaatatgctttcatcttctgttgctctctgtgtctgagagcaaagtgacctggttaaacaaaccagaatccctctacatggactcagagaaaagagattgagatgtaagtctcaactctgtccccaggaagttgtgtgaccctaggcctctcacctctgtgcctctgtctccttgttgcccaactactatctcagagatattgtgaggacaaattgagacagtgcacatgaactgtcttttaatgtgtaaagatctacatgaatgcaaaacatttcattatgaggtcagactaggataatgtccaactaaaaacaaacccttttcatcctggctggagaatgtggagaactaaaggtggccacaaattctttgacactcaagtcccccaagacctaagggttttatctcctccccttgaatatgggtggctctgattgctttatccaaaagtggaagtgacattgtgtcagtttcagatcctgatcttaagaggctgacagcttctacttgctgtcccttggaactcttgctatcggggaagccagacgccatttaaaagtctgcctatcctggccaggtgtggtggctcacacctgtaatcccagcactttgggagaccaaggcgggcggatcacttaaagtcaggagtccaagaccagactcgccaacatggtgaaaccgtatctctaataaaaatacaaaaattagctgggcatggtgcgggcacctgtagtcctagctatcaagaggctgagacaggagaaacacttgaacctgggaggtggaggttgcattgagctgagatcgtgccactgcactccaggctgggtgacagagcgagactccatctcaaaaaaaaaaaaaaaagaaaaaaaaaatgtctgcctatcctgagactgccctgctgtgaggaagcccaagcagtcacgtggacagtgcctgaccagccccagctttcaagccatccaagcccagtcaccaaacatgagagagaagaagccttcaggtgattctggactccactaacatatgactgataccgcatgatacatcccaagtgagaactgccccataaatccagaaaaccacattgctatcttaagtccctaagtttggggcttatttgttccacagcaacaggtaactggaacagagggcaagcctgatgaatgggcacacagactcagcccataccttccctggttctaatgttctcagggagcccggaccaaccctgggagcctcaggaacttaggtttccactggacagttctagaagggctatagaccaaatcaggtaactcaccagaccagccttggaatctatcaaatctaactgctgagctacccagtgcattccgatcctcatcacaattctttgactgaaggccgggcgtggtggctcacgcctgtaatcccagcactttgggaggctgaggcgggtggatcacctgaggtcaggagttcgagaccagcctggccaacatggtgagaccctgtctctactaagaatacaaaaattaggtggggtggcggtgggcgcctgtaatcccagctacttgggaggctgaggcaggagaatctcttgaacctggaaggtggaggttgcaataagccgagatagtgccactgcactccagcctagataacagagcaagactctgtctcaaaaaacaacaacaacaacaacaaaacaattctatgactgaaagtgactaaaaagctggctttatgccattaacactctgtactttgcagccaatcagaactgacgcagtctgggtgctagctgcttcaaaagcaacccacaccacacttttaccatttccatacatcaactgctgagaatatgaaaatgcacagtgacaggttttaggatcctgcttcaggatttccttttcctggtttggtcactagagttggctatttatctgtttctaaacaatagctattttatcgaatagtttagagaccactattaaatattgtgactgatgaaggatctgtgaatttttttatatatgttctaagagttaccattttgataccttttaaaaaccagcagctttctactatattcatgtaaaacagcatgaataaaaccattttttgatacagggttttatttggctttaaactcaggaaccaagttaattatgccagattgaactttgatttttactaccttttcaaagatattttaaaaagtggattactacatatgatttctttggagcttacatttctttacttcacgaattctatgtcactgttacaagtttccattctgatggcttctgggcctttgtacctttgtttttggtgccttattcctagtatgtttctatcaccttaatgaggccgcagatggagtcagaatgtgaaattacaaataatcactggatccatctactgttttccatcaccttccccactgatgctctgggcgagagagtgatgtgtcacttcaactgtgtgtaatatgtcagacacgtcctacaataacaggcgtcatatttgtattatttttagtttactgtagaaaataatgtcaccgccaaaggtgatgagagtcacgttttgtaggatctgttttcttatacttaaagacagacttctgctacggtaattgccagtattcatggcttcctttctgtgtcagaagagaagggatctgctttctcttggctgatttcacatagcattggtaatagacatgcatttctctttctaaaggggagtaactttttaaacccttcctgattttagcctggcaatgtaagtgtccttaatgtgactgttttgataattaaaaaaaggtatataattt

SEQ ID NO: 20 - DNA, 2041 bp, Homo sapiens
cgccactttgctggagcattcactaggcgaggcgctccatcggactcactagccgcactcatgaatcggcaccatctgcaggatcactttctggaaatagacaagaagaactgctgtgtgttccgagatgacttcattgccaaggtgttgccgccggtgttggggctggagtttatctttgggcttctgggcaatggccttgccctgtggattttctgtttccacctcaagtcctggaaatccagccggattttcctgttcaacctggcagtagctgactttctactgatcatctgcctgccgttcgtgatggactactatgtgcggcgttcagactggaactttggggacatcccttgccggctggtgctcttcatgtttgccatgaaccgccagggcagcatcatcttcctcacggtggtggcggtagacaggtatttccgggtggtccatccccaccacgccctgaacaagatctccaattggacagcagccatcatctcttgccttctgtggggcatcactgttggcctaacagtccacctcctgaagaagaagttgctgatccagaatggccctgcaaatgtgtgcatcagcttcagcatctgccataccttccggtggcacgaagctatgttcctcctggagttcctcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctcaaataaccattccaagaagggacattgtcaccaagaaccagcatctctggagaaacagttgggctgttgcatcgagtaatgtcactggactcggcctaaggtttcctggaacttccagattcagagaatctgatttagggaaactgtggcagatgagtgggagactggttgcaaggtgtgaccacaggaatcctggaggaacagagagtaaagcttctaggcatctgaaacttgcttcatctctgacgctcgcaggactgaagatgggcaaattgtaggcgtttctgctgagcagagttggagccagagatctacttgtgacttgttggccttcttcccacatctgcctcagactggggggggctcagctcctcgggtgatatctagcctgcttgtgagctctagcagggataaggagagctgagattggagggaattgtgttgctcctggaggaagcccaggcatcattaaacaagccagtaggtcacctggcttccgtggaccaattcatctttcagacaagctttagagaaatggactcagggaagagactcacatgctttggttagtatctgtgtttccggtgggtgtaataggggattagccccagaagggactgagctaaacagtgttattatgggaaaggaaatggcattgctgctttcaaccagcgactaatgcaatccattcctctcttgtttatagtaatctaagggttgagcagttaaaacggcttcaggatagaaagctgtttcccacctgtttcgttttaccattaaaagggaaacgtgcctctgccccacgggtagagggggtgcacgttcctcctggttccttcgcttgtgtttctgtacttaccaaaaatctaccacttcaataaattttgataggagac

SEQ ID NO: 21 - DNA, 2004 bp, Homo sapiens
cgcctagcccgccgggtcagcgcggccaggcctcgccgccggccccgctcccagggtgcaccgcggctagcgctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcagtatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcaaaaaaaaaaaaaaaaaaaaaa

SEQ ID NO: 22 - DNA, 2186 bp, Homo sapiens
ggcacgaggcgggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgatcagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccc

SEQ ID NO: 23 - DNA, 2566 bp, Homo sapiens
cgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagtccaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcagacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggctgaccacaggggctgtgggtcctgcgtccccttcctcgggtgagcctggcctgtcccgttcagccgttgggccaggcttcctcccctccaaggtgaaacactgcagtcccggtgtggtggctccccatgcaggacgggccaggctgggagtgccgccttcctgtgccaaattcagtggggactcagtgcccaggccctggcacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggcgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggaaaaaaaaaaaaaa

SEQ ID NO: 24 - DNA, 2920 bp, Homo sapiens
aaactgtgagctttatttcatgttatttttggtggatgttgacttagttcatgaatgttgtcacttctaaatgtggacagttgggctgcaggatgcaactcaacctcttttggatcctagagacccctgccaagcccccatcagtcctatttttaaatgaagacatcgccatttctagaagacctgagattttcttccctctgtgcttcgatgtattttaacctcaacattttgaaacggaaaatgcaaggaggggccaagaaatgtcctggggatttgatgccaggaagtacctggtaaggattggagattgctccagaatctactgcatgtcccaatttgcagtttgctcactagggctatatacaaaagctatacccttgagggtttttttttttttcttttgatttcctcaggaccttagagggaaaacaaacagtagcagctaatattctcaagtatattgctgcttagaaagatcctcaggaacaattagcagcaataagcaagcctttgaaaagatctgaattctttttcctgaaatatttacgatacacaggtgctttttatctgaaatctgttgtgtcctccttttaggcagtctctgtgggcagagagtgggacttgcgaggtggacagctgtggggatcctgggcaagggagtttcagaaggtgtggctcaggggctggtagaaacccccttttgttaggacttgttttttaaaaaagaaagccctaggccaggcgcagtggctgatgcctgtaatcccagcgctttgggaggccgaggagtatggatcacctgaggtcaggagttcaagaccagcctggccaacatggtgaaacccccgtctctactaaaaatacaaaaattagtcaggcatggtggtgggtgcctgtagtccagctactcaggaggctgaggcaggagaattgcttgaacctgggaggtggaggttgcggtgagccgagatcacgccactgcactccagcctaggcaacagagcaagacttcatcttaaaaaaaaaaaaaaaaagcccagcattttgcagctttgaagctgctggggatcacgactgtctctgtggcccttacctggccacagatgtaccctggcaacccgctcacagtgccctgcgtgcaggtttatagataacccctgccagacctgctacaaccaagaccttatggtccaggtctcagtttggagaagatttagctgtctaccacttcttgtgtagtgttcctgtgaagttttatttttggttgcaagtatctggaaaacagatgcagatgtttttgtggatgttgttgagacttttgagacttctgtttctaaggtacacatgatgggacccaaactctcctggagagttccattcacttcctgaaacgtgcacctgtttcaggtgcatgtttattcagtgtgcatggatatttaagatttgctggagcaggctgggcggggtggctcacccctgtgatcccagggtgctgggattgcaggcgtgagccaccgcgctgggcctagatcaaatctttatccatgcacattggaacacaggattactgggttgaaatcattctagttttgtcatttagatacttgtagatgaatctattttagcacaaggtataaataactcgggaggtcatctctatcttctttccttttgtgcatttggctataccacgtttaggtactaaaacagctttgcttatgttggccaggggaaaacatggcattctgtgcgcaaagctaatgatcgccagccctgccttggcccctcccttgtttatggtcattgtaagatgcccgcatgttaaggcttaagctgtcactgggctgggtgtaatacccgcttcattcctcctcccaccctcttacccgaaacatgaagggcactgtgctctattgagatctcgataagatcatcattttaacttgtattcaactgagggaggtaacatgatatctgggtgctggtggattgagacctcaagcatcaattcaaaattgctgtcgaaaatatgcactattttttttttccactctggctaagtgtaggctctgaagccagttttatagcttgatacattctggtgaaagatgtcttcatttttaatgaaagaacctacagttagtaggtgtcacctcagggtagaaattctgatagaaattctgattatttgaaactctgatagaaatcctagatgctagatttgaagaaaacctgggttttattgcatagattacaccttttctggggcacatcttaccccaaaataagtggggatttttttgttccttctccattccatggaaccttgtagggtgttgggattgggcctcccctcgccacccgccacatgtctttgtttttttctctcttttgtatgtggaaaaatgtatttttgtaccatatctcatacctggagagaaaccttttttctatcttcagggctgtagaatatattagcgtaacacttcactgaatgtgacgtaaaagcattctgatgaaaactggttctgttataattaagactcagtgtttaaaatatcttaatcagtgttaatttcccagtgtttcagtatcacagtaaatacttgttttactgagaacagaaaataatccagaaaaggaaaaggaccagccctctctagattgctggaattgtatggatgtgttggggttggtttagtgatctcttccttgacaccctagcaaagatgcttttgtggagtgcaaacctttcataaatatactttccaggctgggtgcagtggctcaagcttgtaatcccagcactttgggaggccaaggcgggtggatcacttgcggtcgggagttcgagaccagcctggccaacatagtgaaatcccgtctctaccaaaaaatacaaaaaaaaaaaaaaaaa

SEQ ID NO: 25 - DNA, 3253 bp, Homo sapiens
cttgttgttccccgccgccgccgtcgctgacccagcccgccaggcgctcctgaccgtcgcttcctccggtcccaggtccccggccctcgcctcagccccggcccctggtccccagccctcgtcgcagccccggccgcccgccgccgccatgtccaaggaggagcgccccggtcgggaggagatcctggagtgccaggtgatgtgggagcctgacagtaagaagaacacgcagatggaccgcttccgggcggctgtgggcgccgcctgcggcctggcgctggagagttatgatgacttgtaccattggtccgttgagtcatattcagacttctgggcagagttctggaaattcagtggaattgtcttctcacgtgtgtatgatgaggttgtggacacatcgaaaggaatcgcagatgtccccgagtggttcaaaggcagtcggctcaactatgcagaaaacctcctgcggcacaaagagaatgacagagttgccctttacattgtaagggaaggcaaagaggaaattgtgaaggtgacttttgaagagctgaggcaaggagtggctttgtttgcagcagcaatgaggaaaatgggtgcgaagaaaggagatcgggttgttggttatttacccaacagtgagcacgctgtcgaggcgatgctggctgcggcaagcattggtgccatctggagctccacgtccccggacttcggtgtgaatggtgtgctggaccggttttctcaaattcagccaaagctcatcttctctgtggaggctgttgtctataatggcaaagagcacaaccacatggaaaagctgcagcaggtggttaaaggcctaccagacttgaagaaagtggtggtgattccttatgtgtcctccagagagaacatagacctttcaaagattccaaacagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctgggggcaccctcatccagcatctgaaggagcacctgctgcacggcaacatgaccagcagtgacatcctcctgtgctacaccacggtcggctggatgatgtggaactggatggtgtcccttctggccacaggagcggccatggtcttgtacgatggctcccccctggtgcccacgcccaatgtgctctgggacctggttgacaggataggcatcactgtcctggtaactggggccaagtggctgtcagtgctggaagagaaggccatgaagccggtggaaacccacagtctccagatgctccacacgatcctgtccactggctccccactgaaagcccagagctacgagtatgtctacaggtgcatcaagagcagcatcctcctgggctccatctcaggaggcaccgacattatctcctgcttcatgggccacaatttttctcttcctgtgtataaaggggagattcaggcccggaacctgggcatggccgtggaagcgtggaacgaggaaggaaaggcggtctggggagagagcggcgagctggtgtgtactaagccgatcccttgccagcccacacacttctggaacgatgagaacggcaacaagtacaggaaggcgtatttctccaaattcccaggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagtgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaacccccgtgacttgacacagctttcacagctggctgctaggaccggcgggctgggtgttcacgtgtgtctgtgtcatggatgcaatgcaggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgc

SEQ ID NO: 26 - DNA, 2280 bp, Homo sapiens
agacacatcgaaaggaatcgcagatgtccccgagtggttcaaaggcagtcggctcaactatgcagaaaacctcctgcggcacaaagagaatgacagagttgccctttacattgcaagggaaggcaaagaggaaattgtgaaggtgacttttgaagagctgaggcaagaagtggctttgtttgcagcagcaatgaggaaaatgggtgtgaagaaaggagatcgggttgttggttatttacccaacagtgagcacgctgtcgaggcgatgctggctgcggcaagcattggtgccatctggagctccacgtccccggacttcggtgagaatggtgtgctggaccggttttctcaaattcagccaaagctcatcttctctgtggaggctgttgtctataatggcaaagagcacaaccacatggaaaagctgcagcaggtggttagaggcctaccagacttgaagaaagtggtggtgattccttatgtgtcctccagagagaacatagacctttcaaagattccaaacagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctgggggcaccctcatccagcatctgaaggagcacctgctgcacggcaacatgaccagcagtgacatcctcctgtgctacaccacggtcggctggatgatgtggaactggatggtgtcccttctggccacaggagcggccatggtcttgtacgatggctcccccctggtgcccacgcccaatgtgctctgggacctggttgacaggatagggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgc

SEQ ID NO: 27 - DNA, 1500 bp, Homo sapiens
agcggggagcttargcggsgcgtggctgagaaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattatttttgttgagtccttatgagaaacagcagtatgaatcttgacggtttctgcccgtcctaatggcagagctctctgacttgggtgtatgctgccaggctgggtactttcatacttkgttttcttgttttgctttaaaactacgactcagcatacattttcccacatacatttttacattgtaccttaggactcagtcatctccacttaaattgatgacacaagcagctaataaccatttctgggtttctgcctaaccccctaatggtctgttaaaggccaattctctgggtgtccccagtgaagtggtggctttttwtctttccacatggggacattcacttctcccactcttggcatgtaagaaa

SEQ ID NO: 28 - DNA, 2369 bp, Homo sapiens
acggcggcgagcaggctgcaggcccgcggggatccggggcgcggggggcgccgggcctgatcgccgcctctcgcggtgcccgcaggtccccgggcgcgcagctctcgccccgccgccgcctgccccgggccccggagcgcggtggagaagcccccggaggagcggggggcccgcgccccgcgccccccagacatggtgggccacctgcatctgcagggcatggaggacagcctgaaggagcagggccgggagggcttgctggacagccccgactccgggctgccccccagccccagccccagcccgcccttctactccctggcgcccggcatcctcgacgcgcgcgcgcggggggcgccggcgcctcctcggagcccccgggacccagcgaggccagagcgccccccctcccaactcccaaatcccccggcgtcggagatgaggccccggatgctgccagtgttctttggggagagcatcaaggtgaacccggaacccacgcatgagatccgctgcaactctgaggtcaagtacgcctcggagaagcatttccaggacaaggtcttctatgcgcccgtacccaccgtcacggcctacagcgagaccatcgtggcagcacccaactgcacgtggcgcaactaccgcagccagctgaccctggagccacgcccgcgcgccctgcgcttccgcagcaccaccatcatcttccccaagcatgccaggagcactttccggaccaccctgcactgcagcctgggccggcccagccgctggttcaccgccagcgtgcagctgcagctttgccaggaccctgcccccagcctcctgggccctgccacgctctgacggggctggggccggcccggggtgctggaggagccgggagccctggggagaagccgggaggatggacacgatgagctcggcctggcactcgggcaggaggcgggaagggaggctgccagaccaaggacccgtgtggaaggaggcggctccccgctgcctgccctgacctacaggctaggtggtggtctccttgttttggtgtcaaggactcagtaaaagcatctatttttttagcacttaagctggcaaggcggtaggggcatgcactgttaggtggtggccacccccagggtcaggggaaaagaatgggtccatagagtgcccttgaagcagagaacagccccgagcagtgtgaggacagaggcatcccagcctcagccggtgggaacggctgccactcccccagagccctgccaccccatgtgtcctaggctggtggccaaggccatgtgtgagggaagaggggtacctctcttccctgctgctggcctggggtatttccaaaacagccttttcgcacacatgcaggttgcaccgagaggtctggagctgtggctgagccacctctggtggatgttgagccaggaggttgggcaaaggccggatgctgatgccagcgctggaggtggtgatactgggggcggggaaggcctagaaatactttgagccatggccttgccagtgtcccgtgccctccagtgtcaaagatttggggcactgcccgtcgaaatggaaaggttggtgctcagcctctggagcctcacctgcagggcgtccccagctaacacccatccacgcaccacctccaggacgagaacccttgatgtcaaaaccaagtgcccagtggaggcggtgaagctctcggaaatgctgccacctgtgtgaggccgggtctgaactcgagggagtcggagctcagctgtcggtttaaagagacactgaggggaccgggctgccgccctcagcctgcattcctgtgcgcaatcgattccgcaatgacagcaccttactccttcctgcggcaggctcacccctgcctgtgggatgttgtgagaggaacatgagccagacaaagacttggctcagggctccgtggaacaagccaggatgcacggggagctgggggagcccccagcctggggcagcccagcaggccgctgaacaaacaccccagaagccagcactgtggcagggtgctggggagatgcccctctgagccttcctcccccctcagacctgaatgcaccccacagttgggggctgcccctgccactcccctggtaatgcataaaaggggaggggaaggttccctggggcttgagctccctctgtggaggtgaggaggggagattccgttcacatccaggaggggcaaaatgactgatgtatttttatgtatctacacagagagtgcattttctctccagagatgctgtctggttaacaaaggaataacttaagaaattgattgattatcttaataaactgtgcaaacccaaaaaaaaaaaaaaaaaaaaaaaaaa

SEQ ID NO: 29 - DNA, 538 bp, Homo sapiens
cttgaatacattatctgaaattcggactgctggctcagaaaaatctaaagtcgtttttaaataactatacaattactttgtcataaaagtcaagtgaaaattacctattttcttatttttgagacaactgttctgattttaagaaacctgtaagtatcacagatctttcagcagtattatgagtacaggtcttcctatgaagcactaactatatataatccccctcttcaatagcagactctgacagtaaaatcaatttcaacagagatcaaattaatttcctacccagaaccagatctatcagaatgtgtggtatataattttgccactcaaagcataagggcacactttctgggaaagataaaagtgaaaaagaactgggaagatgacatgtcggcctccaatccctaccaaaaataaccactaccaactgcaatgagttgagatgaccatgtgattcatctccccacatgcatacagcaggccattgtggtcatagggggctgggataagattctctaagaaagataatccaagg

SEQ ID NO: 30 - DNA, 2391 bp, Homo sapiens
ttgaaagaagctatgcttgtagtgtgttgggaagacttaatctgagcaaaacccatgattcttcaagacagagactctataacacacgtggaaaaagtttgacacaaaactcagctccaagcagaagttatttaagaaagaatcctgataagtttcatggttatgaagaaccatattttcttaagcatcaaagagctcatagcatagaaaaaaactgtgtgtgtagtgaatgtgggaaagcttttcgttgtaagtcacagctcattgtacatctcagaattcatacaggagagagaccttatgaatgcagtaaatgtgaaagagccttcagtgccaagtcaaaccttaatgctcatcagagagttcatacaggggagaaaccctactcatgtagtgagtgcgagaaggtcttctctttcaggtcacagctcattgtccatcaggaaattcacacaggagggaaaccctatggctgcagtggatgtgggaaagcctacagttggaaatcacagcttcttttacaccagagaagtcacacaggagtgaaaccgtatgaatgcagcgaatgtgggaaagcctttagtttgaagtctccattcgttgtacaccagagaactcatacaggagtgaaaccccataaatgcagtgaatgtgggaaagcctttaggagtaagtcctatctccatgttcacatccgaatgcatacaggagaaaaaccctatcaatgcagtgattgtgggaaagccttcaatatgaagacacaactcattgtacatcagggagttcacacaggaaataatccttatcaatgcggtgaatgtgggaaagcctttggtaggaaggaacagctcactgcacatctgagagctcatgcaggagagaagccctatggatgcagtgaatgtgggaaggctttcagcagcaagtcataccttgttatacataggagaacacacaccggagagagaccctatgaatgtagtttgtgtgagagagccttttgtggaaaatcacagctgattatacatcagagaactcattcaactgagaagccctatgaatgcaatgaatgtgaaaaagcctaccctaggaaggcatcacttcagatacaccagaaaactcattcgggagagaaaccttttaaatgcagtgaatgtggaaaagccttcactcagaagtcatctctcagtgaacatcagagagttcacactggagagaaaccatggaaatgctctgaatgtgggaaatccttctgttggaattcagggcttcgtatacatcggaagactcataaatgagaaatcagaatgatgcaatgtgagaaactgatgttcaggagacttcggataatatagacaggatttacaagcaggaggccctaaaattacactcatgtcaaaaatcagagaggagagagaccaaccatatttgggatgagtgtaaaagctttcagaaataagttacaaatcyttgtagatgaaaataatggaaggaatgtggagcaataaatgtatcaaatgttgtagtatcatcatgaagattcagagaatttacactaggaacaccttataagttgaataaattaaggaagcattttcccattgaaagtgtgttccatggaaagtcacattccagatttgaagctgtgtttttgtaaaataaaatcttggtatgaacagttgacttcatggtggagtataaagttgtttttttaaaaatatgtaaataatgttcaggaaaaacgcagggaacagagtcttaaagttaatggatatttaatgtgactttcctgagttaacactgaatagtatttctaaaattttttgtactttattttttaatgtaacttgttctatctatctatatatatwtttgatagkttgtggaataatatcccccagtattttccatattaaatgctaattatcttttgawwwcttttycataagcagawctggcatttattacagggctgccgcttaagagaactcattataatgaacgtttattaatattttgcagttccatgcctgttgtccattgattgacatgagcacccctgttttctctggagaaatacctcccctctctggggtgcttcctgtggtagtgtctttcaggtatccgttccactagctacaggtgagcattttacccattgttggataatggtaatctctttttcagaattttgagtctgtaattcatttgtacatgaaccagaaaatgtgggaactcattcattcttgtcccagaattctgttgagaacatccattcattctggctaattgattacaagaataactgtggatacgatccctttagaacctgcttctctgatctgtgtgtttcctcacttctcaataaaaatgtcttttgctttttaaaaa

SEQ ID NO: 31 - DNA, 6509 bp, Homo sapiens
cttggaaatgacccgccacacctgaagcctgcaggtgctgaggccacattcgatcagacccaagctttgggagaccgctggggaaatttcccacttcctctcctgagaccaggaactcagcagagaaactttgtggaaaatgaactgaaggatgccacccagggagagtatctcctgagatcccatcatgcaggccttcccacaagggcccggcagcatgacaaggtgaaggcagagtatgtgcatctcaaccayccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccgcagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagccgcactgttgccatggagacgagtaccacacagagagcagccgggggtctgacctctcagacatcatggaggaggacgaggaggagctgtattctgaaatgcagctggaagatgggggaaggaggcggcccagcggcacgtcccacaatgccctcaagattttagggaacccagcctctgcaggacgggtggatcacatgggccggaggtttccccgtggcagcgctggtcctcagaggtcccggcccgtgacagtcccatccatcgacgattacgggcgagaccgcctttctccagacttctatgaagagtcagaaactgaccctggtgccgaagagctcccggcccggatctttgtggctctctttgactacgacccgctcaccatgtccccaaacccagatgctgcagaggaggagcttccctttaaagaaggccagatcatcaaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaatagagagaagcaggagaagtggcaggcgtcattcggtatcgacgcggagaatggtggccctgtatgactacgaccccagagaaagctcgcccaacgtcgatgtcgaggccgaacttacattttgcacaggagatattattacagtttttggtgaaattgatgaagatggattttattatggggagctgaacgggcagaaaggccttgtgccctcaaacttcttggaagaagtgcctgatgacgtagaagtctatctttctgatgctccatcccactactctcaagatacgccaatgcgctcaaaggcaaaaaggaagaagagtgttcatttcataccttaatcaggcaatgtagccttcacgtaagtgagcaactgaagataccgataaagataccaacttaagctaccttaaccgggccagtgtggtagacttaaggcttcattgtggggttaaaaaaaaaaaaagatacaaagaaatatgtctcaaaaaactattggacctaaataattagaatattacttggtctcagttgtaaagcaactgaatttatagtgaagcaaatcatctttaataatcatttcctactatttgcattaagaatatttgaaaggccaacattgggaacatatttcttaacaagctaactgtgtgtttacatagagagagctgcatattgcattgttagccactcttggaaaaagcacaacctaacaaacatgtttactataggaagctttactttagaaacttaacccaaggtcaagcagatgagtagtgaacacaggtgatcgagtgttggctctgaacactccaaacactggctcgagtggccagaacgtgttttccttaagtaaccctgcctctaccttacgagagagctatgctcctcctcaaagcacaatcatcctgtgacagaagttgctgcaacacgcgtttgttgttggtataccaatgcaatactaagttgatgaagcacgcagctcaaatgatcacattagatggaatagatggtatcttcaggtgtactttgggatgctttactaggtgttttccattagaattagaccttgattttaaatccaagcaagcttgaagccccttggcttacagcatttgcctgctgaatactaaacactcacatggcaagagttgctctggagaggtagggccagaggaatgctgctgcactgccaactcaggcacatgcttagctgtaaagggaagcgaggtgaagtcgtcctgcagcgtattagagtaaaagtctacccctctgaagcactattaagcgcttaacgtatatttaaatactaccatgtgctatctactgaggaagattcatgttcaattatttggaaataatgcaagcatccactaagggcctttaagctttctttgattataattaaggttcattttagttttttttttttctttcaaccagtgtgccatctccaatatttctatagtataccaaccaccccaggaatgcactttaacaatatcaggattttatataaccaaatagtttcaaatacaacaaaattccctttatgaactttcgctttttaagactactgatgggtactcggccaactttactatcaacctaatttcagatcatgtctcccctgcccttagtcttcatttatgaagtgaattattacctgccttagctttgccaaagcaacggccaccccgcactccctcgagacagagaaacggaacccacacatttatgtctggggcctctctctggcgtgctgtgggagaggacctttgcttctcatggcatacttcaacaactgaaagaacaaatgaacccccctgacctttcctggtgggaaacggggacagtacgatgttaccaagtgaattctgttgttggcgctcacacactcaataaactgtaacactgtacctactaggttcctcctgagggttcaggtacagcaaggagagctccatcccccacagtccatctccattcggggtcacctacgtcatctatgggttctggtagtcctgggagaggcagggaaatgtcctcgaaaaagaaaaaggggctgctttccaaaggcaagaaactgctgaaaaagctgggtgcagtgaaatgattcatgtgcttccggacaactgccaaatctatgtaattttctttaattccaaactagggctttcatgactcaagtacttcctaaaaaaacccaatcttctcccctgacaccagtagagaaatgcacttttgcactaccaaccactttaaaccaaccacgagaacaaagaggagcggttgctctctgtcaccgctggcagtctgctctcattgtccaagctctgatttgggaggtgggaggggacgtcttattaacaaacgggggcgcatagctatcacctgtagctccctccctacctgtaattccagtctttgtgcatttgtcatctgcccttaaaggaatgattttcaacctttctcccttctcaaaatgcttgcctcataatgcataactttcactttgactctggtcttgaaattcctagtttaattcgccttgatgttctgccttataaatgcacaatgatttgtactgtctaataaaaacagtgtatactttgtatgtgtcgtgcattcagtggtcttcatcctgacacagtggttcgagatcaagttgtacaggctgtgcattttaagatactagtttcagtctttcaaagccagccaggctacacacagaaaatgtttactcaatcattcaaaaaagagaaaaggagagaaagtaactttgtttggtaaagcaccagtactccaaccttccagaaagccgattatcttcattgcttttaatgttctattctgtggcatatggttttctgttactttcgttgtcaaaatgccatacccaaatacacagcaatgaatggcacacaagtaatccacataatgcataagccacaccaaaaccagactcaatttaaatctgctccaaatgagtccatacccatcttcatcattggcatttgaacaaaagacttacttacaaagttgctggcagatgtatttgatggttactcttttgtaattcttgtccacttgtaaattgtttttactctttatacatacttttcagactgcctttcttttgtaatttatggacggtttataaatgaatgacaaagctttccccattgtgtcttcaaaaacgctattataaattgtaatataatagtatgtggtagatttattattaaaggaaatccatgtgtggttaagctctgtgtgggtgtgtgcatgtgcacagttagtgtaaaatattttctagaaataaaatttgttattttat

SEQ ID NO: 32 - DNA, 1664 bp, Homo sapiens
ggtccccacgccaggatggatgaggcctgggagcagaagcctgtgcacctggccctgtgcatgggcacatgctggagccgcccgtgggccccgcatcctgccacagccacagggcaccccggtgtccaccaccgtcgccaaggccatggcccgggaggccgcgcagagggtggcgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagggaaactgaggcccacagaattgagaatttttgtccatgattacgcagatggtctcctaacagagctggaattagattgaaccgaggcctgaagaagacctgtttccacgcctttccccatgtgccacgttctcctcacctatccaggagtgaatcatcaccttccctgcaatctgctcaggttacaaacccggaggaaaggctggagcacttgttctctgggtgaaggacccatacccccactggtttttgagatcggcattcagcgctgtcttatggcagccmcagccccaggtggccccagagcccttgacatgtggccacctggggctgagtgtgactgaggccctgaatttttacttctataaaattagttccagattagtttacattcctaattagtttacatgtaaacagccacacgtggctggtggccaccagtgctgacgcccagctctggatgaccacacctgctacaagagatgacttttctagagaagagtagaaacacagcggcagaaacacagctctgcacttccgagggcctcccactccttctgatgagactgcagaggaagtctgtttggccaagcatgctattaacacgttttcctgcttgttttgttttttaacagagcaaacaggtctgtttctattaaaatttaaaaagcgttaatatttarcagcattgttttatgttgtattcataacataataatataacaatatattaattgttaatatatattgttaataatataataatataacataaaataagtgatacttattttccatttacagttgagatattttctttaaaagtaacgttaaatattgattcaattcaaagaatacattcattaatcatacagatggcgtctggctaggtgacgcatcatgacagtggtagggagtgactgaagttgagctggtgcacagactgccagttttacaacccgggaagtgttccctgaccatccgcttccccatgctgcccgccccgtcacatgagcccttaccccctggcgctatcccatctgctccaagacaccgatgttctagtgggtggaagcctccacttttagttgactacggtatctctagcatttcacacatagtaggtgctcaatgaatgtttgtcgaatgaatgaatgaaagaagggaggctgagagtagctgggacatttgctctgaaaaaatcacctccattctcccaatattacaaaagcattttcattaagtccacaatgaaaaatgctcactgtaccaataaataatatctttagttatctatttttaaaagtaaaaaaaaacctcgtgccgaagtc

SEQ ID NO: 33 - DNA, 445 bp, Homo sapiens
  misc_feature (1)...(445): n = A,T,C or G
tgagacagagccgtgctctgttgcccagactggagtgcagtggcanagtcntcggctcactgcaacctctgcctcccatgcagactcagacacccaccagagaccagagactcgaaggcctgtccatggtcacacagcagcaggaggcagggcgngtatctggacccacacctgcaggctccggaatctaggactgcacaaggtccaaggacacantcaggtttacagacgcagccacacagaggatgggcgcaggggcagggcgggntgaagagcgagaggggtgaggggaaggagggcataaaaggagaccactgaaagcagaagccaagcgagttcccgaacatgcgcgntcccagcagcaccgttcccggcagccaccagcccagacgcccntccacagaggcgcggaaaaacagcattgcagttcacccgnaccgttgga

SEQ ID NO: 34 - DNA, 8666 bp, Homo sapiens
ggggtggcccgtgagctgatgacgaggactggcttttaatccttggtggtgattaagagaaagcttattggggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatggaagcagaagttctgccagcgctatgaccagctcatggaggccttggaaaaaaaggtggagcgcatcgaaaacaacccgcgccggcgggccaaggagagcaaggtgcgcgagtactacgaaaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccaggcccacccaccccaccacggaggacatcccgggcccccattgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccactgccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccatgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacacggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcaagcccacggtcctgaggtccacctccacctcctcacccgttcgcccagctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggcgggcggtgtcaggtcccagcgagccacaggaacggccctgcaggagcggggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacacaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctcgtcacgccccgctgtgtcctccctccctcccttccttgggcagaatgaattcgatgcgtattctgtggccgccatttgcgcagggtggtggtattctgtcatttacacacgtcgttctaattaaaaagcgaattatactccaaaaaaaaaaaaaaaaaaa

SEQ ID NO: 35 - DNA, 556 bp, Homo sapiens
  misc_feature (1)...(556): n = A,T,C or G
tactagagacggattttaccatgttggccaggctggtctcgaacttctgacctcaggtgatccacccaccttggcctccgaaagtgctgggattacaggcatgagcatcatnccnagcccgttgtaactaattattcttctctttgtcttagacagggatgtatttggccttaaatggcacacagtctgcaatgcttgagggatgtcccctaagaggactaaagaactgacaaaggagaagaaggaaataatgggacaggaggaagcaacagtgagaagaggaggggagtgggcaggaggaaataaggacaggaagaaaaagaggccaatgtaggggagagaggggcagctggtccctggagccgtctatgtccctggtttgcagagaacattncccagggagtcgtgttccngttgctcattaattccctggtcaactggcccttgtcggctcctgcctggagcagttgagtgtccnctactgggagcagctgaacttnaaggtttgcaccgntgttgtttccgagctccctttcccgggcttccgntttcctaa

SEQ ID NO: 36 - DNA, 2701 bp, Homo sapiens
gcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggcggcattgcctatattcagcagaacgtcagctttgtcactggttatgcgatccccactgtctgcggcggtcttgcttttgtggtcttcctctgtggcaagagcgttttcatcaccaagcctcctgagggcagtgctttcacagacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattactttttacttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatccaaaaaaaaaaaaaaaaaaaaaaaagccgc

SEQ ID NO: 37 - DNA, 2927 bp, Homo sapiens
gcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggcggcattgcctatattcagcagaacgtcagctttgtcactggttatgcgatccccactgtctgcggcggtcttgcttttgtggtcttcctctgtggcaagagcgttttcatcaccaagcctcctgagggcagtgctttcacagacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggagacaagcaggcctctcttctcatcccaggggccaagcctgccctggccacagcccagcgagcagctgctgcagccaccgctccttacggggacgtccttgacagacaagcaccttctccacgcccgtccagctcagtcttcgtgaggcagctgaatctgtaccccaagcttccctttctttaacttggtggtgtactttcgttttcttttcctaacagcaccttttctgatacgaaaaagacaagatagattggtaatattaacggctgctatttgaactattactttttacttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatcc

SEQ ID NO: 38 - DNA, 667 bp, Homo sapiens
tcagcttgttccagcctcctgcctgcccctctgtggctgacagtcgactcccctggagtcactgccctgagtctcaagggtacttctctgcaagctccaggccaccaatgccaccagaaatctctgaagtcgctccagtggcttaaccgcatcacaaagtcaccagactggataaagttattccgctgacctaaagcctgtcagatgtgctggccccttccccgacaggkkgcaccggggcaagctggccaaggctccttcaccagccacccccgaagtcactgctgacccacctaccgcatctcaacacggggccgggcaagctcgcaccacggggctcctgccttagggctgcacccctgcctcagagcttcccgttcctctcgcaacaccagctgaacgcctctamttccacagaacctccctcccgcggggggagcccactgctgctccacgaggttcctggctaagggcctgctctggccttwrcttctgtctgctttttaattacactgactttgtatttttacgtgcctgtctgtcctgtgacatcaaagtcttgctccaagaacataacaaagtaactgaaatcgagtgagtgaagtattgcctggtagagattctcaaggaatctgctttgacaaattaataaatgaatttcactggt

SEQ ID NO: 39 - DNA, 1347 bp, Homo sapiens
gcttggtacgaggggaacttgcctgtcaagacagttctttttgtaaacctaagaacctgagagcagggagattccagctgctaggagttaaataattcctttggcacttagcgtcctatcaaaacagagaagcaaaagaaaacaatgagagcaacaccaccacctcaaacaggtgccctgtgctgggccgtgtcctgagagtgcataggagagacatcgagacatccacaagataatgcccatttcacttgatcttcttcatgtctgggggaaaccaagacacaggaaggttaatgaatgacctgcctgagggtctcagatagtcatgagcagaatcccattcaagcctcaggagtttggctccggagtccaggccttccacggctgctgcacagcacagcttcctgtcagctcagaactctgacctccctgcaggtgctgggtgggggcagaggggacagcgaccctggtcctgcctgtagagcgtactggaggctgaatcataagtcagtgttggcagctccagactgaggaagcgccggccgggccatcttcacccgctggtattccctgggtgcgcarcagtagcagagggcaggaatgcaggaagtcgctttaccccaggctcttgagaaatacagtcatatttaacccctgaaaccactgcctgaggttctctgtcmcctcattttgctgattagggcaatcggggcacagagacaatgagccacttacccgaggacacacagctcccaagtgccagggcatggccccaagggcaggaagtcagcctggtaacaccctctcaggtgctttgagaaaagtctaggggctggtgtgcttgtcaccatgtggctgggctaagagatgaggatctgggcttcctggtcaggggaacgtcatgaggagcctgtgccagtgctgtgtgcttggcgtgtgcgtgtcggcagctctgtggtggttcttcagggcaccctgatgggagtccctcgccttctctccacagcgccttgggtgtctcctcctggagcgaggcattgaacctcaggtgatgtcagccctggttcgtctcggcctcagaggagcccggctatttttcctgaacagccccccttcctccctgggagactttcggggtggccagcgtgcttgcttcccaggcaggctgaggtctacctccccgcaggcgtctggcctcaggcctgcagtggatgattgtgggctgtgtggcctttgcctttaggggtcgtcccttcctccataaaataatcctaacagttgtgttttgcgtctattgtggaataaagatgagtattacacagaaaaaaaaaaaaaaaaaaaagtctg

SEQ ID NO: 40 - DNA, 758 bp, Homo sapiens
ttttttggaacgtggatattcagttgttgcagcaccatttgttgcaacaaatggttctgtttgttcattgtactgcctttctcctttgtcaaagattggttgactgtatttttattggtctatctctgggctgtttattctgtcccacagatcattcatctgtttttttccaatgccacactgtcttgactactgtaactttttatagtaagtcttgaaattgggtagtgttgttcctccaatgttgtttttctccttcaatattgtattggctattctggctctcttccttctccatagtttatcaatatccacaaaataacttgatgagatttttattgggattgtgttgaatatatagatcaatttgggaagaactgacatcttcacaacattgagtctttctgtccatgaatatggaatatctctccatttatttagttcttgtttaatttctttcatcagagttatatagttttctttatatatagcttataaatgtattgttataatatatgtatttctttttccttttttggcaccaatgacaatggtaatgtgttttttaattgtaaattctacttgttcgttgctggcagatggggagcaattgacttgtatattaaccttgtagcctgtaatcttgctatgctcactcattagtttcagctttgttgttgattcttttggattttctacatagacaatcacatcatctgtgaataaatatagttttattgcaaaaaaaaaaaaaaaaa

SEQ ID NO: 41 - DNA, 2883 bp, Homo sapiens
cagccgatggggtgcgactgcttcgtccaggaggtgttctgctcagatgaggagcttgccaccgtcccgctggacatcccgccatatacgaaaaacatcatctttgtggagacctcgttcaccacattggaaaccagagcttttggcagtaaccccaacttgaccaaggtggtcttcctcgacactcagctctgccagtttaggccggatgcctttggggggctgcccaggctggaggacctggaggtcacaggcagtagcttcttgaacctcagcaccaacatcttctccaacctgacctcgctgggcaagctcaccctcaacttcaacatgctggaggctctgcccgagggtcttttccagcacctggctgccctggagtccctccacctgcaggggaaccagctccaggccctgcccaggaggctcttccagcctctgacccatctgaagacactcaacctggcccagaacctcctggcccagctcccggaggagctgttccacccactcaccagcctgcagaccctgaagctgagcaacaacgcgctctctggtctcccccagggtgtgtttggcaaactgggcagcctgcaggagctcttcctggacagcaacaacatctcggagctgccccctcaggtgttctcccagctcttctgcctagagaggctgtggctgcaacgcaacgccatcacgcacctgccgctctccatctttgcctccctgggtaatctgaccttcctgagcttgcagtggaacatgcttcgggtcctgcctgccggcctctttgcccacaccccatgcctggttggcctgtctctgacccataaccagctggagactgtcactgagggcacctttgcccacctgtccaacctgcgttccctcatgctctcatacaatgccattacccacctcccagctggcatcttcagagacctggaggagttggtcaaactctacctgggcagcaacaaccttacggcgctgcacccagccctcttccagaacctgtccaagctggagctgctcagcctctccaagaaccagctgaccacacttccggaggcatcttcgacaccaactacaacctgttcaacctggccctgcacggtaacccctggcagtgcgactgcacctggcctacctcttcaactggctgcagcagtacaccgatcggctcctgaacatccagacctactgcgctgccctgcctacctcaaaggccaggtggtgcacgccttgaatgagaagcagctggtgtccgtcacccgggaccacttgggcttccaggtcacgtggccggacgaaagcaaggcagggggcagctgggatctggctgtgcaggaaagggcagcccggagccagtgcacctacagcaaccccgagggcaccgtggtgctcgcctgtgaccaggcccagtgtcgctggctgaacgtccagctctctcctcggcagggctccctgggactgcagtacaatgctagtcaggagtgggacctgaggcgagctgcggttctctgcggctcaccatgtctatcgaggctcgggcagcagggccctagtagcagccatacaggagctggggaagggggcctctggggctgaccaggcgacaggtaggggcgaggggagctgagtctccgaagccttgcttttcacatgcaagggacagggttacatccccaaggtgagggggtggagtctggtctgctccactaaccagggtctcctcctcctcttccttcatcgcttctcctggagtgtgcgcctaataaggccatccttatgccttgcaaagcaccctcaaaagctgcaccacagcctggagaataaaatatcctcagccctgatgcctccccattatgtaacacccaaccgctctcacykacaccctgaggtctattcactgcatcccagtgatachaagtggaggccactgccttctgacatctggctcaaaagcccagtgtctgtttccatttatttccctggaatttcatttaaaattggtatagagaaaaaaaggatgtgacagaagcagagatgaccagaaagcacaggggcagggttctgactggcgtgtgggagaccctgtggccggcacccacctccacacgaggactaagctctgatttttttatcttgcccaaattcctacctaaggggtctagggagtcgcgccttacaaatcataaattctcatcagatgggttttatttgaccctgtatatcatgacttatttttaatctgactatggcataacattacaagacgaggcaaaaatatttaacccccaaatatatttctttgccctaccttgaacttgccctgcagagtctcttgtgaggagaatccacatcctataaagaagcccctttcccctttgttttccttcctttctttccagtccaggagatcatcaactaagagccaggcaccccttttaagtcgrataagaaacagtttacaacctgctctctctctctctgaagtctgctgagagcttcccctgcacaataaaacttggcctccacaatcctttatccttaaccctgaacattccctttccattgatcccaggtcttcagctaagctcaaccaattgtcaaccagaaaatgtttaaatttacctacagcctggaagcactcacccccgctgcttcgagttgtcctgcctttctgaactcaaccaatgtatttcttaaatgtatttgattgatgcctcattcctccctaaaatgtataaaaccaagctgtacctcgaccaccttgggcacatgttcccaggccctcctgaggtctgtgtcaacggccatggccactcatatttggctcagaataaatctcttcaaatatthhaaaaaaaaaaaamaaaa

SEQ ID NO: 42 - DNA, 2176 bp, Homo sapiens
ctgatgtgaaaatccctgcgttcatcaacataacccagttagggtcgcactcatcacggggcccccattgcctctggcgcaccccacgactgacatctgcggggccttcgcgctaggcttcgagtttcagcttccgcaccaggcctgcctttctgcaggggccagggtgggggtcgtgtgctgattgggccctctgaaccgccaccgctgcagaggggctgttccttccgtcacatcccttgtgcccgaatccaccctgtgtcttctcttttctcagcaggacattttaaaagcccagaccccctccttacagagcaaatgtccaggcttcggaggtcactgtcacatcccaagaacccccttcaccaggtgccactcttgagactggactgaagccccctggagaggtgagcttggtgggctctgtaggtttagggaactttgaggttcactgcccttaggagggaagccctctccggttctccgcagtccccaccgttccctatcgtcacccctgggcacctgcactcccacggttctgcctgggccttgggggcatttgagccctgggcccatcctgagttggtttggaggctgggctgtgtggagctgtggaaggccctgggcatgcggccagctcactgctgggagcctggttttctcactgtccagctgtgtggctcgggggcccccgtctctatgtctcagtgatgacaacactggccgtgtgggtcctggtgggccttgagtgggttcctctgctcagacatgaggtgcttagacctcgccctagctctgccctgtgaccttggcaggtcacccggggtcactttcccatcggagtgggggtggggactggaaccagccactcccaggtccctcctctgaggttgctcttggcactggtcctggggacagggctgcaggggactctggcctctctctcccctctcagttccacttgcctttgtcctgctgcctgagatgagggcatggacagccgggtacaagacgggacaggcaacctcgcagtggtggtaaccctgtgcatgaaccctgggcctggcacgtggacctcctgtgaccgtccccacaggcccgtgaggctgagcttggcactgcccaagaccacacagtccatgcgcagtggagctggggtccaggctgcccaccagggcagtgactgcaatggtggcagcaggggacagtcaccatggtgagctcaagccaggcgctgcactgaccttgagggagggctccatgcttccccttcccacagctgcagtgagggctaggagagcagggtcggctgcaggcttgagtcctggggtgcctctgggctgacgggccctgcctgacctgctcctccagtgccccagccctgccccacccacgtcccctcctctcactgccccctggcccactccgctgcggtctcagtgccttcccaggctgggcatcatctgatgggaggaaaatgagggccccagactctgtgtcatcctggcaggacccctcccctcccatggctttgagcccatgagatggccttggacaaagcggcaatgggcccttcctgagacacagtgcggccatctactgggaaactgcccagtgtgactctgatgactgtgatgtgaatcccacagcaaagttgagcagtgcgcaacctgggctactgcacctggcagccctggctcctcctcctctgcctcttcctgctccttcattctcccccagagctctaattgtcactgagattttatgtttcgtttaacaaatgactgtctccccgcttgaacagaacctccatggggggagggaagagtgtctgttgtataaatagttgtatttcagtgcataaaacagtgcctgcctcaaagggaggactcagtcaatatctgttgaatgaatgaatgattgcctgggtcaacgaatgaatggctgaatgaatgatttctcctttccctcggcactgtctggagtccccaggacaggcatgggcagcagtcgctggtctgtggcctgtcccactggacttggggttctcatgcttggtctgggcggagatcacccaccaggctcccaggtcgatcctctgctcatgggaagctgcgtccggcccagctgccaggagctcactgcagggtggagggaagagcagggacgatctgcg

SEQ ID NO: 43 - DNA, 2543 bp, Homo sapiens
cgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcactttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggaggktttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctggaaaaaaaaaaaaaaaaaaaaaaaaaa

SEQ ID NO: 44 - DNA, 1118 bp, Homo sapiens
cgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatct

SEQ ID NO: 45 - DNA, 2189 bp, Homo sapiens
  misc_feature (1)...(2189): n = A,T,C or G
ccctgtcccctgaaggccatgtccagcctgcaattttggaggcaatggatttagaagtncccggtattggcccccngaacatcccccgggaangcctgcccgtggtgaagcatgaaagtccacagggcctactgttttcccaatccctcaggagtttgttcatctggcaaagagactggttagtgatcctgcattagaaaaggaaatcgtagtgaacggaagggaatacgtgagaatgtatcattcatggcaggtggaaagagacacctaccaacagctcatcaggaagctggaaggaagcactgaagattgagggccccgcctcatcagacacctgctctctgacacacagctctgggtgcacactcagagacagagttctggatcacgtgggcccagtgcagttcaaataaaaccagcctcagcggaatcctagaaaatgttagtcgtgagtccccagagccactgcattcatcccatatccttctgtgcgttcagatgctgtcccaggcgtgttcaccagccagtcctgatggaggtgcatgagtgactgggttgactgggacagggaaaggggaactggttttcagggaatttgggagagaatttgattacctgccttagggctttggtgtggacaattagaggcttattttcaagcagtcatggttcagactcctcccgcctgccttctgaccaacctctccccatcgttgccagttttgaaaggccaaaagcaaaacagacgtrtcagctgagccgagtcctcgcaggatttttgttgtgatctcaggactctgacaggcacgtgggtgacccgaggcttctctgaacactagaaagcgctgtgagtgagctcacgcccggcacagctcacttttcaatggtggaattgaaagttgtgctttttagaaaagtggccaggctgcccgcaggccccgcccacctcttggctgaatttgagtggaaaaccaggaaggaacaagcgccacgtcacgcatagcctgcaaatcgcccgcgtgaccctgagatggaggcctgaggctttgggtccagggtgggctcttccccttcccacatcagggacccggggatggatgtcggaagggtcaccagcctccagcctttggcaggatggagcttgggtctgcagggctttgcagccacacagcgaggtcagtccggggccagccgcgccatcatggtaatggtggcctcgccccatccatgtcatccatgtcacatgaggacgtgcagtcttccttgtcctctcctagtggaatttgcctgggagaacctccactgaatactgaaattgttgcatgcctgtggattccttacgacaatggggaacgcggtgtttcccacctcttgtgggtagaaagcagtctgctttgaggaggcgagaaggcaaagccagggcagggcgttgctgtgggaagcgttcggtgaaagcgggtttcgacgcttaggagggccgagggagaagattccaccagcattgtccttgcttcaagttttaggatgtctgaactttcagctttcatgttttcaaccatcatttttttaatggcacaacctacatcttgtttttaaaagaagtagcctcaaattaaactccttaaactctgatgccctggggatgagaacaactagcttggatctcgtgccgtgtaattcaatgtttcattccgctgcctccatcatgtaatagaatcgctttccagaaaggcagttaactggaagcagcagaggctcccagccgtgagaggactgctcaacaatgccccccatcgccgcccccccacccctcgcaccccttgtgttttccctctgaggggcccaagggttatggctttcatgtctaggtgtggggacagaggagggagaggcagatcctgggccgggagaggatggcctggtctgaatctggagtaattaatgccacccaaagaaaaggccctgccaggtccaatgttgtcttagatctgatgatgctgctatttacaaaacactgatcgtccgaaagcttgaatctgttcctcctcgaatgaccctgtagatgcctgacctccaccgtacctccacatcactattcatgtccttctaggaaaatgtgcacatgcctcacgcactatgtgggaagggcgtgtttttaaattaataaagtgtgtcaccattagccatac

SEQ ID NO: 46 - DNA, 1172 bp, Homo sapiens
gcacgagccccatcaccacttctattcaatactgtactggaggtcagctaaataaatcagttaaaactaacaagcataagagctgcaaggaaaaaacggtcactatttattcacaattacatgattgggtacagagacaatccaacataagctacagagaatatcagaattaataactgattaggcaaggggtacaaggccaatatgcaaaaatcattgtatttctatataccaacaacaaacagagaaaatgacatttaaagtagatacggctgggcacggtggctcatgcctgaaatcccagcactttgggaggccgaggcaggtggatcacaaaagtcaagagttcaagaccagcctggccaatatggtgaaatcccatgtctactaaaaatacaaaaattagctgggcgtggtggtgggcacctgtagtctcagctactcaggaggccaaggcaggagaatcgcttgaaccsgggaggcggaagttgcagtgagccgagactgtgccactgcactccagcctgtgtgacagagtgagactccgtctcaaaataaaaaaaaaaatagataaataaaaaataaagtacatacgacttgcattaacatcaaaacattgactacctaggaataaatacaacgaaagatgtgcgcgacccttcctcggaacccacagcacggcacagaccggcattaaaggcagcctgtgtcstggaggtaggggccattttcaagggattcaaagactcaacgttgttaacatagtaacyccccccaccatgatgtgtggactcctatttgtaatctctggcttgctcagatccatgtcccctgtaaagctttcaatatttatcattccagagcaatgaaactctcttctctatagctcccacgcccctaacgctgagttaatttaaaatcatgtcttttctcccaatgaggagatgcaaataccacggggaagcaaattgagacaaaaatccaggttctccagctgcttccactgagctcctttcactctcctgtgtgcctcagattcaaaaggaagcaaatgtgaggcagggagaatttggataaacaggtaaagaaagaaaaccgtttcttccgtgccatcccccacaaattccaatgtcacaaaagcaataaaacaaactagaaaaaaaaaaaaaaaa

SEQ ID NO: 47 - DNA, 740 bp, Homo sapiens
  misc_feature (1)...(740): n = A,T,C or G
tcttcaagcccgggggtgcccttatgagggtctcccccatcttccgcnttcttccccaacgccaggaagtcatccngatgcacttcacggcggttccaagtaagttcactgggatagatgacggagggagggaaatgagagcccaggcaggctgagaccccccaagccacaggcaaacgttcaantcccgcgtggaanccatcaaccccaggggcccttcaacggtgcgtcccgtctgccccatccccctgctccccactgaaggggctctctcggttcaccagccctcacactagncagggcccatctgagatagttttgactccgggggacagcagaaggtgagtgggtcacatagtgtcccgccaaattcacgtccatccggaaccttagaatatgacctggtttggaaatagggttggctgggtgtggtggctcacacttgtaaccccagcactttgggaggccagggtgkgcagattgctagagcctgggaattctagacgagtctgggaattctagaccagcctgggcaacatggtgaaacactgtctctactgaaaatacagaaattagctgggtgtggtagcatgcacctgtagtcccagctactcaggaggctgaggttgggaggatcacctgagcctgggagttccaggctactgtgaaccgagattgcaccactgtactccagcctgggcgacaaagtgagaccctgtctcaaaaacaaaaacaaaaac

SEQ ID NO: 48 - DNA, 541 bp, Homo sapiens
ctggtctcgaactcctgacttcaggtgatccacccgccttggtgtcccaaagtgccaagattgcagatgtgagccactgcacccggcctgcctaatcccatcttaactcatcttaactaacacatctgcaaagaccctctttccaagtaaggtcacgtcctgaggcacgaggtggatgtgagtttggaggacgtcattcaatccaatgtggcagccactcccacagtcacgggcgggaccctgtttccttgccgaggtaaagggtgttctgcgtgtctgtcaggggaaccacttcctgtaactccawyscctgcccggccctcagcatttkactccgtcacccccatcacctgggagscctccggtgactgttcccggaggcctgatccctcctgaagggacagaggctgcagctacctgggaggctgaggcaggaggaccacctgagccagaaggtcaaggctgcactgcaccatgawcgtgcactgcactccagcctgggcgacagagcaagaccttgtctaaaaaaaaaaaaaaaaaa

SEQ ID NO: 49 - DNA, 4927 bp, Homo sapiens
  misc_feature (1)...(4927): n = A,T,C or G
gagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccnttccagtccatcaacaagcgcctggcgtcgccagtggnctcctggggccttgactacgccgggagkctctgctcccgsccaaggtggtgcacacccagcccccgscaacgggcaagtcggsgtcccccagscacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttgccgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggacccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagcmggcccttaagaacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtgggcstcacgcaggcgacggcgsgccsgggcagcaggtgcaagatgatccctgcagtgaccgcgactgcccaaggtgggttcagcaggaaactcattcagcagcaggtggtgaccacggcgtcggccccggctccagacttccaggcgcttcccaacccagcccaggtgcccgccagctccgacagcccaagccagcagcccaagttacagatgagggtccctgctgtcaggctaaagacacctactaagcctccgtgccaagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcagcccacagaagccgtctgccgtgtgtgaggagcatacaatggactttctaaagataaggcgtggggcttccacagtgtctgccagagtttagttctttataccttactgaaaaaatgcctcgtggtcttcgcagagggggaaggcctgtctaaagtcaatcatccgagatgggttttccattccaaagaaaggcaatatggttccttccttccctcctaaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaaawgaaaaaaaawrwaammttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagtttgccggagggrgggccgctgtgtgcgctcacatctggctccagtggaacttttctcctcctcatccgcagatgtgatagaactgaagtatctaggaattctgcctttgtcatttgtttaattgtgtnctgtcatttttttgnttccaaatcttggtagtctccttatagttgaagataaaatgttgagtbcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgrgggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttatataaaaaaaaaaaaaaaaaaaaaaaaaaaaaaaaa

SEQ ID NO: 50 - DNA, 1654 bp, Homo sapiens
agcaaacaagacaaagaagacaggctggctgcagtgctcaggcctgtaaccccagcactttgggaggccagtgtgggtggattgtttgagccaagcagttcaagaccagtctgagcaacagagtgaggccccgtctctgcaaaaaaaataagaaaagaagagggaggggtgagaagatctcacattcaactgagttccagaagagaatgaaaaaagaaaatattcaaagagtggatggctagagaattttccagaatgggtttaatttaccagtctaaagactgaagaaatacaacaagtccctagcaggatacagacaaagatacctgtgcctgacacatctgggcaaactgtggcactcaaagcagatgagaaaaccatgaaagaatccaggaggaaaacagatttctcacgaaggaaaggcgattccatggacagctcccttcttagtaggaactgtggaaaccagaagtagctttaaagtgctgggataaaactgtctttcaaggataagagtgaaaacaaagacatactcagacaaaaactgaaaacatttaccacaaacaaactcaccttaagcaggcaaatggccctcgatgtggaaagcaaagctcaggggacagagggtgtactgaagagttggcggtgatgatccctggagggtccccccagggccaagaagggggctgggagccatgcatggtgagactggagtgtgagcttgaggacagcaagaatcagacgaccaccccaggctgccagggtgtggctcagcctatctgcccctcacgctgagctgcacagatgcaaacaccttccaaacacagtcacgaggccttaggaacgtctccagagcttccgtcatcatccgggtctcctcgtcagctcctgcctggtgagggctctgccagaggacagccctgagtgccgccatcaaggctgaggaggccgcccccacgtgccacccacgaagctgcctgcaggccgggaggcttctcttttggcttcagccacatgtgaaggagaacctgtcaagctccggctgatgaagtcttcagaagggctcagagtcaagcggcagaactcctggtgccatctgcttaattacaggcgcgggttttcctcggtgttttgatctataaatacgaaaaataagaacagcaccggtgctgaatctatgtcatcccatgaatggatgaactggttgaaaaaaaaatagcctgatactgggagccaaaaaggccgaagggatcgtgaccaactcagcattccactggaggctatatgatcaatcagcaaactgtttatcctgaatgtaggatgtgagttaaaactcacagctgcgcctgctgccagaaggtttgctgagggcggtcactccctggcactggggtccttgaagttatctactgggaaatctagcgcctgttgttcgaaggatgcagtctcgcaagcctgctgtgaaccaaacggcggactgccgattacccgacaatcactgcactttgtcgcgatctcttttaccaataaatacggagggctgtgtaaagctctatctcttttaccaataaatatggagggctgtgtaaagctcagggcccttgtccactagaggcaaggtgccccctgaccccttctttcaaatataaaaaaa

SEQ ID NO: 51 - DNA, 5256 bp, Homo sapiens
ggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgagaagcacgatttggaggtcgccgtcaagtgcattaacaagaagaacctcgccaagtctcagacgctgctggggaaggaaatcaaaatcctgaaggaactgaaacatgaaaacatcgtggccctgtacgacttccaggaaatggctaattctgtctacctggttatggagtactgcaacggtggggacctggccgactacctgcacgccatgcgcacgctgagcgaggacaccatcaggctcttcctgcagcagatcgcgggcgccatgcggcttctgcacagcaaaggcatcatccaccgcgacctgaaaccgcagaacatcctgctgtccaaccccgccggccgccgcgccaaccccaacagcatccgcgtcaagatcgctgacttcggcttcgcgcggtacctccagagcaacatgatggcggccacactctgcggctcccccatgtacatggcccccgaggtcatcatgtcccagcactacgacgggaaggcggacctgtggagcatcggcaccatcgtctaccagtgcctgacggggaaggcgcccttccaggccagcagcccccaggacctgcgcctgttctacgagaagaacaagacgttggtccccaccatcccccgggagacctcggccccgctgcggcagctgctcctggccctactgcaacgcaaccacaaggaccgcatggacttcgatgagttttttcatcaccctttcctcgatgccagcccctcggtcaggaaatccccacccgtgcctgtgccctcgtacccaagctcggggtccggcagcagctccagcagcagctccacctcccacctggcctccccgccgtccctgggcgagatgcagcagctgcagaagaccctggcctccccggctgacaccgctggcttcctgcacagctcccgggactctggtggcagcaaggactcttcctgtgacacagacgacttcgtcatggtccccgcgcagtttccaggtgacctggtggctgaggcgcccagtgccaaacccccgccagacagcctgatgtgcagtgggagctcactggtggcctctgcgggcttggagagccacggccggaccccatctccatccccaccctgcagcagctcccccagtccctcaggccgggctggcccgttctccagcagcaggtgcggcgcctctgtccccatcccagtccccacgcaggtgcagaactaccagcgcattgagcgaaacctgcagtcacccacccagttccaaacacctcggtcctctgccatccgcaggtcaggcagcaccagccccctgggctttgcaagggccagcccctcgccccctgcccacgctgagcatggaggcgtcctggccaggaagatgtctctgggtggaggccggccctacacgccatctcctcaagttggaaccatccctgagcggccaggctggagcgggacgccctccccacagggagctgagatgcggggtggcaggtcccctcgtccaggctcctctgcacccgagcactctccccgcacttccgggctgggctgccgcctgcacagcgcccccaacctgtctgacttgcacgtcgtccgccccaagctgcccaaaccccccacggaccccctgggagctgtgttcagcccaccacaggccagccctccccagccgtcccacggcctgcagtcctgccggaacctgcggggctcacccaagctgcccgacttcctgcagcgaaaccccctgccccccatcctgggctcccccaccaaggctgtgccctcctttgacttcccgaagacccccagctcccagaacctgctggccctcctagcccggcagggcgtggtgatgacgccccctcgaaaccggacgctgcccgacctctcggaggtgggacccttccatggtcagccgttgggccctggcctgcggccaggcgaggaccccaagggcccctttggccggtctttcagcaccagccgcctcactgacctgctccttaaggcggcgtttgggacacaagccccggacccgggcagcacggagagcctgcaggagaagcccatggagatcgcaccctcagctggctttggagggagcctgcacccaggagcccgtgctgggggcaccagcagcccctccccggtggtcttcaccgtgggctctcccccgagcgggagcacgcccccccagggcccccgcaccaggatgttctcagcgggccccactggctctgccagctcttctgcccgccacctggtgcctgggccctgcagcgaggccccagcccctgagctccctgctccaggacacggctgcagctttgccgaccccattgctgcgaacctggagggggctgtgaccttcgaggcccccgacctccctgaggagaccctcatggagcaagagcacacggagatcctgcgtggcctgcgcttcacgctgctgttcgtgcagcacgtcctggagatcgcagccctgaagggcagcgccagtgaggcggcggggggccctgagtaccagctgcaggagagtgtggtggccgaccagatcagcctgctgagccgagaatggggcttcgcggaacagctggtgctgtacctgaaggtggccgagctactgtcctccggcctgcaaagtgccatcgaccagatccgggccggcaagctctgcctgtcgtccactgtgaagcaggtggtgcgcaggctgaatgagctgtacaaggccagcgtggtgtcctgccagggcctgagcctgcggctgcagcgcttcttcctggacaagcagcggctcctggaccgcattcacagcatcactgccgagaggctcatcttcagccacgctgtgcagatggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggcaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcgtctgcagagaggcctgccttccggattccaggcgggcatgccctgcaaaccccgcctgggcctcccttggtctgcccagccctcggttagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgttcgcttgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttkaaaaaaaaaaaaaaaaaaaaaaaaaaaaaaaaaaaaaaaaaaaaa

SEQ ID NO: 52 - DNA, 1406 bp, Homo sapiens
ctggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctgaaaaaaaaaaaaaaaaaaaaaaaaaaaaaaaa

SEQ ID NO: 53 - DNA, 1620 bp, Homo sapiens
ggcacgagggtcgcgaatggggcaggagcgagcctctctggtcccgacgcgggtggcccgggtctcctcgactcctgaggaaagcccaccgggcggggcgggagctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaaaaaaaaaaaaaaaaaaaaaaaaaaa

SEQ ID NO: 54 - DNA, 1910 bp, Homo sapiens
tcctatcgaggacatccctgacgtccatcctgacttgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaagcagtgggaagacactggccttcgtcatccctgtggtgcaggccctgctttcgagagtggtctgccacatccgtgccctggttgtgctgcccaccaaggagctggcccggcaggtgagcaaagttttcaacatctacacagatgccacacctctgagagtctccctggttacgggacagaagtctctggtcaaggagcaggagagcctcgtccagaaaacagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcccaagcagagggcggcctaggctggggctcaaagggccggagggaatgaaggctcaccacccttgaccctccttccagagcaggtgctgatcactggatcctgtatgtgaaggaaaggaatccccccagtggacacagccttcctccccaaagcacgtggtctctgcgccaggcagcccgggcgtcagagctcaagcacctgccccgattggagacttcagggcttgtcactttcagagtgtggaggtcaggatggctgcgggcaataaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagccag

SEQ ID NO: 55 - DNA, 1558 bp, Homo sapiens
acctgataacacttattagacacattgaggcacgatggaaccccaagtttctcttcaaagaatcagtatgtcagtctgttcagcttcctgttctttgattctccattttaaagtttaacttcctggttctcttcacccccttgcctctagtttcagtaaacaactttcccgccagtcctaatcactagttcacatctgttcccctggtcacctgctccatcctgactcatctcggtcacctgctttgaccggagtcacctttagttacctcttcctaaccgtccttcccaccaaactgctcaccccgccactctggctcgtactcctgctctttttaaaatagccagtcggaattagcttagactgtgtggtccaaccctagccaataagggaacgacacagcagtagggactacctgcctcagggataagacctcctgtccctcccgtgtccaggtatgctcttgccatggctccacctgcgagggtcaccctttatgcaaaaagtcaaaactgccttgctgagaacattaaatggatgctcgagtgctatttctctgtggcactggggaacaagcattttgcatttctaacagtccaggcaccaaccttttaaaaaaaaatagaaaaaagatagataaaatagtcaattaaaaatataaatgcatatttatccactatactttaaaaatagctttatttaagggaataaggttaccctaccataaaattcactccactttaagtggtacttttccattgaatcctagtaagtattcacccacctggttgcagaacagccttttaagggggttttcctcacttctagggggccccttgcatccttttgccatttttttcccggcytmaggccccagcccccaggcaagcgttgattctgctgtcacgtaatttgccttttctagaattccttataatggaattaggagcagtgtcctcttttgtgtctggcttctttcacttaacttttttttaaagattcattcgtctttttgcatgtatcaccagttcattcctttttattgctgaatgatattccaaatatattccgtgtagggatagatcgtaatttttttatccattcacctgtcagtggacattcgggttgtttccagtttttggactcctcacatataagccctaggaggaacacgcaccttacaagactttgtgtggacacatgctggccttctcctaggtaagtaccctaggagtggaacggctggattgtatggcaggtgtttacctttttaagaaattgccaaactgtttcccaaagtgtgtggaccattttatattccccctagtagtatatgaataggttccagtttctccacatccttagcagccagcacttggtatgatcggtctttagccatcttaggaaggcctgtaggagcatctcactgtggttttaattgcattcccctaatcactaatgaagttgagcatcttttcatgtgcttattttctatccatttttctttgacagtgtttgttgacatcttttgcctggtgwttttcgaatgttctcagag

SEQ ID NO: 56 - DNA, 867 bp, Homo sapiens
cacaattcggcacgagaccgtctgtggaggagaatctgaactgaggaggaagccctgcccagcagcctgggggctcccagggatgtctgctgcatggagactgcagaaacctgtggtggggcagagagttccagtttggccgtktgttgaytgccctcatgcagaytctaccagcggccaaagcggtgtctggagacgacagtgtgtgtgcctagggcacacaggcacggagacaccgccagccctttgtgttgtgatcagggctggcgggaggctctgactagggctgtgggaaggggacgtgtgcactgtcctctttctgagcgttgctgtggtgggagtcctgtcacggggagcagtcatggaagaggaccggcccctcctcccaggtacaagcacaggctcctgtgcactccgactcgctgttcccctcatctggcctccccagagcccaggcactgcctgctaaccccagaccttctgtggtccacttaggactcttgcccaccattggtcctgccggccggcccgcccaggctgggctttctcagggggactccagctgcccttctgccccatgaggagacactagctcccttggcctcattcccttactggcaactgagggtctggttcttagagtcccttatgtgtaaacatgtaaagcttgtggctgtgaggtgtgtttggtaagaacagtccacagctttcaccagattctcaggagtgtcagtggccccttcccggtcaataagttgaagagccggggtcagtctggctgccactgagggccaggctgcctccttgtgtgcttgggtggcctgactgcaaggaaaaaaaaaaaaaaaaaaagatctttaagtaagc

SEQ ID NO: 57 - DNA, 1739 bp, Homo sapiens
taatgataacgtatttggagtttatttagaagtaaagtgtgatgacgataacacttaagtgtgaatttttaaatatagttgagtagactgcatcatctgagttagaagcctattccttcagggctcggggtagcttgaatttgtagcaggcacatgacagaaattgtatgtattgtggatctgcatgtgtgctgagtattccctatttctttgatcccttttcccccattttctgctctgctcccccctgaggctgtcttctagagactggggtttcttcataggtttgaacagtgggagataccagaggtgggaggagaaaaagttatttattaccgttcccttcctcctgcctggaccatggtagcttctgtgttcccgtaaggatacagcttcctttgggaagccccatctatggctgtagatctctcggtttcagttgacaccattccctctccatgatcttcagacttaactactactgggtgcttccccaacccactggttgggtgtctttaattgtgaacacatatttgtaaatagtgcctttattaattgttcttgagttaatattctgagtgtgccatttattttctgtgccatctgttaaatgatgagcatttaataaaattgtgataatcagttatcagtacaagtgccgcatagtgcataggctgaaatgtctcaagattccccacactacatatcagtattttctatctgtatctggacaatgcagtagaaattataacaaatacaaagttctttgtgcttttctgctgcatatgtcagtggctctggagattgttaccatctgctacatatataaatagacttgcagttattactaagctcctcttcagtaatagaaagacttatgaagtcttttactacctctgggttagccaaacaaccttcaaaaagcattgttatttaggttaaatatctgtggacaagaaacaagataatcagttactgagtgaagaaagacgggaatgatgtcccatacttcccagctctctaaagtgttatgctgtacaattaaaatacccctgacccatcatctgctaccattcgttgtggataattcatgtaatctctaacctgtgggcaagtctttacccttcagtagtcaagattacgttagagacttcgtccacgaatccacaccacctttcccatcagttctcaccggaaatatgctgccaaaaagaaaatcagcttttctaagatcaagccagagttgcttctcttacaaccttacggcgctaatgcattaagttgaagtcgactgccaaagaggcccagcagagggcagcacccccatcatttttttgaatttctcccttaggaattttgccttcctttgtcttctgtccaccaggccttctctccagctggacacaaacctcctttgacgggaaataattgccgttaggcttcacagtagtgctttttcctttcacttggatttgcattttaacctgcatttcgaagatttttatacatgttttctatttccgacaatgccaggaggcttcattgacgttgtagtctgtgttaataaacttgtgtatcactctgctctgatcttttaggaattaacttgcaaatgaaatgaatatgttgggactttggcataatttgaatatagcattgtgtgagttgtgattgtctcttcctaattgtgctgtaataacctgtgtatgagaataaaatgatttccaccatcaaaaaaa

SEQ ID NO: 58 - DNA, 2171 bp, Homo sapiens
cacttccccgatcgggccgtgtccgccgcggccctgcgaggtccgaggggcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggaaaatgacccagtcacagatatcatttgaggatgtggctgtggatttcacgctggaggaatggcagctacttaatcctactcagaagaacttgtacagagatgtgatgttggagaactatagcaatctggttttcttggaagtctggctagataatcccaaaatgtggctccgagataatcaagacaaccttaaaagtatggagagaggccataaatatgatgtttttggaaaaatatttaattcaagcataaacattgttcatgtaggactgcgatcccataaatgtggcacaggagaaaaaagtttgaaatgtccttttgatttgcttattccaaaaaataattgtgaaagaaagaaaattgatgaactcaataagaaattattgttctgtatcaaacctggcagaacccatggtgggataaaatactgtgattgcagtacatgtagaaaatccagcaacgaagagccatggctcactgctaatcacataacacacacaggagtctatttatgcatggaatgtggcagattttttaacaagaagtcacaacttgttatacaccagagaactcatacaggagagaagccctatcaatgcagtgagtgtggaaaagccttttcacagaagtcactgctcacggttcatcaaagaactcactcaggagaaaaaccgcatgggtgcagcgaatgtcagaaagcttttagtaggaagtcactcctcattttacatcagagaattcatactggagagaagccgtatggatgcagtgaatgtggaaaagccttcagtaggaagtcgcagcttaaaagacatcagataacgcacacaatagagaaaccctacagttgcagtgagtgtgggaaagcattctcccagaaattaaaactcatcacacatcagagagcgcacacaggagagaaaccctatccatgtagtcactgtggaaaagccttcttttggaagtcgcagctgattactcatcagaggacccacacagggaagaaaccttacggatgtggtgagtgtcaaaaagccttcagcaggaactcacttctcattaggcatcagaggattcatacaggagagaagccctacgaatgcaacgaatgtggtgaagccttcatcagaaaaccacagctgattaaacatcagataactcacacaggttaaatatctgtggacaagaaacaggataatcagttactgagtgaagaaagacgggaatgatgtcccatactccccagctctctaaagtgttatgctgtacaattaaaatacccctgacccatcatctgctaccattcgttgtggataattcatgtaatctctaacctgtgggcaagtctttacccttcagtagtcaagattacgttagagacttcgtccacgaatccacaccacctttcccatcagttctcaccggaaatatgctgccaaaaagaaaatcagcttttctaagatcaagccagagttgcttctcttacaaccttacggcgctaatgcattaagttgaagtcgactgccaaagaggcccagcagagggcagcacccccatcatttttttgaatttctcccttaggaattttgccttcctttgtcttctgtccaccaggccttctctccagctggacacaaacctcctttgaagggaaataattgccgttaggcttcacagtagtgctttttcctttcacttggatttgcattttaacctgcatttcgaagatttttatacatgttttctatttccgacaatgccaggaggcttcattgacgttgtagtctgtgttaataaacttgtgtatcactctgctctgatcttttaggaattaacttgcaaatgaaatgaatatgttgggactttggcataatttgaatatagcattgtgtgagttgtgattgtctcttcctaattgtgctgtaataacctgtgtatgagaataaaatgatttccaccatc

SEQ ID NO: 59 - DNA, 1088 bp, Homo sapiens
tagttctgcgcgttcacgtccccgatcgggccgtgtccgccgcggccctgcgaggtccgaggggcaatagccctctggaacaagacaattcatgtgagataagaaagaagagcccacaagaccaaggatgtattctcagtttacagaccactgaccagaggccactccagggtgtcaggactaagagaagtcacaaaacagcagatttcccaagagcagcggccaataggtcagactttgacgggccgtgacaataaccaggtaaatcgtctgaggcaacagcagaccatggctatgacgccactccaagcaggatggtcgggcccggaggactgaacatggcctcagcagtcacctcggcagttgccatgccaggaaagacgccccacagcccactggagagacagaagaatctgtgtgaatcttctttacctggcctgaggcatcaattcaggcacagcagaacactggccaggaaactgaacgtgacctgaatgtcttccaggctgagacaggtcctgagtgcaatcccagagggcacacgtggtcccctagaaacaacgaattcacaaggtcaggtgccccagccgggcacgcacgcctcaggttgtgaggttaacagggatccaaggtggcttcccatcgtcgggcctctgtccagtctggatcattgggtttaggccttgacttcagagggcctgcctgggactgagttccaaaccattctgtttatccatgacatgagtttgttagtcccaccttatcaagtgtggacagtctctggaggagttctgcacagagcccaggagccaaggcagtcctctgcctctcctcgtcagcaccgtgaggaagccgaggtgtgggctcagcagacggtccaagtccacagccgccacagtccatggaaaggcagcaagaggacctcttgtgtttggttttttaggaggaggagaaagcttttaggagcaggtctgaaaaataaagatcattattattttttccctttccctgagcctcccagatgccagttttgttttgtttttctgttacctgtgtgtcccatgtagtaatcaaaacttaagaacaaa

SEQ ID NO: 60 - DNA, 7995 bp, Homo sapiens
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatcsgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctggaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacatccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcagagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtaactgcagctgcgcgggagacttcgccctcaccatccacacccaggtcttcatggaacagatcggaatattccggaacattgcccagcactaacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccaggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttcaaaaaaaaaaaaaaaaaaaaaaaaaaaaaaaaaaaaaaaaaa

SEQ ID NO: 61 - DNA, 4602 bp, Homo sapiens
agcggggcgcggggcgcgggcttctgggcggctgcggcccgggcggcggcgatgctgtggccgcggctggcggcggccgagtgggcggcgctggcctgggagctgctgggcgcctcggtgctgctgatcgctgtgcggtggctggtgcggcggctgggcccgcggccgggaggtctgggccgcagcgggaccccagttcctccgccaagcgcggccgccgcccccgcctcaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccatggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaagatttaaatgttctatataacacttagatttctgatattttggaagaagttagaagttaatgaaagcaaactcagttaccaattttctggaaaatatccatgtggtaatgtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgattttgtatgtggaccactgctcctgatttcccaggtcttaggccacctttgactgtttctccgtttgtttgtgggcagcgattccagtcccaacggaggcattctcgtgtgtcccggggggttatgtccttcacaaaacacttaatgaaatgaattacttc

SEQ ID NO: 62 - DNA, 3873 bp, Homo sapiens
cccagcgcttgagaagtcggaggccaaggccgggccggtgcccaaggtgtcaggcctggagcgcagccgcgagctcagcgccgagagcttcctgcccactgccagccccgcgccccatgccgcgccctgcccggggcccccgcccggctcccgcgccaatcccttggtgaagaaggaaccccccgccccgcaccgccacaccccgcagccgccacccccgcagccccgcggcctgctcccgacacacgtgcctgcatccctgggcgccttcgcgggccacagccaggcggcagccaacggcctgcacggcctcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccgatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccgtttgacaagtatgcgcccaagctggacagcccctacttccgacattccagcgtgagtttcttcccgtccttccctcctgccatcccgggactgcccaccctgctcccacaccccggccccttcgggtccctgcagggcgcttttcagcctaaggtgtctgacccgtaccgggcggtggtcaaggtgagcacgtgttgggaaggcccgtggcaagggaggactctggtgcccccggggcggcctcggggggcccgtgacagcaggagtctgcagaaaacatgggtgggggtggcaccagccccactgagcgcttccatcctgtcgcagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagaccgagcacctttgggggcctgggcagcctgagcagccacgcctttgggggcctgggcagccatgcactggctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacgggacctcctggagaagacgcgcctgctgagccgggcctcgcccgccacccccgctggccaccccgtcagcggcctcctgctccgggcccagagcgagctgggccggtccggggcccccgcggagcgcgaggccgaacctcgggtcaaggagagccgctccccggccaaggaggaggtcgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccaggcgctgctggctgtaaacattatcagaagtttaatggcagcaactttccttcaactatgcaagcgcttcccggcggctctgctggttgggggaggaaggttccgccagcgacctcccagcccctgggtccgtggaggggttgggtccccccagcagagcccctgggccagcagaacagcactcctgggcggctcctgtgggcttcaggactggccggctccagccgcaagggcgatgctgtggacgtttgtgtggatggtgcagtgttcttggaatctgtagaccagatcggtggaggtatagaagtgcaagagtctaaaggctgatttacacacacacacacacacacacacacacacacacacaaaatcactgctgtgtgttttcttccgcctgaggcatcagcgtcacctcggtgtggtcgtcgcctcccaggcccttggcctggcctcctctcagtttgggttttgccctcacccacatgagcccccccatgccctgccccccttgcggccttttgtgttccccgatgtctgggctgtgtccctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaaaaaaaaaaaaaaa

SEQ ID NO: 63 - DNA, 6640 bp, Homo sapiens
cgtgtacttccttgtttgtctttgtcgctggccgacttgtcttcattccaggtggccagagcgagtggggccgggcgttgtcacgggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctacagagtgtccggcagtggtaccagcagcagctcgccctggcacaggaggcccgcgtcaggctgcagggtgagatggcccacatccaggttggacagatgacccaggctggtatcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggccaagacgagaaaggagccgaaagcgcaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcacccgcctggccaggccggctgcagtttctcacttccctgttccattcagtaagagctttacttttccgcagaaatgaaattttatctgtacctttggctttttacttgttttttttgatagccatcccaccataggatgtgtacatagatactgaatatcataatccaatctttgtttttttttttttttttttgagacagagtctcgctttgttgcccaggctggagtgcagtggcacactctccgctcactgcaagctccgcctcccaggttcatgcgattctcctgcctcagcctctcgagtagctgggattacaggcgtgcgccactatgccaggctaatgtttgtatttttagtagcaatggggtttcaccatgttggccaggatggtctcgatctcctgacctcaagtgatctgcccatctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccatggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttcattttttacaaatgtaagtgtgcttgggaattccttaaattttgtgcaataaactattttttggtaaagat

SEQ ID NO: 64 - DNA, 2431 bp, Homo sapiens
gtcggcgaggcttctgaagacgcaattcctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttgcgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaatgcatggacaagggatgagctttacaaagatgatgcactttggagatcagaaaattcatatttaagcaaagtgatacaaacacagtgatttgggaatgccttcatttacaatgcaatacttaaattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaaaaaaaaaaaaaa

SEQ ID NO: 65 - DNA, 6916 bp, Homo sapiens
gtgcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggctccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagccttctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagcttattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtctgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaaccagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaagacatttcttagtggtatttgtggcttatcttctagtgtcacgtatgttttgtgttttggacttacctataatttaatgtaattgggagtatgaaatgcatatgccttttagtgcctctgatgtctgtgaagacaacactacacaccactggtttttattttttaacaataatataaaaaatggaaactcatgtaacatgactacatgaataagtaccttaagtgataacccgtttcttttaacttatagacatacataaggggtcttttgtttttatggacctttctattcagtaactgaagccaacattgtgtaagtcttctgcatcctcagagtctgagtaacagtttatataaaataaatatgcaaaggcaggaaccacagaataaccatagtaatatataactgaatgagcaaaataaaggtgtgtgaactacattacaacacccaaactaaatgaaataaagtagtgctgtattaaatctttttctcatttagtgaggtgcctccatatagtatatatatatgtatcttaagtgatatgtaacccaaatgtcactattttaatttactgtgataaagtatcatggatattttgtgctgctgttatgctttttgtgttgcataaaatatcttgtaaaaattagatggataaatgaattattaaaaaatcacatttctgaagatgtaaagtattagggaattttgtgctggaaaaacatttttgacattcaaggatgcctattttatcttctagcaaatttctgtggtccctggaaaagtacagatgatcctggacttacagtggggttacctcccaataaacccattgtaagttgaaaacattgtaagtcaaaaatgcatttaatacacccaacttaccaaacatcatagcttagcgtagcctaccttaaacattctcagaacacattctaatgcatcatctattttataaaaaggtgttgaatatctgatgtaattattgaatactgaaggtgaaaaatagtagtgtatggataccattgtaatgttgagaaactgtaagtcacatcctcttaagtcaggaactatctgtataaggaaacaagatttccattttatcatttgaaatgtatttgactttgtttcactagttgcattatccccatggaaaacttcacattgagaacttaccattatatatttccataaaaatgcatgaaccatcccttagctaagtaaggattttgtaatgttctctcaataatgttgcttggcaaagttaatattttttgtatgctgatgaaatttagaaaagtccaatattgagcttgattgcaaacttagaaaaactcaagacttctccttttatgttcaaattgttgtatcagtatggtattttgcacctttaccttaaacaatattttctcctttaattattgattttgcaacattttgggaaagttggaattttaaataaatgaataattttctaaaccagaataccagttcaacagccaaataattctgtctttccatgctgtaattttaaagcatttaattttccaactttttgttcatactcaagtgtgtgaacttcctggctgggcacagtggctcatgcctgtaatcccagcactttgggaggctgaggacctcaagtggagacctcaagtggatcacttgaggtcaggagttgaagaccaacatgttcatggccaacatggcaaaaccctgtcttaaattagccgggcatggttgtgcgtgcctgtaatcccagttactcaggaggctgaggcaggagaatcacttgaacctgagaggcagaggttgcagtgagccaagattgtgcagcctgggcgacagagcgagcctctgtcaaaaaaagaaaagaaaaagaacttcctactttttaatatctcaaattcattttactagacgtgggagaccaactaatgcaaatgaacagttacagggtgatgttgtactttgtgatttttgccctattttttctttccatctatcaccattctctttccaatcccagagattgatttattaggtcttggaaattctagattattccattaactattaagcaswkaracctgatacttcctacactagataatggaacttcaacattagcctattgattgcccaagaacaaacatttttttctaaatgtcaggtgttatggggaggattgatgctgacagcagaggtctagttaaaaactgatgcagaggttcaaatacgttgtgcagtaatcactagaactcaccttctaaagtgtcatgagagctctgattctgcaattagagattttttaatgtgtttttgaaattaccttgtaaaccacaaatctgtgtctctgcattgccccttattgtttcctaccacaaattctacatcaagaagaaagttttaaagttagactggatttatttgtgattttatggagcacaataaggtacattgagatagcatactaaaggaggccaaatacaggaagcatcatcttttcttattctcttactgcctggattttcccactgacctggaattgtgcacagttctacaaaggacaattgacattgttttccttttactaagtagtgggttttccttaaggtccagactgaattttgagacctgtaccaggattgccttctgtgtgactttttcttgcaggatctgacatcattacctatgggtccatatatttgtgatactttggtttcgggaacatcacttttagaatgttgacataaaatgcacccacagaatgccgtatttatcaaaagtaactttctagcaaaatctacagcagtaggcatttggaatctgcatttgagacctctgcagtcatttggtcattccagcaatctatgtccaggttgtcaatttcagaggtcttattagtctatacaggtaccaatgagctttcagatgttcaacacctacccctggcctaactgctgataaccaaccataacccttgcagatgcatgcatgttttctgcaccttgctatcatttttcagtccatttttcacatgtatacatagtgattatttttaaatgcaaccctgatttcacatgcctcatgttgaaatatcgtgtggcttattgtggacttaaagtgtaacattctccttatggtatgtaaggacttttgtacaaaccaatgcctatctatctatcatttctgaaaactttttcctcctatgcaatattttctggcctctgtgaacaacttgtagttccttgagatttctattatcacttatgtttttgcaaatctgcaattgaaatgcccttgttccttgttaatgcctattgaatctatatgaacctgtacgtgtgtttctcactgtgataatataatcattgcatgttttatctttcccactagaaagcttctagaaagctaggactatcttttttgtctgtgtaatttttgcatcacaagctatatttaaatgtgggtgcagtgagtggctgttttctgccacatggagaaacatggtctgcagtgagagagaagaatgaagccatgatgaaagcaaaatcaagaaagagtcccgattgtgttccagtacctggttcttctggtcttcatgttcaggtccacctctgcccttttcatgtcttgattgttgaattcttctgtgagatactccaaatatcctaataaattctcatgtttgcttcaa

SEQ ID NO: 66 - DNA, 4424 bp, Homo sapiens
gactcacctctgacgccgctcttcgcgctccgctggtgaatggagtcgcgttctctgtttgctgttgctgctgccttgtgacgggatcgctttctcccatcgaaccttctagttgcttattgcagctctacggcggtggtgctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcaagtggcattcacccaaaagaaagtacttactcaggagagagtctctgaaagtggtaaatatgggggaaactgtcttcttcctgctcagctagtactgagagagtatttccataaacgtgactcacatactaaaagtttaaaacatgatttagttcttaatggtcatcaggacagttgtgcaagtaacagtaatgaatgtggtcaaactttctgtcaaaacattcaccttattcagtttgcaagaactcacacaggtgataaatcctacaaatgccctgataatgacaactctcttactcatggttcatctcttggtatatcaaagggcatacatagagagaaaccctatgaatgtaaggaatgtggaaaattcttcagctggcgctctaatcttactaggcatcagcttattcatactggagaaaaaccctatgagtgtaaagaatgtggaaagtctttcagccggagttctcacctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaaccctatgaatgtcctgaatgtgggaaatctttcagacagagcacacatctcattctgcatcagagaacccatgtgagagtgaggccctatgaatgcaatgaatgtggaaagtcttacagccagagatctcaccttgttgtgcatcatagaattcacactggactaaaaccttttgagtgtaaggattgtggaaaatgttttagtcgaagctctcacctttattcacatcaaagaacccacactggagagaaaccatatgagtgtcatgattgtggaaaatctttcagccagagttctgcccttattgtgcatcagaggatacacactggagagaaaccatatgaatgctgtcagtgtgggaaagccttcatccggaagaatgacctcattaagcaccagagaattcatgttggagaagagacctataaatgtaatcaatgtggcattatcttcagccagaactctccatttatagttcatcaaatagctcacactggagagcagttcttaacatgcaatcaatgtgggacagcgcttgttaatacctctaaccttattggataccagacaaatcatattagagaaaatgcttactaataaatatgggaatttttcacaaagagcaatgactttattttgcattggagaactcctggagataagctgtacaaattgaatctatgtggaaatgctttcagtcttgttactatcctattgcacattagagaattggtcctggaagggaaagaaaccacagattttatttcagtacacaaatccatcagattttcttcttttcatgaattcctacagaagtaattggcctgagagcattcttgaccaagtcttaaatgctagaatctgagaaggaattattaaataggtgagttgttgagcgagaaccccttcatttgaaaagaaatgagtatgctactatagggagagttgttgctgagaattaagaaatgatacagttaatgcaacaaaagatggaaaatrryaykwsrgtcaatatgtcattgttttcttgactatgtctctcttctgggacatttagtagtgtttggtatgttttatgtgtctggtagaaaccatattttggttaacagcaagaaaaatgcttataatgtagtacaattaaaaacaacacatctccactaccagtgctaacccatttttaagtacatttgcatgtgggcaagaattgaaagtatacagataattgaacagaattgatttgttagataaggagattttgactgagttttatagtctgtttaatgttgctgtaataattattttaagaaacttaaatattgtaagaggatatctagtttctctattctaccatcaaagaagcttttgagtaccacctgttaatgagctttcctattctaaattgttttgggtcacagagttccactttttccactcttattagcactgcaaaagctcctgagaatttaaaaacacagtaattctctggatgttaggacctaggggaacattgggcatttgaacatatcagggagggtccccattttagtgggaacaagtatttaaacaatatttagagcaagtgtcctcatgtgataaacagagcacagtccaaagataccctctttctcaaggtagtcttttatctttataaagaaagattagtgtttaagagcgtagacttgagctagactacccaggttgaaaccccactagctgggtgatcttgaacatgctgcttagcttctctgtgccaaacttactgatatcctcatctgtaaattagcgataataatagtacttacctggtaggattatggtgagtattaaatgagtaaatggaaacagcttagaatagtgcctgacatatattatgttctctgtagttactggctgtgattattaataatattgccgcaccctaatatctgttatttaattgaaatctgcttgtgtgcttataagaatttactgagttctcacttcccttacagtcatacatggtttttcccttttgcctaaatcagaactcaacagcctgggaaaatcactgacaaatagtggatataggtttcatttctgaggatcaataaacagcttgtaatgttgtatacacatttattctgtttgtacaaaggttttccattctatggagaggatcccagtcttcagattctctggtaagttaataacccacaaaagattcaggaagaggatctattttaattttctctttcattctataaatcagtctgttgtatatagggacttgaccatgattctccattttctggcataaatattagctgctcaatgatttgattgttgaatgatagcrwgargtgatttgctgaagccaaccagagatcttgatctctctctgaggaaaaaacctagaaatgatggttagaatcaggagacttgagaactacgaggaacatggcagcctctagctcatacttgtcgttgtacaattgagatcaagtgaattggccccggtctcacattttcagtgaagtcagactcagaactaggtcctgggtttcatgtttcctgctgctcttctcactgtgtacacaccatgcccacatacaacatacctatcagaaatggttttcattaagggagtagaatagtcacttaactggggctcttaacattgctaataacctgtggctcaatttcctcaactgtataatgaggttactactagtatctacctcaaagcgttgtcatgtggattgagatgatatgtatgaatcacataaaagagtgcctggcacatagtaggtgccattaataatattactattgttaacaccttaagggtctaacttgtaatgaagacagaaatatgtatgaggatgatcactgaaatatttatgacagtgcataatttgcaaaataaaaaatgtacactagcataatatttgtggcatatccgtgtaatggaagattatgcaggcattaaaatatgtacacaaaaagtttggtaaaggaaaaatgctgtcatgtgttacaaaagcatgataaataattgttaatatggaataagctcaaatatgtcaaaataaatgtaaaaaatgagtgttgcccaaaact

SEQ ID NO: 67 - DNA, 530 bp, Homo sapiens
  misc_feature (1)...(530): n = A,T,C or G
cntaaatttaggatgtgtatcntcaaatctctgcccttgtgactggcatatgttaattaactgggccatgggcggggcgcctgtaacccccggctactggggaggttgaggccgggagaatggcttgaaccccgggaggcagaggttgccagtgagcccaagaccgagcccattggcactcccagcatgggcaacaagagcaaaactctatctcaaaaaaaaaaaaaaaaaaantctcagattttcttgacaattgaatataatctataaacagaactgtttttattcttactcatcctttattcttctagtaagaattgcctagtaaggttttgaagtttttctcatatagttcacatatatttctagctaaaattattttcttcctattgtgaagacttttttaaaaataaaagtatgtgctaacttgttgaggacggcaatcaatctattagcttatatatttccttttcagtcactttactacaaattattgatagtaattgaatctcttctcattttggggactt

SEQ ID NO: 68 - DNA, 548 bp, Homo sapiens
ggccagaaagaccaaaactgtatcctgaggtttgagtttctgagccaggtgatgtcatcctccagcttggccggcctctttctgggagcctctggtgtgaaagagagcagatttattaaaaatcatcaacttcaaattatttggatggaaacattgccaaatcatagagatgtttgctaccacccgcacaccaagcagctgggtaactagaagtgcaggatcagcttattcacctccgaaagcctgcatgcaaccactgaggccgcctctattttttacatagttctacttggtgtatgtaaccccacagagaaacctggaagaatgcatgaaacctagtaaggcaaccagcacatgcaacagaatgaaccgtttctttccatctgaatgcctaaatgtggactctgatcctttctaccaagtcctaagtttgggaaaagaggacaaggacaggggctctgtcccatatcataatgtgcttgtgaatggctaaaattacaatgctgagataagtgtgtgtaataaaataattgcaccccgaattgaaa

SEQ ID NO: 69 - DNA, 1176 bp, Homo sapiens
cggccgcaggacaagcccgaggagcaggcgggcgctccaggggaaaaccacgcacaaaaccttcttcagagaaaagggaagctccaaacctgactgagacaaacggaggctcttgaaataaaaagaaaataccgcaggacaaacagcctcccgtccccgggcgcaggtcgcggtcacagtggtgacctgggattgctttcccaggactgcgagtcgggtttgggtttctcctccctgcattccacagctgctctggtcatcgcaacgtgtttattgatcactgaagaatctcaagttttgagacgaggaagaaacacccattaggtctccaagacagctgtgtttcacaaactttaaggagacagaaattttctcccctggaacctgtgaaaatgtcccttttccaaggaagtgaaggttaagaggtcccgttctcacagaccctcaggaatttcacttggctccgagctttgacctccgagagagccatggaaaagctgctgcggctgtgctgctggtactcctggctgctgctattttattacaactttcaggtgcgtggcgtctactccagatcgcaggaccatccaggatttcaggtgttggcgtctgcttcccattactggccactggagaatgtggatgggatccatgaacttcaggatacaactggagcgtcccgaacccacaagctcactgtgcttccttcccgtaatgctacttttgtgtattccaatgattctgcctactcaaatctctctgcaactgtagatattgtggaagggaaggtcaacaaaggcatttacctgaaagaggaaaagggagtcacgcttctctattacggcaggtacaacagctcctgcatcagcaagccagagcagtgtggccctgaagatttccagtttttcttgataaatctctcctgacttctctggctggctggagctaagtcgcggtggccctggacttccgtctccagttcccctcagtccccaccagacttctcgactcttcaataatcttcaggtcgaacagagcctgtccgcagcatgagctctggggccagaaggcgtgggttccacttccggttccgacctgtttgtggggatcttgggcaaccactgcttccctttgaaaagcctcatctgtaaagtgagtgaataaaaggaccttccc

SEQ ID NO: 70 - DNA, 2064 bp, Homo sapiens
ggcttggcaatgaggccgaactcctggagagcatgggggatgcaccgccgccccaggacgagcacaccaccatcatagaccgcggaccgggggcctgcgaggagagcaaccatctcctgctcaatggtggctcccacaagcacgtgcagagccagattcacaggtcagccgactccggggggcggcagggcagagaacagaagcaggaccccctgcactcgcccacctccaagaggaagaaggtgaaatttaccacctttaccaccatccccccggacgacagctgccccacggtgaactccatcgtcagcagcaatgatgaggacatcaaatgggtgtgtcaagacgtggctgtgggtgcccccaaggaacttagaaactatctggagaaactcaaagataaggcttaggcccctctagccaaagggccctgcccagatgccttccttgtactggaaactggcccaagtggggcagaaggcgttgtcagtggggttaagaagggacggtcccagggtccatgctagaccagttggaaagttttgaagtcaggaaaagacgtttttgtatcaagggatttttagcagttaatggtggtggatttttaaaggtcaggggaataaagtctggggcatggggagtgcagaccaagttactgaactgcacaggcaaaattaggaaggttattttatgagtcaaaacatactacagacaagctaccaaaaattatttgttaaaaaatgcaacaagacaaataaaaagagaaataatcatctgtttatatttctaataaaggagcaaaatataaaaataggacctgctaagagacattttccattctaattcacgattcacttttccaaggacagccttcaactgtcaccacacagctgggggggagtcatttcttaacaagggatgcctcttgggatagaactagggagttttaaatctttacttgatcatcttttattttcttttccactttttccttttctctctctctctgtgtcctagacttccattgcatttatatttaatgtttatttctgagaatcaagcagtatatttttcctaaatgaaacataaattatattcctattcattagataggttcctaggaacaatgccaattaatccattgtttaagtagtaacttgaatgtttttctatatccctccagctttgttgatagtggcgggttttgtacaattggagggagccctcagagccttctgggggaggagaggaactgtccttaatccatcaccactaccatagggcaaagccagcaggtgtggccctgtgaggggctgtacagacgggatgtggccaggagaacagagccccacctggaccacctgacccctcgggattccacccctgtcatcgtggggatgttcctatataggagaaagttgggttaaatcaaaaaagaggccacgcccaggtgtaatcagagccaacctggtgggctgggtctatcacaagacataactgatgctgaacatgaacaaagataaaaactgtttggagggtttttgagttgtttttcttatgttgttgggtggggtataccagcataaactctaaagataaaatctatgttagattgtcaatcaactgtgtttttgaacagcataattgtgtagcagcacattgcaaaaatgcattcatccaaagcgacacatgtggcaacgtagaccacgccagtgaaataagccccttcgtgatcacctgactccagttctccgtgtgctccattggctgcggctgcaggaggaagatgcctgacagccctcatgctctccgcaggggggcgctcacaaagatgccaggggtgtttattgtgtttatttttttaattactaaaatcagtagctaagaaagggtccttgaagcctcctaacctgggttggacctttgaaaaatatatttgtagcacatattatagatggaaagaagaagatatttatttatacctgtgatgccaattgtcattaaaaggcttttcatggcttgacaagtcaaaaaaaaaaaaaaaaaaaaaaaaaaaaaaaaaaa

SEQ ID NO: 71 - DNA, 417 bp, Homo sapiens
tttttattatttttacctttttaaaattttacattttattgatacataatagatgtacatatttccagggtactgtggtaatttaatacattcatacaatttgtatgtataattgggatacccaccaccaattacataatggatatttgagtaccaaaatttacaatttgagtacaaaatccttcagacttctactaaatacttcatagttctttgatcccaatgtactcataatggtttaatttttaatgactctattaaattctaaaactagcaattcaggttttgcagaaataacccattttgtccttttatctcagtgggttatggtggtttgtaaaagtacctaaactcaataacacatataaccggcacaagcagatttcagatcagtcagcatttcccccagcggagcac

SEQ ID NO: 72 - DNA, 482 bp, Homo sapiens
ccaagactataaccacagctgaaatctaaggtttctgatggagaagaagaccttagtaatttggtttttgttttgtttcatagaaagaacactgaccataagatctgccctcaacacatttttaagagcgtgatacaggattgttaacaataaggaacatggttgtttgtttttctcttaattgcttttttattacgaagctaaatgatttttaagagcgaaatttgaatataaagaaaataatagggcttttgacttttctactacaagaaggtggcttcctcaaggcatatgattgcaatccaagcgatgctatttccagatggtaaacaaccctcttttttacaatcatgttgcctacaagtctaggcagacaacccttggtacttacatacaccaggtactagagaaaagctggaaaatgcagccagtggtctcaaggctttcaaaaatgagaccttaataaagagttaatatgaaaa

SEQ ID NO: 73 - DNA, 667 bp, Homo sapiens
aaaaaaaagcagtcaaaatgtaagggagctggaaagcagtctgcatgtggaacaactcaagattaaagctaagcattctcagcatcatagcaagtgtatttaagggggaaatttccagttattctcaaattgttaaaggctttcagaaaaatctaatgttttaatggtcacaatgatctttacctctacaggtagacactaccttgttacagatagggaactgttccatagagttaaatttgcaatcctgagtaaccatttttttaagtcatttattaatgaagactgatacatagaatgtttaagaaattatatttaagtattttccacaattgatttgtgtgttgtggcaacattataaggaaatgtttcttaaacagtttcagcacaaatttttgtaccaagttttaattcaataaaatttgctgtatatgttgaacagagttgttaagacttccttttactttctcttcaccttgtgacttggctgttcctcctgctgttcctctctgccgtccacggccaaataattccccctctgctggtggcggctgaggcctaggctgaatataaccaggttgctgactcgctggggacatgcaaataaagaacactcttttcgtcgagcggtcagacaccagagaaaatttctagtcttaagtctcag

SEQ ID NO: 74 - DNA, 2292 bp, Homo sapiens
ggggtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttcgagactggggtttgagctttgattccaacttactgtccttctcaggaagaattttgcaaacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccaggtgtcattcgtgttcctgctccttgccagtacgcccacaagctggcttttcttgttggccagagtattcacagagagccaaatctgtcactgtcaaaccgcctttactacctctaacctgcagaagacgatgcagccgcttttctttttgaaatgactttgggatttttttaagcttttatttactttttttttaactgttatctttctggatgaaacttgggaaggggattaggagatctagcattttatttctagcattgctattcaccggcttccttattttatatgtaaaaattaagattttatattttatcttcttgtttctcatagatattttgtgagcatttttttgtttattttgaagaaatgtggataagatacttggtagtataaaacagactctctgagagtatttgaaatgtgtttggagatttacttaaacgtactttcaggagtgagcaagtcctacttataaacctatattaactttatttttgagatacctgttttgaatttaaaggagataagaggcgtaaagtaggatgctcactacaaccataggtggggtttcagctcatatcttaaagataaaaggtactattatataacctatacacaagatacaggagaaaatatgcttgatttttatttggcaggggggctaggttgtatgggagtaaaaaaaacattgaaaatttttaaattgtccaaagaaacattttaagactctttaacaaaaaaggccatgagtaaatctctatattaacatcactatttattttgttttggaactgggacatgattctatttgttataaaataaaattgatgtccc

SEQ ID NO: 75 - DNA, 3225 bp, Homo sapiens
ggcggtgttgaggttgggtccgggatgcggggtctttgactgaaggggtaggccaagtggaggtatcagggacgtcgcgcggcacagaagaggaccagcctggaggccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggcccaggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattcagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggccccgaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgatgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggtaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctcgcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggtaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 76 - DNA, 2306 bp, Homo sapiens
aagagacaagaggtgccttgtgggcagatagggggctgggagggggcctgcccggaagcagtggtggcccgtggcaggcttctcactgggtaggaccgggccctctgttgcaccccctcaccctgctctctgccctcaggagtggctaagcaggttcggttacctgcccccggctgaccccacaacagggcagctgcagacgcaagaggagctgtctaaggccatcacagccatgcagcagtttggtggcctggaggccaccggcatcctggacgaggccaccctggccctgatgaaaaccccacgctgctccctgccagacctccctgtcctgacccaggctcgcaggagacgccaggctccagcccccaccaagtggaacaagaggaacctgtcgtggagggtccggacgttcccacgggactcaccactggggcacgacacggtgcgtgcactcatgtactacgccctcaaggtctggagcgacattgcgcccctgaacttccacgaggtggcgggcagcrccgccgacatccagatcgacttctccaaggccgaccataacgacggctaccccttcgacggccccggcggcaccgtggcccacgccttcttccccggccaccaccacaccgccggggacacccactttgacgatgacgaggcctggaccttccgctcctcggatgcccacgggatggacctgtttgcagtggctgtccacgagtttggccacgccattgggttaagccatgtggccgctgcacactccatcatgcggccgtactaccagggcccggtgggtgacccgctgcgctacgggctcccctacgaggacaaggtgcgcgtctggcagctgtacggtgtgcgggagtctgtgtctcccacggcgcagcccgaggagcctcccctgctgccggagcccccagacaaccggtccagcgccccgcccaggaaggacgtgccccacagatgcagcactcactttgacgcggtggcccagatccggggtgaagctttcttcttcaaaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggagacaggtactgggtgttcaaggacaataacgtagaggaaggatacccgcgccccgtctccgwcttcascctcccgcctggcggcatcgacgctgccttctcctgggcccrcaatgacaggacttatttctttaaggaccagctgtactggcgytacgatgaccacacgaggcacatggaccccggctaccccgcccagagccccctgtggaggggtgtccccagcacgctggacgacgccatgcgctggtccgacggtgcctcctacttcttccgtggccaggagtactggaaagtgctggatggcgagctggaggtggcacccgggtacccacagtccacggyccgggactggctggtgtgtggagactcacaggccgatggatctgtggctgcgggcgtggacgcggcagaggggccccgcgcccctccaggacaacatgaccagagccgctcggaggacggttacgaggtctgctcatgcacctctggggcatcctctcccccgggggccccaggcccactggtggctgccaccatgctgctgctgctgccgccactgtcaccaggcgccctgtggacagcggcccaggccctgacgctatgacacacagcgcgagcccatgagaggacagaggcggtgggacagcctggccacagagggcaaggactgtgccggagtccctgggggaggtgctggcgcgggatgaggacgggccaccctggcaccggaaggccagcagagggcackgyccgccagggctgggcaggctcaggtggcaaggacggagctgtcccctagtgagggactgtgttgactgacgagccgaggggtggccgctccagaagggtgcccagtcaggccgcaccgccgccagcctcctccggccctggagggagcatctcgggctgggggcccacccctctctgtgccggcgccaccaaccccacccacactgctgcctggtgctcccgccggcccacagggcctccgtccccaggtccccagtggggcagccctccccacagacgagccccccacatggtgccgcggcacgtcccccctgtgacgcgttccagaccaacatgacctctccctgctttstagcggcycggaattc

SEQ ID NO: 77 - DNA, 1632 bp, Homo sapiens
ccggcggctgagaatccgcgttgttccgtgttgggggcggcatggagcgggagccgggcgccgcgggagttcgccgggctctgggccgccggctggaggcggtgctggcgagccgcagtgaggccaacgccgtgttcgacatcctggccgtgctgcagtctgaggaccaggaggagatccaggaagcagtccgcacgtgcagccgtcttttcggggccttgctggagcggggagagctgtttgtgggccagctgccctctgaggagatggtcatgacagggtcccagggagccacacggaagtacaaggtgtggatgagacaccgctatcacagctgctgcaatcgcttgggagagctcctgggccacccctcctttcaggtcaaggagctggccctcagcgcactcctgaagtttgtgcagctggaaggagcgcaccccctggagaagtccaagtgggaaggcaactacctgttcccccgagagctcttcaagttggtggtgggaggcctgctgtctcctgaggaggaccagagcctgctcctgtcccagttccgggagtacctggactacgacgacacccgctaccacaccatgcaggcagccgtggatgccgtggcccgggtcactggccagcaccccgaggtgccccccgccttttggaacaatgccttcacgctgctgtctgccgtgagcctgccccgccgggagcccaccgtctccagcttctatgtgaagcgggcggagctgtgggacacctggaaggttgctcacctgaaggagcacaggagggttttccaggccatgtggctcagcttcctcaagcacaagctgcccctcagcctctacaagaaggtgctgctgattgtgcatgacgccatcctgccgcagctggcgcagcccacgctcatgatcgacttcctcacccgcgcctgcgacctcgggggggccctcagcctcttggccttgaacgggctgttcatcttgattcacaaacacaacctggagtaccctgacttctaccggaagctctacggcctcttggacccctctgtctttcacgtcaagtaccgcgcccgcttcttccacctggctgacctcttcctgtcctcctcccacctccccgcctacctggtggccgccttcgccaagcggctggcccgcctggccctgacggctccccctgaggccctgctcatggtcctgcctttcatctgtaacctgctgcgccggcaccctgcctgccgggtcctcgtgcaccgtccacacggccctgagttggacgccgacccctacgaccctggagaggaggacccagcccagagccgggccttggagagctccctgtgggagcttcaggccctccagcgccactaccaccctgaggtgtccaaagccgccagcgtcatcaaccaggccctgtccatgcctgaggtcagcatcgcgccactgctggagctcacggcctacgagatctttgagcgggacctgaagaagaaggggcccgagccggtgccactggagtttatcccagcccagggcctgctgggacggccgggtgaactctgtgcccagcacttcacgctcagctgaccctggcccacctgtgaataaatctcagctgaccccagcc

SEQ ID NO: 78 - DNA, 3138 bp, Homo sapiens
ctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgagatggtgccttgctgtgttgcccaggctggtctaaaactcctgggatcaagtgatcctcccaccttggcctcccaaagtattgtgattacagggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgagaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccccccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcagcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagaggcaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcctgccgagaggggcagttttgctcttttgtacattttccgaaactacagttaaagcggaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccgcggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgattcttggaaaaaaaagtttcttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctc

SEQ ID NO: 79 - DNA, 2679 bp, Homo sapiens
aagaattcggcacgaggccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgaagctaacaaggaaaatgtgttccatgggaccaaagatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgacaaaaaaaaaaaaaaaaaa

SEQ ID NO: 80 - DNA, 3325 bp, Homo sapiens
cgagagcgcgcggggggcggttgccgtggcagcgccggctccagggagggctgctggcgccgggccgggaccgcggggcctgaggcggagaccggagagcccgcggcccggccggaggcagctcgggacaggcttgagcggcggggcgcgctgcccggccggcggggatgcgggaccggctgccagacctgacggcgtgtaggaagaatgatgatggagacacagttgttgtggttgagaaagatcatttcatggatgatttcttccatcaggtggaggagattagaaacagtattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaagaaggaaattgatgttcattattatttgtgtaattgttttgcttgtgatccttggaattatcctagcaacaacattgtcatagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaamaaatgtgcatgaagtttaattaggaaggaatgctttatgttatgaaggcttttttttttttttttgagacggagtctcgctttgtcatccaggctggagtgcagtggtgcgatctcagctcactgcaacctcggcctcccgggttcaagcaattctcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggctgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacccttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaatggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccacgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtatttagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagagaagcataaaagtattcactttcctgccttgtcatttctggaaagattttggggagatattttattgcatattaattaataaattgttctacta

SEQ ID NO: 81 - DNA, 3446 bp, Homo sapiens
cgagagcgcgcggggggcggttgccgtggcagcgccggctccagggagggctgctggcgccgggccgggaccgcggggcctgaggcggagaccggagagcccgcggcccggccggaggcagctcgggacaggcttgagcggcggggcgcgctgcccggccggcggggatgcgggaccggctgccagacctgacggcgtgtaggaagaatgatgatggagacacagttgttgtggttgagaaagatcatttcatggatgatttcttccatcaggtggaggagattagaaacagtattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaagaaggaaaaagtggataattattgctgtgtcagtggttctggttgccataatcgctctaattattggcttgtcagttggcaaatgatggtgtggataacgtcagtgtgcatgcctctctgccagggaaattgatgttcattattatttgtgtaattgttttgcttgtgatccttggaattatcctagcaacaacattgtcatagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaaaaaatgtgcatgaagtttaattaggaaggaatgctttatgttatgaaggcttttttttttttttttgagacggagtctcgctttgtcatccaggctggagtgcagtggtgcgatctcagctcactgcaacctcggcctcccgggttcaagcaattctcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggctgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacccttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaatggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccacgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtatttagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagagaagcataaaagtattcactttcctgccttgtcatttctggaaagattttggggagatattttattgcatattaattaataaattgttctacta

SEQ ID NO: 82 - DNA, 407 bp, Homo sapiens
ggcacgagggctgtggtcatgccgctgcactgtagcctgggtgacagtgtctcaaaaaaaagaatctttaaatacggagtcgaaggcaaataatcaggagtgttactagcaaaccctgagcttcaaaacagaaattcgagcttccatggttgcttaaaaagatacaactttgcccttctggcttctggctcgtccacacatctgcatgtgccctaaggtccctctgctgcagagctctggcagcatctttgctttccagatccaaaacaaaaacacaaagaaaaggggaatcccgatcagaaccagaaatagaatgcgtattctcttaagaatgggttcgagggtgttcaagtactttaacatatgtcataataaagttcttctactgataaaaaaaaaaaaaaaaa

SEQ ID NO: 83 - DNA, 415 bp, Homo sapiens
ctgcgttcagtgctcagtggtgagttcccacgcaagagcctgggagtcaaccagaaaagaacgcacgcgggcgggcccagcgacctcgggcgccatctgctgattaccagacgccactacctgagaaatgcccctccagtcccctcattgcccagctgcggaccctaagcggagccataaccgtcctaccaacccacgtcagcagaagagcccagtgggagggcgtgtgttcacttctgctcctctggcaaagacgcccaggtcagaaacacccacccgaccctcccactacccagagacagccccacctgcacagctcagagcaggaccactgaccctctggctctccggtcatatttgctattgaagaccagaataaagtatttttatcaggattgaaaaaaaaaaaaaaaaa

SEQ ID NO: 84 - DNA, 2886 bp, Homo sapiens
gtcatggagtgtctgcacgggacgtcctggagagtcggacacgtaagcagcacagtgaggccaccaacagcagcaaccgagtcttcgtgtactgcgccttcctggacttcagctccggagaaggggtctggtcgaaccacggctgtgcgctcacgagaggaaacctcacctactccgtctgccgctgcactcacctcaccaactttgccatcctcatgcaggtggtcccgctggaggtcaacattggcatcctcatcgctgtgaccagagtcatctcacagatcagcgccgacaactacaagatccatggagaccccagtgccttcaagttgacggccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaaccaaggtctggtcgctcacgagcagctccgcccgcacctccaacgcgaagcccttccactcggacctcatgaatgggacccggccaggcatggcctccaccaagctcagcccttgggacaagagcagccactctgcccaccgcgtcgacctgtcagccgtgtgagccgggaggctgccaaccaggccaggctgcgctcagaacacacccccccaaacagaatgaaatgccccacctttgcccatggaccctctccttgctgctgtctggacatgggtgttgtggccccgagacagctgtcctcccctgtgactctggctgtcggagcacactgctcagcccagcagcctgatgcccaggccagcgtgggccctcctgccttgcatcccacccgtgggctgagtgacttcctcgggggattccccaggacacagtggcctgactgtgatggtgcccttgagcctcccttcatcactcagcatcagacccagcgaggccaggacactcggggccggtcccgcagcaccaggaggggatgttcagcctctgtgccttggtggggcttggggactcagggccaaagaggtggttcaggtccccacgcaccctcagtcaggcgcaggcagctgggggtgtgtggggaagagcatgcggagtccccagtgtctgaatccactgagtggtgagttccccacagccggcgctagccgtggtgtgtgtctctgtaggtggtgccggcgtgggccaacctgtgctgtgtcatcagttgggggcccctgcccaagccgagctcgagccgtgggcgggagtcgttgactctccaggtgagggcgacccctctgccctgtccttgsgggggtcccctctgctcacgtgaagagccgctctgggccttgaggctgcctgatggtgcctgtgcttgggggagcttctcggccatccgctgtgagttttgcctctttggaccccaattcggccttaagatgccctcctccctcgtgtgccagcctccttggttgttcttgggccacaggagctggccgtgtccccgcagtgcctggtgtccaggtggaaagtggagggcattttccagggcactgctttccccagaggcttcctcatggctcacaggcactctacgaagtttctaatgggcagaccacgcggcaggtagcacagtgcgctccgtctggtcaccatgagaccgacctgcgctgagtccccactgacctggagagggagggctggtgacagccgtgtcttctgtgttgagggaaatttatggactcagaytcagccccagaggagatgggataattgttatggacccatgtgtgggcatgatcctgtggaacacaggtttgggatcatagatgtgaattaagacaccaccgagatacgggctgtgaggttcatactgtgctgatagcactcgtggtgtctgtgaaatgtgggtaagacattcaaacctggttttgatactggaaactcttcctttaaaactgtgaccatgatttcattcagcccctccacacccctatgtctgccttgtttcagagtgagttttctatggagcctgtggcccttttgcagcccacctggtggcttcttaatgtaactcttcccctggtcgcctggagtggaccactcatctgcaggcctctcctgcatggggagggtaggcagggagcagcatgtctgcaggggtgaacctttgctcttctgtcaggcgaggcccaggctgcaccagccacctgccacatggtgacagtgccacgggccctgcgtatggcccctgcaaccgtgctctggcgggcacacctggctgctgcaggccaaggccgctgttcagtgaagagtcccatgtttagtatggactaaagtcccatgtttagccactgccccaggctcccgtgaccccagaaaccaggtcacatggaccacagtgccagatcctcatcacgccggtgagcacctagaagtgagaacactgtattcctacaatgtacacttggatatttctccttatttagtttctagtgaaacaaatcaagtaaggaactatctttagtttagatggaattatttgtttttaattgttgccgtattcatctatatagctaatatttcaagataagtaatgaacaaaacctgtctaaaccttttgtttccaatgaatgaaagtcatgcactttatttataggctctatgttttggcttctgcagtacttttattatctatacataatttggccaaaaataagaaattggaaagaatgaaatgtttagtttatagtagaagaaagatgatgacactaagttgtgaaaatatgttgtgatttttatgaaataaactcatgtcctg

SEQ ID NO: 85 - DNA, 690 bp, Homo sapiens
tcagagagcacgttggccctacaaatgcaaatccaacattcagccacgacctcccatgtgccaagtgtcatgggattcatgctttcaaaccatcggttccagttaagactcatataatgaaacagatgggttcacatgattttagtttatatgggaagaagctttagactaaagcagagggaggtaaacttacaggcaagcaggaaggcttgaaggcttgagtgttcttggaggctcacggctgggtgcaggctgaccttgggtgagagccctcgttcattgccccgtgacactgtccttcctgtgttttcaaacggcctcttgttcctggtcaatatcctctgcgcttctctttggggatttaggacaccacgacattctcttcattgtccaaggaaaccattctcctcatctagaaacatcatcgatttctgaagttaaattgagaccagagtggattctgcacatcagtctctcccctttccctctgtgactgtggactctgggagggttgaagggaggtggtgccaatggcaaagacatgctctgatggtgcggcttttccacaggcctttcttaagctgtgactgggtctcagatctttcttcagacctgagggatgtttagagtggaggatgtttgcaaccatcagtcttccgtcatgttacactggagtttcgggcagtgacg

SEQ ID NO: 86 - DNA, 358 bp, Homo sapiens
gggcataaagaaaatgtagcttttcatgtgcttggattagctgtatacgcaaattagatgctgatgaactttctagaagtcagttttccctatggataggaacatctacctggctacatctgtgctagatatttggagagaagcattcagaatgaaagctatattttccgagctaatatttgcatgaatattgagatgtcgttccctttttgaagtaaatattgacctcagtttcacctttatttctgtgttctgatcaacacacaccaataactgctgatgactggatgttcatcctggtggaatctgctggaaccaataaaaaatgcctagctgctgttaaaaaaaaaaaaaaaaa

SEQ ID NO: 87 - DNA, 381 bp, Homo sapiens
aaaggctccaggcttcggtatcatcccgtggagagtgacggtgcctgcttcgcgcagtctgtctgagaatcaagtgagatgagagacacaaagtatctaaaaatctacttttctaccggtgcactttcaggtttattcaaattacagagaatgccaggcgtgattctccagccgagtctatgaaaaacaagaaaaagaaaagcttagcacttcttaatgtgtgcgcagccagacacaatgacaggcttgatgttttctctgtgaaatgagttatgagtcatctgactcatctgacaagggaatctgttgagatggaaaaaacaaaatatatgagtgatcagtgatgcaaataaagcaacaccgtcacgggccttgccctgg

SEQ ID NO: 88 - DNA, 3790 bp, Homo sapiens
agtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaagcctacaagcaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcagctcaaacctggcaaagaagataagcttttcaggaaaaagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgcttctttgttgggaagggtctttgggctccagttttggggaatatgtgaaccacaagccaggaagaatgctggctgggcatgaatgagcctccaaagagggcccaaattagtacccaaagacaactcagaaaaggagccagctgggcctccaggtctcacttcacaccaagtgctgccttaccaccgacagactgcaataaggtcactgatcagtgcctgtccttcttcaaacgctgtggaaacatctgtcatattgacctgaggtactgcaagcaagtcaccaaggaaggctgtgagcagttcatagccgagatgtcttctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaaccactcttgaactttgagggtttctgttctaggagtggactagaagtttaagcccagagtcagtaaacactgttttgaagtccaaaca

SEQ ID NO: 89 - DNA, 4833 bp, Homo sapiens
tgagtttgagtcaagctccgagtcctcgccctcatcctcggaggatgaggaggaggtagtggccagggaagaggaggaagaagaggaggaggaggagatggtggccgaggaaagcatggcttctgcaggccctgaggactttgagcaggacggggaggaagcggctctggccccgggggcacctgcagtggactcgttgggcatggaagaggaggtggacatcgagactgaggctgtggcccctgaggagcggccctccatgctggacgagccccccttgcctgtgggtgttgaagagccagcggactccagggagccgcctgaggaaccaggcctgagccaggaaggggccatgttgctgtctccagagccccctgccaaggaggtggaggctcgacccccattgtcccctgagcgagctccagaacatgacctggaagtggagccggagccccctatgatgctccccttgccgctgcaaccaccattgccgcccccacgaccaccccggccacccagcccaccgccggagcctgagaccacagatgcctcacacccatctgtccctccggagccccttgccgaggaccaccccccgcatactccaggcctctgtggcagcctggccaagtcgcagagcacagagacggtgccagccacaccaggcggggagcccccgctatcagggggcagcagtggcctgtccctgagctctccgcaagtgcccggcagccccttctcctacccagccccgtcccctagcttgagcagtgggggcctccctcggacacctggccgggacttcagcttcacacccaccttctccgagcccagcgggcccttgctcctgcccgtctgcccactccccactggccgacgcgatgaacgctccgggcccctggcctccccggtgctcctggagacgggcctgcccctccctctgccccttcccctgcccttgcccttggcattgcccgccgtcttgcgggcccaggctcgtgcgcccaccccgctgccacccctgctgcccgcccccctggcctcttgccctcccccaatgaagaggaagccgggccggccccggcgatccccaccatctatgctctccttggatgggcccttggtccgaccaccagcaggggccgcccttggaagggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcaggctcgcccgaactctcgccaccccagcccctcttccggccccgctcggagtttgaggagatgaccatcctgtatgacatctggaacggtggcatcgatgaggaggacatccgcttcctgtgtgtcacctacgagcgactgctacagcaggacaatggcatggactggcttaacgacacgctctgggtctaccatccctccaccagcctctcttcagctaagaagaagaaacgggacgatggcatccgcgagcacgtgacgggctgtgcccgcagtgagggcttctacaccatcgacaagaaggacaagctcagatacctcaacagcagccgtgccagcaccgatgagccccccgcagacacccagggcatgagcatcccagcacagccccacgcctccacccgggcaggctcggagcggcgttcggagcagcgccgcctgctgtcctccttcactggcagctgtgacagtgacctgctcaagttcaaccagctcaagttccggaagaaaaagctcaagttctgcaagagccacattcacgactggggcttgttcgccatggagcccatcgcggctgacgagatggtcatcgagtacgtgggccagaatatccgtcaggtgatcgcagacatgcgggagaagcgttatgaggacgagggcatcgggagcagctacatgttccgggtggaccatgacaccatcatcgacgccaccaagtgcggcaacttcgcgcgcttcatcaaccacagctgcaaccccaactgctatgccaaggtgatcacggtggagtcacagaagaagatagtcatctactcgaagcagcacattaacgtcaatgaggagattacctatgactataagttccccatcgaggacgtcaagatcccctgcctctgtggctccgagaactgccgggggaccctcaactaggccccggcaccagactcaaaggatgtcagccgtagccctgggactcccgagcgtggagcccctggccccggggcccggccccccgcgcccgcccccatttcaggtgctgtcctctacccagcggccattcagggcctggcgccccacactaccccctggagcccctggctccggcccctccgcgggaaagggcttctctgtcgttcagcccacgtctctctcattttaacaaacgcccctttcaggatttctgtttaactccagcatcagcttctctctctccgtctctcctcccctctctctcttctctgtctcttctctctcccaccatcaccctcggcctcttcctgtgaatgctgctacgttgttttgtcttctctatttttttcctcgttgtgagaaaagacatttaaccgttgaaatgtgaaggtggaatcagagaggggccccgcgggggtctgcagaggcctcagtgtggctgtgcgtggcccgtgtcctggaagccacccggacctggacgcagggccaggtgctgtgggaaggatggaggcccccacggccttgacctcagaacactacgccctgaaagcgcccctcactgcccgtgggcacagtgaggagaccccacacctttccccacccgagctgcagcctgttccttccccagaggcctggggcaccactgacccggtggaccctgatggagctaagctgtcccaggcaggggtctccgctctgggctttccctgccacctcacaccccagcaccccctaaaccttgggttcaatgtttactttctcattcggatgccagcaacgcgggagcctctcggaggccccagtgcaggtgaggggcgctgagaacgcgggcagccactctcttctgcccttgccttcgccctgggtgggacagggctcccaagggcaggcgggtcccccagtcccgccattacgggttgtcagaccgtctgcgtgtggcattttttggcttataagcttcacccactcacccccaacccacaccccacatccccctaccggcagcccctcaacctaagaaggccagagcatatttattttcggagggagcagattacttctcccagagaaaggaaaatcttggaaaagatttaaaaacacaaatctaagccttgacggtttttttttcccttttgacccccttcccatctcttcagaatttattcccatggcttttttttttcttgtgcgtgtataaaatcaaaaggaaggggaaaaaggtttttgaagttcagaaccaacttctgtatatagaggctgccgcaaaggactttctcttgggaacattgtttcttgtagaaacatgcgggaagacattttttgctcatttctttgtacttccaaaaaaaaaggaaaaaaaagacaaaagcaagtccccccgtaccccagaaagcagaggaggcgtgtaaataatttctggaaagtgactgttgtgacccggagtcctcatcaagatgagcgcgctccatgagggagctgctcccaccctgcggacgcaggcggccggagcctctggtatctcagcttgtgtcaagcttgttatcatgtaaattctgtacaaagaattgttatttttctcttttttgttgttggtggttttgttgtgtgttttttgttgtttttttttttattcctttcccccaggccctctctatttgagactgtgcccgccggtttcaagatcaaggaaattggtggcaacaagacacagatggggtacctgggcacagcggcgaacttctcttccgtttgcggttttctgcctaattgtgcaactgaggaaataatttatttttcacatgaggaaatgcgtagcttgtagagacggctgattcaagttacatgtacagcctccaaagggctgtctccattctgtccccttcccataaaagaagtgggggtgttcgagaagaccagggaagggacccttgcctcacccctccccctggcctcaccttgctcccagccatcgtgcccagtgttaacctcggctggccttcactaaggggactagacctccctctccccaggagccccagccccagagtggtttgcaataaccaagatatgtgtcgagtcatttttctttcaactccctcatttttcattgaacaaatctctgcttttcaagagttgggggtttctgctattttttgctttctctccctccccctgcaaagatgagaaccaatgagttttagggatgtttgtgcgggtagactccatcatccatatgtaacttgttttgaagagaagtgtttccgttgtgtgtcttgatgtaaatatttgttcatatttttgtgaattcaatactatgtaccattgtattatagtaacttttataaagcaaaccataaatatactgacttttcttacag

SEQ ID NO: 90 - DNA, 3254 bp, Homo sapiens
tcgaaacagctgccggctggtcccggccgaggccggcgcagggagggaggagccgcccgggctgtgggggcgccgcgagctgggccggcctcggtgtgcccgcgccgccagcccgctccagacgcgccacctgggcgctccaagaagaggccgaagtttgccgcggccgtgagttggagctcgcgccgggccgctgcgccgggagctccgggggcttccctcgcttcccggtattgtttgcaaactttgctgctctccgccgcggcccccaactcggcggacgccgggcgcggagagccgagccgggggcgctgtgcgcagcgctcgggccaggccgggcgggcatgggcgggggcccgagcaggggtggagagccggggccagcagcagcccgtgcccgggagcggcggcgctgaggggcgcggagctccccgcgaggacacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttcttttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccstaaatatacatctgtgtatttgagttggctttgctacccatttacaaataagaggacagataactgctttgcaaattcaagagcctcccctgggttaacaaatgagccatccccagggcccacccccaggaaggccacagtgctgggcggcatccctgcagaggaaagacaggacccggggcccgcctcacaccccagtggatttggagttgcttaaaatagactccggccttcaccaatagtctctctgcaagacagaaacctccatcaaacctcacatttgtgaactcaaacgatgtgcaatacatttttttctctttccttgaaaataaaaagagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttccacaaacagatcaggaagcactaggttggcagagacactttgtctagtgtattctcttcacagtgccaggaaagagtggtttctgcgtgtgtatatttgtaatatatgatatttttcatgctccactattttattaaaaataaaatatgttctttagtttgctgct

SEQ ID NO: 91 - DNA, 3012 bp, Homo sapiens
ggcacgaggctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttgtgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagccaaaaaaaaaaaaaaaaaaaa

SEQ ID NO: 92 - DNA, 694 bp, Homo sapiens
ctggcctccaactttgtttctcgctatcctctccgccggtgccccctttcccggcggaccccgggatggtccccggcaccccgaggacgccgaggttacgggaagttcggggactggcgggagaaggggttagggggtggtccgcggcgaggggcgcggggtgcatcttctcttccttttatgggctgccacacttgtgtatcccttcttccttgaatttaaccaggagtgagcagtggacagcttcttccctatgagaaggaggtgaagcaggacctgaaatcccgtgctcagctcccacatcccccgtgtccaggacaagtcctttgctgaatcagcggcagacaccacccggagccctgcgggagcctttccctgttcttccagcatggatctgaaactcccttcccactttctgcagcctcccagagatagttcaggctccagcctcatgtgatagcatgaagagaaactggttccaacagctgtgtgctctgctgccctcatcccaaacaacagtttaaatgcacaattacgcttttctctaaggcccaaaataggataggaaagatcgttttgctatccctgaatgcctgtcacccttgtttcgtaaggtaagattgggaagggcttggccattgcccttgcggctgagaaaccaactttaggaataaagacactctctccatgtctg

SEQ ID NO: 93 - protein, 388 aa, Homo sapiens
TSCPRPLQEGTPGSRAAHVVSRKGPGSTSCPRPLQERTRVHELATSSAGRDPGSTSCPRPLQEGTPGSRAAHVLSRKGPRVHELPTSSPGRDPGSTNCPRPLQEGTPGSRAAHVLSRRGHRVHELPTPSPGRDPGFMSCPRPLQEGTRVHELPTPSPGGDPGPRAAHVVNGKGPGSTSCPRPLQEGTRVHELPTRSPGGDTGFTSCPRPLQEGTPGSRAAHVLSRRGHRVHELPTSSPGGDTGFTSCPRPLQEGTPGSRAAHVLSRKGPGSTSCPRPLQEGTPGSRAAHALSRKGPRVQVSCRPTSCLCVNQKKDEEQALLSLQAGFGGGAGSPAAPSLAGHPVLEPQNCRRPAEKGSMMAPRCAALDLPPWTWRQGFSSLARLVSNS

SEQ ID NO: 94 - protein, 435 aa, Homo sapiens
TSCPRPLQEGTPGSRAAHVVSRKGPGSTSCPRPLQERTRVHELATSSAGRDPGSTSCPRPLQEGTPGSRAAHVLSRKGPRVHELPTSSPGRDPGSTNCPRPLQEGTPGSRAAHVLSRRGHRVHELPTPSPGRDPGFMSCPRPLQEGTRVHELPTPSPGGDPGPRAAHVVNGKGPGSTSCPRPLQEGTRVHELPTRSPGGDTGFTSCPRPLQEGTPGSRAAHVLSRRGHRVHELPTSSPGGDTGFTSCPRPLQEGTPGSRAAHVLSRKGPGSTSCPRPLQEGTPGSRAAHALSRKGPRVQVSCRPTSCLCVNQKKDEEQALLSLQAGFGGGAGSPAAPSLAGHPVLEPQNCRRPAEKGSMMAPRCAALDLPPWTWEPPGSSHSGKEGSGHGGRPGPIPVPWPFFLLPVCHCPGAFAPAFPLSRQGFSSLARLVSNS

SEQ ID NO: 95 - protein, 414 aa, Homo sapiens
TSCPRPLQEGTPGSRAAHVVSRKGPGSTSCPRPLQERTRVHELATSSAGRDPGSTSCPRPLQEGTPGSRAAHVLSRKGPRVHELPTSSPGRDPGSTNCPRPLQEGTPGSRAAHVLSRRGHRVHELPTPSPGRDPGFMSCPRPLQEGTRVHELPTPSPGGDPGPRAAHVVNGKGPGSTSCPRPLQEGTRVHELPTRSPGGDTGFTSCPRPLQEGTPGSRAAHVLSRRGHRVHELPTSSPGGDTGFTSCPRPLQEGTPGSRAAHVLSRKGPGSTSCPRPLQEGTPGSRAAHALSRKGPRVQVSCRPTSCLCVNQKKDEEQALLSLQAGFGGGAGSPAAPSLAGHPVLEPQNCRRPAEKGSMMAPRCAALDLPPWTWMPVMPEVCRAVHTLTAWPLRSLCLTPKSAPQLPVTGSLLP

SEQ ID NO: 96 - protein, 396 aa, Homo sapiens
TSCPRPLQEGTPGSRAAHVVSRKGPGSTSCPRPLQERTRVHELATSSAGRDPGSTSCPRPLQEGTPGSRAAHVLSRKGPRVHELPTSSPGRDPGSTNCPRPLQEGTPGSRAAHVLSRRGHRVHELPTPSPGRDPGFMSCPRPLQEGTRVHELPTPSPGGDPGPRAAHVVNGKGPGSTSCPRPLQEGTRVHELPTRSPGGDTGFTSCPRPLQEGTPGSRAAHVLSRRGHRVHELPTSSPGGDTGFTSCPRPLQEGTPGSRAAHVLSRKGPGSTSCPRPLQEGTPGSRAAHALSRKGPRVQVSCRPTSCLCVNQKKDEEQALLSLQAGFGGGAGSPAAPSLAGHPVLEPQNCRRPAEKGSMMAPRCAALDLPPWTWEPPGSSHSGKEGSGHGALLRYS

SEQ ID NO: 97 - protein, 449 aa, Homo sapiens
TSCPRPLQEGTPGSRAAHVVSRKGPGSTSCPRPLQERTRVHELATSSAGRDPGSTSCPRPLQEGTPGSRAAHVLSRKGPRVHELPTSSPGRDPGSTNCPRPLQEGTPGSRAAHVLSRRGHRVHELPTPSPGRDPGFMSCPRPLQEGTRVHELPTPSPGGDPGPRAAHVVNGKGPGSTSCPRPLQEGTRVHELPTRSPGGDTGFTSCPRPLQEGTPGSRAAHVLSRRGHRVHELPTSSPGGDTGFTSCPRPLQEGTPGSRAAHVLSRKGPGSTSCPRPLQEGTPGSRAAHALSRKGPRVQVSCRPTSCLCVNQKKDEEQALLSLQAGFGGGAGSPAAPSLAGHPVLEPQNCRRPAEKGSMMAPRCAALDLPPWTWEPPGSSHSGKEGSGHGGRPGPIPVPWPFFLLPVCHCPGAFAPAFPLSVSVLGPVTHVTVPGYLFFSFSLSSFIEV

SEQ ID NO: 98 - protein, 371 aa, Homo sapiens
MEDEDYNTSISYGDEYPDYLDSIVVLEDLSPLEARVTRIFLVVVYSIVCFLGILGNGLVIIIATFKMKKTVNMVWFLNLAVADFLFNVFLPIHITYAAMDYHWVFGTAMCKISNFLLIHNMFTSVFLLTIISSDRCISVLLPVWSQNHRSVRLAYMACMVIWVLAFFLSSPSLVFRDTANLHGKISCFNNFSLSTPGSSSWPTHSQMDPVGYSRHMVVTVTRFLCGFLVPVLIITACYLTIVCKLHRNRLAKTKKPFKIIVTIIITFFLCWCPYHTLNLLELHHTAMPGSVFSLGLPLATALAIANSCMNPILYVFMGQDFKKFKVALFSRLVNALSEDTGHSSYPSHRSFTKMSSMNERTSMNERETGML

SEQ ID NO: 99 - protein, 1430 aa, Homo sapiens [sequence omitted]

SEQ ID NO: 100 - protein, 375 aa, Homo sapiens
RKZGAGWQGGDPPRLLPPPPPPPLLVAWERRCESRARAAAAPLREGRRWEGDGGFRZTQHRQHYPTAAGSERVQAWZECPASGEZNQRTVLKVSZNLSQSAYPTRTZSTTQNMWZHPWTILZFAATFZVRWFPTRKQLPVSWGLCGQGKAVIGDDLPLTGLQNKISZEFFSSQREPZMCQHQQNLWILZZMZKKIQHZTMENFHRLFZLFTDSSHRGZEDILLSWRFITRSSIYGADSANYATNZCTRSRSSLZSFVVZPRZRCLRLGZKZQRSVLHIWCRSGCKISPZAZFGSYMZSPSGGZRWIZIFCKEAVGHSVFCAQLLRRVZQCRCHDECGZNTNVFFSDFKACREKEAKCHETCNASKGYDHKASKEI

SEQ ID NO: 101 - protein, 633 aa, Homo sapiens
APLERAASEEPAGGRGRAQGGGPPAPSGFRGPGGARRHGPAGPRAPVSQPGRTTWVSAMNGPALQPSSPSSAPSASPAAAPRGWSEFCELHAVAAARELARQYWLFAREHPQHAPLRAELVSLQFTDLFQRYFCREVRDGRAPGRDYRDTGRGPPAKAEASPEPGPGPAAPGLPKARSSEELAPPRPPGPCSFQHFRRSLRHIFRRRSAGELPAAHTAAAPGTPGEAAETPARPGLAKKFLPWSLAREPPPEALKEAVLRYSLADEASMDSGARWQRGRLALRRAPGPDGPDRVLELFDPPKSSRPKLQAACSSIQEVRWCTRLEMPDNLYTFVLKVKDRTDIIFEVGDEQQLNSWMAELSECTGRGLESTEAEMHIPSALEPSTSSSPRGSTDSLNQGASPGGLLDPACQKTDHFLSCYPWFHGPISRVKAAQLVQLQGPDAHGVFLVRQSETRRGEYVLTFNFQGIAKHLRLSLTERGQCRVQHLHFPSVVDMLHHFQRSPIPLECGAACDVRLSSYVVVVSQPPGSCNTVLFPFSLPHWDSESLPHWGSELGLPHLSSSGCPRGLSPEGLPGRSSPPEQIFHLVPSPEELANSLQHLEHEPVNRARDSDYEMDSSSRSHLRAIDNQYTPL

SEQ ID NO: 102 - protein, 471 aa, Homo sapiens [sequence omitted]

SEQ ID NO: 103 - protein, 593 aa, Homo sapiens [sequence omitted]

SEQ ID NO: 104 - protein, 582 aa, Homo sapiens
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIKGAADEIMLPCEFCEELYPEELLIDHQTSCNPSRALPSLNTGSSSPRGVEEPDVIFQNFLQQAASNQLDSLMGLSNSHPVEESIIIPCEFCGVQLEEEVLFHHQDQCDQRPATATNHVTEGIPRLDSQPQETSPELPRRRVRHQGDLSSGYLDDTKQETANGPTSCLPPSRPINNMTATYNQLSRSTSGPRPGCQPSSPCVPKLSNSDSQDIQGRNRDSQNGAIAPGHVSVIRPPQNLYPENIVPSFSPGPSGRYGASGRSEGGRNSRVTPAAANYRSRTAKAKPSKQQGAGDAEEEEEE

SEQ ID NO: 105 - protein, 605 aa, Homo sapiens [sequence omitted]

SEQ ID NO: 106 - protein, 557 aa, Homo sapiens
MDDLDALLADLESTTSHISKRPVFLSEETPYSYPTGNHTYQEIAVPPPVPPPPSSEALNGTILDPLDQWQPSGSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 107 - protein, 343 aa, Homo sapiens
MDDLDALLADLESTTSHISKRPVFLSEETPYSYPTGNHTYQEIAVPPPVPPPPSSEALNGTILDPLDQWQPSGSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKDPGPGAKSGWGAVLGGRLASGRRAEQPRRAGRGRVHGPGEDREQLTPWGAPEAREPAGQHAGEPAV

SEQ ID NO: 108 - protein, 148 aa, Homo sapiens
MKLLVLAVLLTVAAADSGISPRAVWQFRKMIKCVIPGSDPFLEYNNYGCYCGLGGSGTPVDELDKCCQTHDNCYDQAKKLDSCKFLLDNPYTHTYSYSCSGSAITCSSKNKECEAFICNCDRNAAICFSKAPYNKAHKNLDTKKYCQS

SEQ ID NO: 109 - protein, 388 aa, Homo sapiens
MAGCCPRWRPSCSSTTRRASCSSAAAKWGSZTAPCNCSSWPTSSGGCLCGKRATRKLTPWSAPLRPRSRAWLZPTLLNLDSGSGMWRIMZYQLRRKTPSSSZPTZSSPZTRHRACAPRFQMRPLCVNQMPAVLPALPAPTATESQQAGAZLSTGPSRRVRWRPGARWRMTHTCHNLLFZRLQKTSLFWLRTTSGIPNLISARGISFPTSPLLTSSRAFMMLKQIPSAPYSVLAKZWRTQDTVSRTWPWREASWASRSTGTATWTEPPPSACPGTPSAASIHGTLSTTYLLATISGLPSTTETWLATSSARSSRPMASASTSLCLGRQGNLTSSPLZSTSALAWHCZAWRPCCVTSZSSTAZRKDSTIGRRNINMWKITSRVLLVSWTS

SEQ ID NO: 110 - protein, 404 aa, Homo sapiens
MAGCCAALAAFLFEYDTPRIVLIRSRKVGLMNRAVQLLILAYVIGCYHLHLAEVEMESPRRWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRCVAFNGSSRRVRWRPGARWRMTHTCHNLLFZRLQKTSLFWLRTTSGIPNLISARGISFPTSPLLTSSRAFMMLKQIPSAPYSVLAKZWRTQDTVSRTWPWREASWASRSTGTATWTEPPPSACPGTPSAASIHGTLSTTYLLATISGLPSTTETWLATSSARSSRPMASASTSLCLGRQGNLTSSPLZSTSALAWHCZAWRPCCVTSZSSTAZRKDSTIGRRNINMWKITSRVLLVSWTS

SEQ ID NO: 111 - protein, 595 aa, Homo sapiens [sequence omitted]

SEQ ID NO: 112 - protein, 387 aa, Homo sapiens
MNRHHLQDHFLEIDKKNCCVFRDDFIAKVLPPVLGLEFIFGLLGNGLALWIFCFHLKSWKSSRIFLFNLAVADFLLIICLPFVMDYYVRRSDWNFGDIPCRLVLFMFAMNRQGSIIFLTVVAVDRYFRVVHPHHALNKISNWTAAIISCLLWGITVGLTVHLLKKKLLIQNGPANVCISFSICHTFRWHEAMFLLEFLLPLGIILFCSARIIWSLRQRQMDRHAKIKRAITFIMVVAIVFVICFLPSVVVRIRIFWLLHTSGTQNCEVYRSVDLAFFITLSFTYMNSMLDPVVYYFSSPSFPNFFSTLINRCLQRKMTGEPDNNRSTSVELTGDPNKTRGAPEALMANSGEPWSPSYLGPTSNNHSKKGHCHQEPASLEKQLGCCIE

SEQ ID NO: 113 - protein, 331 aa, Homo sapiens
MTSPHFSSYDEGPLDVSMAATNLENQLHSAQKNLLFLQREHASTLKGLHSEIRRLQQHCTDLTYELTVKSSEQTGDGTSKSSELKKRCEELEAQLKVKENENAELLKELEQKNAMITVLENTIKEREKKYLEELKAKSHKLTLLSSELEQRASTIAYLTSQLHAAKKKLMSSSGTSDASPSGSPVLASYKPAPPKDKLPETPRRRMKKSLSAPLHPEFEEVYRFGAESRKLLLREPVDAMPDPTPFLLARESAEVHLIKERPLVIPPIASDRSGEQHSPAREKPHKAHVGVAHRIHHATPPQAQPEVKTLAVDQVNGGKVVRKHSGTDRTV

SEQ ID NO: 114 - protein, 1371 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGVZMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 115 - protein, 509 aa, Homo sapiens
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYRESRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQEKCYLFWSSSKKGSKDKEAIQAYSESLMTSAPKGSVLQEAKL

SEQ ID NO: 116 - protein, 672 aa, Homo sapiens
MSKEERPGREEILECQVMWEPDSKKNTQMDRFRAAVGAACGLALESYDDLYHWSVESYSDFWAEFWKFSEIVFSRVYDEVVDTSKGIADVPEWFKGSRLNYAENLLRHKENDRVALYIAREGKEEIVEVTFEELRQEVALFAAAMRKMGVKKGDRVVGYLPNSEHAVEAMLAAASIGAIWSSTSPDFGVNGVLDRFSQIQPKLIFSVEAVVYNGKEHNHMEKLQQVVKGLPDLKKVVVIPYVSSRENIDLSKIPNSVFLDDFLATGTSEQAPQLEFEQLPFSHPLFIMFSSGTTGAPKCMVHSAGGTLIQHLKEHLLHGNMTSSDILLCYTTVGWMMWNWMVSLLATGAAMVLYDGSPLVPTPNVLWDLVDRIGITVLVTGAKWLSVLEEKAMKPVETHSLQMLHTILSTGSPLKAQSYEYVYRCIKSSILLGSISGGTDIISCFMGHNFSLPVYKGEIQARNLGMAVEAWNEEGKAVWGESGELVCTKPIPCQPTHFWNDENGNKYRKAYFSKFPGIGLMATTAESTPRPGASSCLAGVTAPSTPTGCGSAARKSITLWNPSRRWRTACVSPSITSTGRRGZSSSZRWPPGTPSSLTWLRGSVTPSAWACLRDTCPASSWKPRASRIRSTARKWKLPSNRSSLEKPWSKEVLSRTPRPWICTGTSLSCRAS

SEQ ID NO: 117 - protein, 317 aa, Homo sapiens
RHIERNRRCPRVVQRQSAQLCRKPPAAQREZQSCPLHCKGRQRGNCEGDFZRAEARSGFVCSSNEENGCEERRSGCWLFTQQZARCRGDAGCGKHWCHLELHVPGLRZEWCAGPVFSNSAKAHLLCGGCCLZWQRAQPHGKAAAGGZRPTRLEESGGDSLCVLQREHRPFKDSKQCVSGZLSCHRHQZAGPAAGVRAAALQPPTVHHVLIGHHGRTQVHGAFRWGHPHPASEGAPAARQHDQQZHPPVLHHGRLDDVELDGVPSGHRSGHGLVRWLPPGAHAQCALGPGZQDRVSGLMATTAESTPRPGASSCLAGV

SEQ ID NO: 118 - protein, 202 aa, Homo sapiens
MVTLAELLVLLAALLATVSGYFVSIDAHAEECFFERVTSGTKMGLIFEVAEGGFLDIDVEITGPDNKGIYKGDRESSGKYTFAAHMDGTYKFCFSNRMSTMTPKIVMFTIDIGEAPKGQDMETEAHQNKLEEMINELAVAMTAVKHEQEYMEVRERIHRAINDNTNSRVVLWSFFEALVLVAMTLGQIYYLKRFFEVRRVVG

SEQ ID NO: 119 - protein, 431 aa, Homo sapiens
ERSYACSVLGRLNLSKTHDSSRQRLYNTRGKSLTQNSAPSRSYLRKNPDKFHGYEEPYFLKHQRAHSIEKNCVCSECGKAFRCKSQLIVHLRIHTGERPYECSKCERAFSAKSNLNAHQRVHTGEKPYSCSECEKVFSFRSQLIVHQEIHTGGKPYGCSGCGKAYSWKSQLLLHQRSHTGVKPYECSECGKAFSLKSPFVVHQRTHTGVKPHKCSECGKAFRSKSYLHVHIRMHTGEKPYQCSDCGKAFNMKTQLIVHQGVHTGNNPYQCGECGKAFGRKEQLTAHLRAHAGEKPYGCSECGKAFSSKSYLVIHRRTHTGERPYECSLCERAFCGKSQLIIHQRTHSTEKPYECNECEKAYPRKASLQIHQKTHSGEKPFKCSECGKAFTQKSSLSEHQRVHTGEKPWKCSECGKSFCWNSGLRIHRKTHK

SEQ ID NO: 120 - protein, 108 aa, Homo sapiens
MDEAWEQKPVHLALCMGTCWSRPWAPHPATATGHPGVHHRRQGHGPGGRAEGGESSRLEKRSVFLERSSAGQYAASDEEDAYDSPDFKRRGASVDDFLKGSELGKQGN

SEQ ID NO: 121 - protein, 686 aa, Homo sapiens
MREAAERRQQLQLEHDQALAVLSAKQQEIDLLQKSKVRELEEKCRTQSEQFNLLSRDLEKFRQHAGKIDLLGGSAVAPLDISTAPSKPFPQFMNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQKPVHLALCMGTCWSRPWAPEGGRPHPAASCPATGHPGVHHRRQGHGPGGRAEGGREQQV

SEQ ID NO: 122 - protein, 2517 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWKQKFCQRYDQLMEALEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPRRTSRAPIEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTMREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNTATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSKPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 123 - protein, 496 aa, Homo sapiens
MGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCGGLAFVVFLCGKSVFITKPPEGSAFTDMFKILTYSCCSQKRSGERQSNGEGIGVFQQSSKQSLFDSCKMSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFLLLAAIQGATLLLFLIISVKYDHHRDHQRSRANGVPTSRRA

SEQ ID NO: 124 - protein, 504 aa, Homo sapiens
MGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCGGLAFVVFLCGKSVFITKPPEGSAFTDMFKILTYSCCSQKRSGERQSNGEGIGVFQQSSKQSLFDSCKMSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGDKQASLLIPGAKPALATAQRAAAAATAPYGDVLDRQAPSPRPSSSVFVRQLNLYPKLPFL

SEQ ID NO: 125 - protein, 71 aa, Homo sapiens
FWNVDIQLLQHHLLQQMVLFVHCTAFLLCQRLVDCIFIGLSLGCLFCPTDHSSVFFQCHTVLTTVTFYSKS

SEQ ID NO: 126 - protein, 535 aa, Homo sapiens
MGCDCFVQEVFCSDEELATVPLDIPPYTKNIIFVETSFTTLETRAFGSNPNLTKVVFLDTQLCQFRPDAFGGLPRLEDLEVTGSSFLNLSTNIFSNLTSLGKLTLNFNMLEALPEGLFQHLAALESLHLQGNQLQALPRRLFQPLTHLKTLNLAQNLLAQLPEELFHPLTSLQTLKLSNNALSGLPQGVFGKLGSLQELFLDSNNISELPPQVFSQLFCLERLWLQRNAITHLPLSIFASLGNLTFLSLQWNMLRVLPAGLFAHTPCLVGLSLTHNQLETVTEGTFAHLSNLRSLMLSYNAITHLPAGIFRDLEELVKLYLGSNNLTALHPALFQNLSKLELLSLSKNQLTTLPEASSTPTTTCSTWPCTVTPGSATAPGLPLQLAAAVHRSAPEHPDLLRCPAYLKGQVVHALNEKQLVSVTRDHLGFQVTWPDESKAGGSWDLAVQERAARSQCTYSNPEGTVVLACDQAQCRWLNVQLSPRQGSLGLQYNASQEWDLRRAAVLCGSPCLSRLGQQGPSSSHTGAGEGGLWGG

SEQ ID NO: 127 - protein, 49 aa, Homo sapiens
MDLEVPVLAPEHPPGSLPVVKHESPQGLLFSQSLRSLFIWQRDWLVILH

SEQ ID NO: 128 - protein, 549 aa, Homo sapiens
MTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQQTTTTSQVQVPQIQGQAQSPAQIKAVGKLTPEHLIKMQKQKLQMPPQPPPPQAQSAPPQPAAQVQVQTSQPPQQQSPQLTTVTAPRPGALLTGTTVANLQVARLTRVPTSQLQSQGQMQTQAPQPAQVPLPKPPVVSVPAAVVSSPGVTTLPMNVAGISVAIGQPQKAAGQTVVDPARAHAAAAEAEAAGRPAAEGHPAPGCTGPGSRPAEDHRTADHHPWRAAEGCLRRAAAL

SEQ ID NO: 129 - protein, 1050 aa, Homo sapiens
MEPGRGGTETVGKFEFSRKDLIGHGAFAVVFKGRHREKHDLEVAVKCINKKNLAKSQTLLGKEIKILKELKHENIVALYDFQEMANSVYLVMEYCNGGDLADYLHAMRTLSEDTIRLFLQQIAGAMRLLHSKGIIHRDLKPQNILLSNPAGRRANPNSIRVKIADFGFARYLQSNMMAATLCGSPMYMAPEVIMSQHYDGKADLWSIGTIVYQCLTGKAPFQASSPQDLRLFYEKNKTLVPTIPRETSAPLRQLLLALLQRNHKDRMDFDEFFHHPFLDASPSVRKSPPVPVPSYPSSGSGSSSSSSSTSHLASPPSLGEMQQLQKTLASPADTAGFLHSSRDSGGSKDSSCDTDDFVMVPAQFPGDLVAEAPSAKPPPDSLMCSGSSLVASAGLESHGRTPSPSPPCSSSPSPSGRAGPFSSSRCGASVPIPVPTQVQNYQRIERNLQSPTQFQTPRSSAIRRSGSTSPLGFARASPSPPAHAEHGGVLARKMSLGGGRPYTPSPQVGTIPERPGWSGTPSPQGAEMRGGRSPRPGSSAPEHSPRTSGLGCRLHSAPNLSDLHVVRPKLPKPPTDPLGAVFSPPQASPPQPSHGLQSCRNLRGSPKLPDFLQRNPLPPILGSPTKAVPSFDFPKTPSSQNLLALLARQGVVMTPPRNRTLPDLSEVGPFHGQPLGPGLRPGEDPKGPFGRSFSTSRLTDLLLKAAFGTQAPDPGSTESLQEKPMEIAPSAGFGGSLHPGARAGGTSSPSPVVFTVGSPPSGSTPPQGPRTRMFSAGPTGSASSSARHLVPGPCSEAPAPELPAPGHGCSFADPIAANLEGAVTFEAPDLPEETLMEQEHTEILRGLRFTLLFVQHVLEIAALKGSASEAAGGPEYQLQESVVADQISLLSREWGFAEQLVLYLKVAELLSSGLQSAIDQIRAGKLCLSSTVKQVVRRLNELYKASVVSCQGLSLRLQRFFLDKQRLLDRIHSITAERLIFSHAVQMVQSAALDEMFQHREGCVPRYHKALLLLEGLQHMLSDQADIENVTKCKLCIERRLSALLTGICA

SEQ ID NO: 130 - protein, 409 aa, Homo sapiens
LAPLPLPSPTSPGFQFSAQPRRFEHGSPSYIQVTSPLSQQVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHHQEMQALKEVFKEYLIELFFLQHFQGNMMDFLAFKERLYGPLQAYLRQNDLDIEEEEEEHFEVINDEVKVVARKHGQPGTPVAIATQLPPRTSAAFPAQQQPLQVLSDGSTVQLPRLSSLGFEDSMC

SEQ ID NO: 131 - protein, 399 aa, Homo sapiens
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKGVSAAGQVVSLKVWLIDDILEKINSHLPSHIRILGLKRVTGGFNSKNRCDARTYCYLLPTFAFAHKDRDVQDETYRLSAETLQQVNRLLACYKGTHNFHNFTSQKGPQDPSACRYILEMYCEEPFVREGLEFAVIRVKGQSFMMHQIRKMVGLVVAIVKGYAPESVLERSWGTEKVDVPKAPGLGLVLERVHFEKYNQRFGNDGLHEPLDWAQEEGKVAAFKEEHIYPTIIGTERDERSMAQWLSTLPIHNFSATALTAGGTGAKVPSPLEGSEGDGDTD

SEQ ID NO: 132 - protein, 469 aa, Homo sapiens
PIEDIPDVHPDLQKQLRAHGISSYFPVQAAVIPALLESAACGFLVGRGGYRPSDLCVSAPTSSGKTLAFVIPVVQALLSRVVCHIRALVVLPTKELARQVSKVFNIYTDATPLRVSLVTGQKSLVKEQESLVQKTADGYRCLADIVVATPGRLVDHIDQTPGFSLQQLRFLIIDEADRMIDSMHQSWLPRVVAAAFQSEDPADPCALLQRRQAQAVTAASTCCPQMPLQKLLFSATLTQNPEKLQQLGLHQPRLFSTGLAHRGLEDTDGDGDSGKYAFPVGLTHHYVPCSLSSKPLVVLHLVLEMGFSRVLCFTNSRENSHRLFLLVQAFGGVDVAEFSSRYGPGQRRMILKQFEQGKIQLLISTDATARGIDVQGVELVVNYDAPQYLRTYVHRVGRTARAGKTGQAFTLLLKVQERRFLRMLTEAGAPELQRHELSSKLLQPLVPRYEEALSQLEESVKEEPKQRAA

SEQ ID NO: 133 - protein, 389 aa, Homo sapiens
MTQSQISFEDVAVDFTLEEWQLLNPTQKNLYRDVMLENYSNLVFLEVWLDNPKMWLRDNQDNLKSMERGHKYDVFGKIFNSSINIVHVGLRSHKCGTGEKSLKCPFDLLIPKNNCERKKIDELNKKLLFCIKPGRTHGGIKYCDCSTCRKSSNEEPWLTANHITHTGVYLCMECGRFFNKKSQLVIHQRTHTGEKPYQCSECGKAFSQKSLLTVHQRTHSGEKPHGCSECQKAFSRKSLLILHQRIHTGEKPYGCSECGKAFSRKSQLKRHQITHTIEKPYSCSECGKAFSQKLKLITHQRAHTGEKPYPCSHCGKAFFWKSQLITHQRTHTGKKPYGCGECQKAFSRNSLLIRHQRIHTGEKPYECNECGEAFIRKPQLIKHQITHTG

SEQ ID NO: 134 - protein, 2234 aa, Homo sapiens
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIGLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLEDVPSRIECPLIYHLDVGAMYPNIILTNRLQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKKLLEKNDVYKQKKISELFTLEGRRQVTMAEASEDSPRPSAPDMEDFGLVKLPHPAAPVTVKRKRVLWESQEESQDLTPTVPWQEILGQPPALGTSQEEWLVWLRFHKKKWQLQARQRLARRKRQRLESAEGVLRPGAIRDGPATGLGSFLRRTARSILDLPWQIVQISETSQAGLFRLWALVGSDLHCIRLSIPRVFYVNQRVAKAEEGASYRKVNRVLPRSNMVYNLYEYSVPEDMYQEHINEINAELSAPDIEGVYETQVPLLFRALVHLGCVCVVNKQLVRHLSGWEAETFALEHLEMRSLAQFSYLEPGSIRHIYLYHHAQAHKALFGIFIPSQRRASVFVLDTVRSNQMPSLGALYSAEHGLLLEKVGPELLPPPKHTFEVRAETDLKTICRAIQRFLLAYKEERRGPTLIAVQSSWELKRLASEIPVLEEFPLVPICVADKINYGVLDWQRHGARRMIRHYLNLDTCLSQAFEMSRYFHIPIGNLPEDISTFGSDLFFARHLQRHNHLLWLSPTARPDLGGKEADDNCLVMEFDDQATVEINSSGCYSTVCVELDLQNLAVNTILQSHHVNDMEGADSMGISFDVIQQASLEDMITGGQAASAPASYDETALCSNTFRILKSMVVGWVKEITQYHNIYADNQVMHFYRWLRSPSSLLHDPALHRTLHNMMKKLFLQLIAEFKRLGSSVIYANFNRIILCTKKRRVEDAIAYVEYITSSIHSKETFHSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGMITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLVCLKCRGVKETSMPV

SEQ ID NO: 135 - protein, 939 aa, Homo sapiens
MLWPRLAAAEWAALAWELLGASVLLIAVRWLVRRLGPRPGGLGRSGTPVPPPSAAAAPASGEMTMDALLARLKLLNPDDLREEIVKAGLKCGPITSTTRFIFEKKLAQALLEQGGRLSSFYHHEAGVTALSQDPQRILKPAEGNPTDQAGFSEDRDFGYSVGLNPPEEEAVTSKTCSVPPSDTDTYRAGATASKEPPLYYGVCPVYEDVPARNERIYVYENKKEALQAVKMIKGSRFKAFSTREDAEKFARGICDYFPSPSKTSLPLSPVKTAPLFSNDRLKDGLCLSESETVNKERANSYKNPRTQDLTAKLRKAVEKGEEDTFSDLIWSNPRYLIGSGDNPTIVQEGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDVICERSKNKSVELKERIREYLKGHYYVPLLRAEETSSPVIGELWSPDQTAEASHVSRYGGSPRDPVLTLRAFAGPLSPAKAEDFRKLWKTPPREKAGFLHHVKKSDPERGFERVGRELAHELGYPWVEYWEFLGCFVDLSSQEGLQRLEEYLTQQEIGKKAQQETGEREASCRDKATTSGSNSISVRAFLDEDDMSLEEIKNRQNAARNNSPPTVGAFGHTRCSAFPLEQEADLIEAAEPGGPHSSRNGLCHPLNHSRTLAGKRPKAPHGEEAHLPPVSDLTVEFDKLNLQNIGRSVSKTPDESTKTKDQILTSRINAVERDLLEPSPADQLGNGHRRTESEMSARIAKMSLSPSSPRHEDQLEVTREPARRLFLFGEEPSKLDQDVLAALECADVDPHQFPAVHRWKSAVLCYSPSDRQSWPSPAVKGRFKSQLPDLSGPHSYSPGRNSVAGSNPAKPGLGSPGRYSPVHGSQLRRMARLAELAALZ

SEQ ID NO: 136 - protein, 814 aa, Homo sapiens
PALEKSEAKAGPVPKVSGLERSRELSAESFLPTASPAPHAAPCPGPPPGSRANPLVKKEPPAPHRHTPQPPPPQPRGLLPTHVPASLGAFAGHSQAAANGLHGLSRSSSAPLGLGKHVSLSPHGPGPHLSTSHLALRSQAQHQLHAAMFAAPPTLPPPPALPASSLVLPGHPADHELLRQELNTRFLVQSAERPGASLGPGALLRAEFHQHQHTHQHTHQHTHQHQHTFAPFPAGLPPTPPAAPPPFDKYAPKLDSPYFRHSSVSFFPSFPPAIPGLPTLLPHPGPFGSLQGAFQPKVSDPYRAVVKVSTCWEGPWQGRTLVPPGRPRGARDSRSLQKTWVGVAPAPLSASILSQKPGRWCAVHVQIAWQIYRHQQKIKEMQLDPHKLEVGAKLDLFGRPPAPGVFAGFHYPQDLARPLFPSTGAAHPASNPFGPSAHPGSFLPTGPLTDPFSRPSTFGGLGSLSSHAFGGLGSHALAPGGSIFAPKEGSSVHGLPSPHEAWNRLHRAPPSFPAPPPWPKSVDAERVSALTNHDREPDNGKEEQERDLLEKTRLLSRASPATPAGHPVSGLLLRAQSELGRSGAPAEREAEPRVKESRSPAKEEVAKMPARASPPHSKAAPGDVKVKEERGEDEASEPPAGGLHPAPLQLGLGRERLGAPGFAWEPFRGLELPRRAFPAAAPAPGSAALLEPPERPYRDREPHGYSPERLRGELERARAPHLPPAAPALDGALLPSLGALHFPRLSPAALHNGLLARTPPAAAALGAPPPLVTAAGPPTPPGPPRSRTTPLGGLGPGEARDYSPSRNPPEVEAR

SEQ ID NO: 137 - protein, 1530 aa, Homo sapiens
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGVAGFHDNLRKSQGTSAEGSVRKEALQSLRLSLPMQETQLCSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGILEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGQDEKGAESAGQLFQPCHAHQDPGLPSSRLAAGGAAETTARREQGAPQEPEQLPPAAQAGDGQPAAPDGGARPDGARVSVLVDAAGASHCQPCAPGGSRRPTRRPTETQSEQGFQRRAGRVTAVDSPPCAAAPEGSYQCYLFDCVVDVFLRHEI

SEQ ID NO: 138 - protein, 457 aa, Homo sapiens
MSQGSVTFRDVAIDFSQEEWKWLQPAQRDLYRCVMLENYGHLVSLGLSISKPDVVSLLEQGKEPWLGKREVKRDLFSVSESSGEIKDFSPKNVIYDDSSQYLIMERILSQGPVYSSFKGGWKCKDHTEMLQENQGCIRKVTVSHQEALAQHMNISTVERPYGCHECGKTFGRRFSLVLHQRTHTGEKPYACKECGKTFSQISNLVKHQMIHTGKKPHECKDCNKTFSYLSFLIEHQRTHTGEKPYECTECGKAFSRASNLTRHQRIHIGKKQYICRKCGKAFSSGSELIRHQITHTGEKPYECIECGKAFRRFSHLTRHQSIHTTKTPYECNECRKALRCHSFLIKHQRIHAGEKLYECDECGKVFTWHASLIQHTKSHTGEKPYACAECDKAFSRSFSLILHQRTHTGEKPYVCKVCNKSFSWSSNLAKHQRTHTLDNPYEYENSFNYHSFLTEHQ

SEQ ID NO: 139 - protein, 736 aa, Homo sapiens [sequence omitted]

SEQ ID NO: 140 - protein, 639 aa, Homo sapiens
LTSDAALRAPLVNGVAFSVCCCCCLVTGSLSPIEPSSCLLQLYGGGALSPQHSAVTQGSIIKNKEGMDAKSLTAWSRTLVTFKDVFVDFTREEWKLLDTAQQIVYRNVMLENYKNLVSLGYQLTKPDVILRLEKGEEPWLVEREIHQETHPDSETAFEIKSSVSSRSIFKDKQSCDIKMEGMARNDLWYLSLEEVWKCRDQLDKYQENPERHLRQVAFTQKKVLTQERVSESGKYGGNCLLPAQLVLREYFHKRDSHTKSLKHDLVLNGHQDSCASNSNECGQTFCQNIHLIQFARTHTGDKSYKCPDNDNSLTHGSSLGISKGIHREKPYECKECGKFFSWRSNLTRHQLIHTGEKPYECKECGKSFSRSSHLIGHQKTHTGEEPYECKECGKSFSWFSHLVTHQRTHTGDKLYTCNQCGKSFVHSSRLIRHQRTHTGEKPYECPECGKSFRQSTHLILHQRTHVRVRPYECNECGKSYSQRSHLVVHHRIHTGLKPFECKDCGKCFSRSSHLYSHQRTHTGEKPYECHDCGKSFSQSSALIVHQRIHTGEKPYECCQCGKAFIRKNDLIKHQRIHVGEETYKCNQCGIIFSQNSPFIVHQIAHTGEQFLTCNQCGTALVNTSNLIGYQTNHIRENAY

SEQ ID NO: 141 - protein, 69 aa, Homo sapiens
GQKDQNCILRFEFLSQVMSSSSLAGLFLGASGVKESRFIKNHQLQIIWMETLPNHRDVCYHPHTKQLGN

SEQ ID NO: 142 - protein, 135 aa, Homo sapiens
LGNEAELLESMGDAPPPQDEHTTIIDRGPGACEESNHLLLNGGSHKHVQSQIHRSADSGGRQGREQKQDPLHSPTSKRKKVKFTTFTTIPPDDSCPTVNSIVSSNDEDIKWVCQDVAVGAPKELRNYLEKLKDKA

SEQ ID NO: 143 - protein, 482 aa, Homo sapiens
MLIPELCYLTGLTDKMRNDFNVMKDLAVHTRLTPEQRQREVGRLIDYIHKNDNVQRELRDWGLSFDSNLLSFSGRILQTEKIHQGGKTFDYNPQFADWSKETRGAPLISVKPLDNWLLIYTRRNYEAANSLIQNLFKVTPAMGMQMRKAIMIEVDDRTEAYLRVLQQKVTADTQIVVCLLSSNRKDKYDAIKKYLCTDCPTPSQCVVARTLGKQQTVMAIATKIALQMNCKMGGELWRVDIPLKLVMIVGIDCYHDMTAGRRSIAGFVASINEGMTRWFSRCIFQDRGQELVDGLKVCLQAALRAWNSCNEYMPSRIIVYRDGVGDGQLKTLVNYEVPQFLDCLKSIGRGYNPRLTVIVVKKRVNTRFFAQSGGRLQNPLPGTVIDVEVTRPEWYDFFIVSQAVRSGSVSPTHYNVIYDNSGLKPDHIQRLTYKLCHIYYNWPGVIRVPAPCQYAHKLAFLVGQSIHREPNLSLSNRLYYLZ

SEQ ID NO: 144 - protein, 951 aa, Homo sapiens [sequence omitted]

SEQ ID NO: 145 - protein, 660 aa, Homo sapiens
MQQFGGLEATGILDEATLALMKTPRCSLPDLPVLTQARRRRQAPAPTKWNKRNLSWRVRTFPRDSPLGHDTVRALMYYALKVWSDIAPLNFHEVAGSPPTSRSTSPRPTITTATPSTAPAAPWPTPSSPATTTPPGTPTLTMTMQQFGGLEATGILDEATLALMKTPRCSLPDLPVLTQARRRRQAPAPTKWNKRNLSWRVRTFPRDSPLGHDTVRALMYYALKVWSDIAPLNFHEVAGSPPTSRSTSPRPTITTATPSTAPAAPWPTPSSPATTTPPGTPTLTMTRPGPSAPRMPTGWTCLQWLSTSLATPLGZAMWPLHTPSCGRTTRARWVTRCATGSPTRTRCASGSCTVCGSLCLPRRSPRSLPCCRSPQTTGPAPRPGRTCPTDAALTLTRWPRSGVKLSSSKASTSGGZRGTGTWCPCSRHRCTASGGACRCTWTAWTPCTSAPATTRSSSLKETGTGCSRTITZRKDTRAPSPLHLPPGGIDAAFSWAPMTGLISLRTSCTGVRZPHEAHGPRLPRPEPPVEGCPQHAGRRHALVRRCLLLLPWPGVLESAGWRAGGGTRVPTVHGRDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 146 - protein, 515 aa, Homo sapiens
MEREPGAAGVRRALGRRLEAVLASRSEANAVFDILAVLQSEDQEEIQEAVRTCSRLFGALLERGELFVGQLPSEEMVMTGSQGATRKYKVWMRHRYHSCCNRLGELLGHPSFQVKELALSALLKFVQLEGAHPLEKSKWEGNYLFPRELFKLVVGGLLSPEEDQSLLLSQFREYLDYDDTRYHTMQAAVDAVARVTGQHPEVPPAFWNNAFTLLSAVSLPRREPTVSSFYVKRAELWDTWKVAHLKEHRRVFQAMWLSFLKHKLPLSLYKKVLLIVHDAILPQLAQPTLMIDFLTRACDLGGALSLLALNGLFILIHKHNLEYPDFYRKLYGLLDPSVFHVKYRARFFHLADLFLSSSHLPAYLVAAFAKRLARLALTAPPEALLMVLPFICNLLRRHPACRVLVHRPHGPELDADPYDPGEEDPAQSRALESSLWELQALQRHYHPEVSKAASVINQALSMPEVSIAPLLELTAYEIFERDLKGPEPVPLEFIPAQGLLGRPGELCAQHFTLSZ

SEQ ID NO: 147 - protein, 624 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFEMVPCCVAQAGLKLLGSSDPPTLASQSIVITGSGGGGISPKGSGPSVASDEVSSFASALPDRKTASFSSLEPQDQEDLEPEKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPPTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYQQNIPASELPVAVTSRPDCYWGRNCRTQVKAHHAMKFNHICEQTRFKNZ

SEQ ID NO: 148 - protein, 665 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFEANKENVFHGTKDTSGAGAGRGADPRVPPSSPATQVCFEEPQPSTSTSDLFPTASASSTEPSPAGRERSSSCGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKNZ

SEQ ID NO: 149 - protein, 289 aa, Homo sapiens
MRDRLPDLTACRKNDDGDTVVVVEKDHFMDDFFHQVEEIRNSIDKITQYVEEVKKNHSIILSAPNPEGKIKEELEDLNKEIKKTANKIRAKLKAIEQSFDQDESGNRTSVDLRIRRTQHSVLSRKFVEAMAEYNEAQTLFRERSKGRIQRQLEITGRTTTDDELEEMLESGKPSIFTSDIISDSQITRQALNEIESRHKDIMKLETSIRELHEMFMDMAMFVETQGEMINNIERNVMNATDYVEHAKEETKKAIKYQSKARRKLMFIIICVIVLLVILGIILATTLSZG

SEQ ID NO: 150 - protein, 228 aa, Homo sapiens
HGVSARDVLESRTRKQHSEATNSSNRVFVYCAFLDFSSGEGVWSNHGCALTRGNLTYSVCRCTHLTNFAILMQVVPLEVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAVZ

SEQ ID NO: 151 - protein, 828 aa, Homo sapiens
SVKSTTLAVDYPKTPTGSPATEVSAKWTHLTEFELKGLKALVEKLESLPENKKCVPEGIEDPQALLEGVKNVLKEHADDDPSLAITGVPVVTWPKKTPKNRAVGRPKGKLGPASAVKLAANRTTAGARRRRTRCRKCEACLRTECGECHFCKDMKKFGGPGRMKQSCIMRQCIAPVLPHTAVCLVCGEAGKEDTVEEEEGKFNLMLMECSICNEIIHPGCLKIKESEGVVNDELPNCWECPKCNHAGKTGKAYKQKRGPGFKYASNLPGSLLKEQKMNRDNKEGQEPAKRRSECEEAPRRRSDEHSKKVPPDGLLRRKSDDVHLRKKRKYEKPQELSGRKRASSLQTSPGSSSHLSPRPPLGSSLSPWWRSSLTYFQQQLKPGKEDKLFRKKRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPGQMDNRSKLRNIVELRLAGLDITDASLRLIIRHMPLLSKLHLSYCNHVTDQSINLLTAVGTTTRDSLTEINLSASLLGRVFGLQFWGICEPQARKNAGWAZ

SEQ ID NO: 152 - protein, 766 aa, Homo sapiens [sequence omitted]

SEQ ID NO: 153 - protein, 582 aa, Homo sapiens
MQRPGPRLWLVLQVMGSCAAISSMDMERPGDGKCQPIEIPMCKDIGYNMTRMPNLMGHENQREAAIQLHEFAPLVEYGCHGHLRFFLCSLYAPMCTEQVSTPIPACRVMCEQARLKCSPIMEQFNFKWPDSLDCRKLPNKNDPNYLCMEAPNNGSDEPTRGSGLFPPLFRPQRPHSAQEHPLKDGGPGRGGCDNPGKFHHVEKSASCAPLCTPGVDVYWSREDKRFAVVWLAIWAVLCFFSSAFTVLTFLIDPARFRYPERPIIFLSMCYCVYSVGYLIRLFAGAESIACDRDSGQLYVIQEGLESTGCTLVFLVLYYFGMASSLWWVVLTLTWFLAAGKKWGHEAIEANSSYFHLAAWAIPAVKTILILVMRRVAGDELTGVCYVGSMDVNALTGFVLIPLACYLVIGTSFILSGFVALFHIRRVMKTGGENTDKLEKLMVRIGLFSVLYTVPATCVIACYFYERLNMDYWKILAAQHKCKMNNQTKTLDCLMAASIPAVEIFMVKIFMLLVVGITSGMWIWTSKTLQSWQQVCSRRLKKKSRRKPASVITSGGIYKKAQHPQKTHHGKYEIPAQSPTCVZ

SEQ ID NO: 154 - protein, 501 aa, Homo sapiens
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGCAQESQREEAS

SEQ ID NO: 155 - protein, 64 aa, Homo sapiens
MVPGTPRTPRLREVRGLAGEGVRGWSAARGAGCIFSSFYGLPHLCIPSSLNLTRSEQWTASSLZ

SEQ ID NO: 156 - DNA, 804 bp, Homo sapiens
atctagctggcaacacaaaccccaggaaactccagttaagaatgaacacaaatgtggtgtgtgatgagcagccacagcaggcactagctgtcagctggagggcatctcggcctcactataaattatctgcaggaggaaacgggacagatctacaggcagtggggacgggcactgggtcttctcatctgctctatccacgagagtctagtgggggtttcatctgccaagtgagcccagtgctttggtgaggtcacgcttgaggcattcgttggtgtgttgttcccatggcttccctttttagcccctccatctaagcggtcatttggggtgtgaggatcttcactcactcactcctgccccgagcccagactcgaaggctcacatcagctgatggaagccaagatcagactcacacacgtgacgccgcgcccttccctgcactctgtgcaccaagaggctgaatctccccaacgccgtcgacaaggaactcttgccctctagcttctggttggctctgcttggaatcagaccttcagggaatggggcctgcctcaccaaggctgggctctcttaaaatggggttaagaatactttttaaatctaattctgtttgtttgcctcttttaatgtcatacatttcggaaatcaaaatcttgacattaataattacattgtttatattatttattatttcatatacttcattgattatatctatctttcctacgttattattaattaatgttaagtttagtccttctattttataattattactttaaactctatcttctttacaatttt

SEQ ID NO: 157 - DNA, 653 bp, Homo sapiens
ctaactatagggagaggatccgcggaattcagatactaccaaacagaattggccttagaattcatcgtagatccaaacttgacagaacgaagaacaaaagtacataaatgctcacctacagttgcagagagatttgagtaggcagaatcattggaatacacaaaagtagcattacgggaaggaagcacagtgagcttgtgggttcgggacgctgggtgaaacaacaaaaagaaaaagcacagcaagtgagtgagacaaaagacaaatgggaccaacatatctctcaacctgcagcaggcaccaggaggggctctttcatccaagagcaccctggactttctcttcggacctcacatcccccagccttcaccacccttgtttactttggtcagcagctcggccactccagtggccccactcagttcccacaccagggcgtgatggctgctgaatttggccgcaagcgatagttctaattttctggctccaacacataggcagatacttagttgagagatatgaaattgaacttggccactcataacacaagctcaacaaaaggattaatgggtatgatgtcacaagaactgatgagacagacactcttcatgaaaatgactgcgtgaaatgatgacaaatggacaaaacaacgg

SEQ ID NO: 158 - DNA, 555 bp, Homo sapiens
aactataacttccgcactgaaggtgaaattgagaaattcccagatgaaaaaaagacagagaatgcgttgctaacagacttgctttacaagagataccaaaggaagtccttgaggctggaagaaaactactctagagagtgatccaagcctgcaggtagaaatgaagagcaccagaaatggtcactatgttaacataaaacactctgcaaatatacgttctcctttattttcttaacttctttaaaagatataagattgcataagacaataactttatccagaatatataaagaactcttaaaattcaaaaataagccaggtacagtggcttacacctattatcccaacactttaggaggctggggtaggaggatcacttgagccctggagttcaagacagcctgtgcaacatagtgagaccctatctctacaaaaaaatttaaaaatagccagacatggtgccacgcacctgtagtcccaactactcatgaggctgaggtgggaggatcgcttgagcccagaaggtctaggttgcaatgatcccattattgtgcc

SEQ ID NO: 159 - DNA, 747 bp, Homo sapiens
  misc_feature (1)...(747): n = A,T,C or G
attccctagccaagcaatcaggcaagagaaagaaataaagggcatccaaataggaagagaggaagtcaaactatctctgatggcagatgacataacctttttatattttttgagacagtctcgctctgtcacccaggctggagtgcagtggcacgatctcggctcactgaaacctctacctcccgagttcaagtgattctcctgcctcagcctcccaagtatctgggactacaggcatgtgccaccacacctggctaattttttgtatttttagaagagatggggtttcaccatgtaagccaggctggncttgatcccctgacctcatgatctgcctgccttggcctcccaaagtactgggattacaggcatgagccaccacacctggcctagataacataattctatatctagaacaccccatagactcagcccaaaagctccttcagctaataaaaatcttcggcaaagtttcacgatacaaaagcaatgtacaaaaattactagcattcctgtacaccaacaacagtcaaaccaagaaccaaattcagaaaggcaatcccattcacaatttgccccaaaaaagaacaaaatacctatgaatacaacttaccaggaaggtcaaagtgctttacaatgaaaattccaaaacactacttaaagtaaatctgagaagatccaatcaaatggaaaaacattccatgctttatggattggaagaaatcatttttttaaaaagacccttct

SEQ ID NO: 160 - DNA, 734 bp, Homo sapiens
taccagattgctgactatgcggacctctcccatctccatgaccgaacaaagccagcatggtttcttttcatcataaaattgtcatcagataatgggagacaccccgattcaatgactgtaataaaaactagatagcaaagcaattcagcagagcttgccctgcaggcatctgcactcatcctcagactcactctgactctccatcccggactacagtctcgtgcctcatgctatttgcctgcgtcctgtctcaggccttgttcagaggcccagatgaagagcccgcctccatgtaaagcagcgtgtcctgaagcctggagatttgagacagggccttgagtggtccatgggcctggaaccaagcaactctgatgtctctgagcatctcattccatcacccaaacgtcggggtgttcggcacccaaacatcaccttgacagcaggtctccctccccctaaagccctcccctgctgtattttctcgatcccactaaccacgatccaatgtacttcatatcttagacgtttatttcatttattgtcagtctctccccaccgaggcgtaggccccatgagagcagagaccttctttctgcctgttcgctctgcaccccagcccccgagaacagggcttggtacttggtgagcactcagcgtttgtaaccaaacccagcctggctctgccctcccgcaacaaaaccaaacatggacgtcgggattgcaatgagaggaag

SEQ ID NO: 161 - DNA, 760 bp, Homo sapiens
  misc_feature (1)...(760): n = A,T,C or G
atatctgacatggctccttccttcaccttctgtgggtctctgctcaaacattaccatcttatggaaggtctcttgggcacccngacctgcacaaccacctccttccttcgaccgtctgtatgttttttgtttgtttgtttgtttgttttgagatggaatatggataaaattgaaaaaatatgcatatccctattttgttaaatgttatgtgataatttctattaatagttaactatttataataatgttagagttcactcataatctgggataaaaagacaacaagacccaacctgacatattatatatattctcattaatatattttttttttaatttaatatggatcaatcatatataaattatgacaaaataatttttttatttttttttttttttaactagtaaactnacaacngcaccgacaaacacaancnacttacttttatttcacacttatatattttttatatgttttctttttttttatatctatttttttttatttttatttgttttgttattattttattttttatttttttatattatatttttttttttattatattttattatttattacaattattttattctttattatttttatctatattttatgttattttttttttattgtttttttgatattttattttaatttttttttttttcatatttatgtataatatttatttttttttttttatagttattttttatttttttatatatgttttttcttcctattatcaaa

SEQ ID NO: 162 - DNA, 458 bp, Homo sapiens
  misc_feature (1)...(458): n = A,T,C or G
cgcggaattctcaatcttgctggaaacacaaacccacaggaaactccagttaagaatgaacacaaatgtggtgtgtgatgagcagccacagcaggcactagctgtcagctggagggcatctcggcctcactataaattatctgcaggaggaaacgggacagatctacaggcagtggggacgggcactgggtcttctcatctgctctatccacgagagtctagtgggggtttcatctgccaagtgagcccagtgctttggtgaggtcacgcttgaggcattcgttggtgtgttgttcccatggcttccctttttagcccctccatctaagcggtcatttggggtgtngaggatctcnctcncnnnccncccgccccnaatctcaaccttnaaggtctctcatcacttcatggtaagtcatattcattctttttatcgttgactccttgctcatttcctt

SEQ ID NO: 163 - DNA, 666 bp, Homo sapiens
ttcccccaactcccatgggagcagggctgggagacagtgcaaaagagtcttgaagccggacaacagcgggggattccagcactgccattctctactggaatgctcagctggatgcttgaccctggagaaattctttctctctctgaagttttccttagtggagagggagaaaatgaaaaaatatgcatatgcctattttgttaaatgtaaggtaataatagctattaagattcaactatttgtaagaaggtgagagttaaaagacagtctgggagacaagcacaacaggcaggacctgacatggagcagagtgctcatcagattgggtttttctcaaccttcagtgatcaccataaattttctatgactttctattcatcccatctatatcattcatcatttgaatacttttggctgtttaattaaacacattgactcacttttcttttttacttaaatatgttttaaaggaagcctcatattctaaccaaaaatggaaaactaaatatatccattgccatttataaaatgtaactatttttttaataatattcaacagtttcttcaaactgcagctagcttggacaatctgttctaatggcttcattgctttgatgccccacttttgcctttctcttttttctaacaaaaaagctctagacatgg

SEQ ID NO: 164 - DNA, 285 bp, Homo sapiens
  misc_feature (1)...(285): n = A,T,C or G
cgactcactatagggagaggctccgcggaattctcaatcttgctggaaacacaaacccacaggaaactcctgttaagaatgaacacaaatgtggtgtgtgatgagcagccacagcaggcactagctctcagctggagggcatctcggcctcactataaattatctgcaggaggaaacgggacagatctacaggcagtggggacgggcactgggtcttctcatctgctctatccacgagagtctagtgggggtttaatctgccgggggancccagtgctatggaga

SEQ ID NO: 165 - DNA, 436 bp, Homo sapiens
  misc_feature (1)...(436): n = A,T,C or G
ttcttctgaggacgcaagaattgacattgctgcagacccgcacggacatgaattcaccaccaggaacgttttgatgccatgactcaaatacgtatttaggtgctgcatgactcagatctgttcctggcggcccgacacctctatgcctcaccttcttcggctagagatgctcaacgcctgtacacaattttcttctccccttttgctctcctgtttactaaccaatgcccagaacaattccccttcgttgtaagtgactctgctgatctctcagttcaccctgatgggtggcttgcaggggtggnnnnnnnnnnntnnngnntctnttnnntntttttgttnntntgttttatttttttcgtgttttctttttttttccctttctttcctcttctccccagtccctctctttttctcatccctctccctccctctt

SEQ ID NO: 166 - DNA, 954 bp, Homo sapiens
cgcggaattccacgacgaaatctttctcaaggttcatactccgagcctcagcgttctgctctgctgcccccctcgtggagatgggtgtctactgagctcgcggagcaggtgggtgtcacctgcgctaacaggtacttagtaagggggtccgttcgtcaaatggaaacacgccacccttatcgtgaaaaggggagccgtcagtccccactttcccctgatatccactatctttaccatcatctaatgacggaggatgacccggtgtcctagcgggattaccaggatcccaccaacgctagcctcacctccagatactccacgctcacccagcgtgtgcccaccatgttccaaccacacagaccagccgggtcctccaaaagcccgcatccctcctgcctcagaggctttgcacacacgccccctttccctggaatatgatccaccccaccccacctgtggctctcttggccaatgaaccctggttcttccttgaacctcagcactttcccgacttctgaagcttcacacccccgttagacacgttcacaactgcccgcttgccttcctcgctgacagcatttaaaaattttgaattaccattctctgtgcttgtcttccaaactaaaataataagcctcaacaagaaaagacccattctgattctgacttaccctttgtttccatccccttatgcaatgtaggcccttcccatcagtgcttcccatttcttttgtatgaacatatgagatgaatttcttcccgcggtaaacatcgctttatgtttgttatatttctaatttaatactatatttgttatcggtagtttctatctatgtgcctcttgtttatttttttgagcgttatctgttacgtgttattttatctttttttttatttacatcgttttataattctttcttttaatcttattttctttagagttctgtttttttg

SEQ ID NO: 167 - DNA, 491 bp, Homo sapiens
  misc_feature (1)...(491): n = A,T,C or G
cgcggaattcctagccaaagcaatcaggcaagagacagaaataaagggcatccaaataggaagagaggaagtcaaactatctctgatggcagatgacataacctttttttttttttgagacagtctcgctctgtcacccaggctggagtgcagtggcacgatctcggctcactgaaacctctacctcccgagttcaagtgattctcctgcctcagcctcccaagtatctgggactacaggcatgtgccaccacacctggctaattttttgtattttgagaagagatggggttntaccatgtaanccangctggnctcnancccctgacctcatgatctgcctgccttggcctcccaaagtactgggattacaggcatgaaccaccacacctggcctaaataacataatnccatatctagaacaccccatagtcccagtccaaaagctccttcagctaataaaaatctttggcaaagtttcaggatacaaaa

SEQ ID NO: 168 - DNA, 508 bp, Homo sapiens
cgcggaattctgagttttcagggccaaacaagttgactgtggcataaggtgcagatcagtagactatggcccatgaaccaattctggcccaccgcttgtttttataaatgaagttttaatggaacgctgtcacagctaattgcttacatattctccatggcagcttctgcactcttatggcaaggttaactagtagtgacagagactataaggccagctgagcctaaaatatttactgtctcattctttacagaaaacgtttgctgttccctggtcaaatgttttgtttgtttttggtcaaagttttttccaaacattttgatcatatacatatatttagcatacctctactggcaggaatgatcaaagatttctaaattttagatatccctactggtaaaaaagctatgggggctgcacctctaatatatgggtgaaataccagatatttacacagcttcaaagcatctccccatgaactatttattaattacaaaagggaaaccaa

SEQ ID NO: 169 - DNA, 658 bp, Homo sapiens
aagagcaagctcagatttctgagcgtaagtgataaaacttgattctgggaggagaaaggtcaggataatgcctcctctgtctgagcacatggacctacactctgaagagagaagaacaggagagatggccagagtgaatgctcaggggacagagttttgttccctccattcagccctgctgtggtctcaccaatgcctgggctcaccaggcagttcacacaacttctggatctgttaactttcctcctacggtggcgtccctagatcggaatgaaaatctaatgctgtggccgctgctgcagcaaacaaacccaaacaccgaatggctcacacgtgatggatgtttctgtctcattctcacaagtccaaagggtgcttccatgtagccagcaactgtgtccttcacgtggtgactcagggaccatggtcccttccatccgtggctctgtttgtaatgtgtggccattgaagctgccttgttagtcaccttaagccagtagcagagaaagggaatggctggccgtgtggcggaaatatttgcgggtcacgactgcaagtgtcacgttcggtttttattcacatcccatcggccacatctaactgtgatgtgaggccaggacattctaccacatgccctgagagtgagggcctttggccc

SEQ ID NO: 170 - DNA, 498 bp, Homo sapiens
  misc_feature (1)...(498): n = A,T,C or G
cgcggaattcaaaagatccagggatttattaatatttttccctttcaaaaaaaattgtttcctagttgtgtccccaaaatagtcgagtagcaatgacaaactggtaacagcaaacatcttgagcccctagacccaggtctctgcagagcatttctcgttaacaagagtcagggcttgctggggaaactctgatacttagtctggagccagaaatatgtacgatcatcccaggacattttgtcatgactgaaagcaaaaacgttattaaacgggaaaagtgtcatactgcagtgatgccaaagatagtgtaatttgaccatcaaaagagaaaataatgaccaggcgtggtggctnangccngnnannccancactnngggaggccaaggaggcanggggatcactngaggtcaggagttcaagaccagcctggcccacatggtgaaaccccatctccactaaaaattacaaaaaattagctgggtatgggtggtgccag

SEQ ID NO: 171 - DNA, 718 bp, Homo sapiens
aggaagggctcaccacgggtcctttgtacaaaaaggaaggacttgtcccagggtgctttctgttgcttctccaattaaggctcactttacaagtttttaaaaaaatgggctccttagtaaaaccaacacatcctcccatcaccgtggttttgcttgtgatcttaaaggaatcgcaaaggtctcaaacctagacagccagaggaaacctcttcccaagacaactttttcaacactgtggcagacgggtccagcgagttttcccagtcaggactcattttggcctcccagataggcttctgaattatatgcctctgaatttggctgcaagactggaggcttctttcaagtcccatgtagagtggccccagcctctgtgcatggaacaaagagatacgtgctgtatccaggagtaggtggcaaaccacagacgattccttttcaccctgcagcagagttatcaggtcacagaaactacaagactgcagaaaatcgtggaagggactggttaccagatactcgtacacacatgttcacagctgcgctgctctcaacagccaaagggtagaaatgacacaagtgcccatcaatggatgaatggggaaacaaaatgtgggatatccatacaatggaatattattcagccaggaaaaaggaatggagtatgtgatttctgctaccacatggatggaccttgagagcaccatgctgggggaaagaa

SEQ ID NO: 172 - DNA, 592 bp, Homo sapiens
cgcggaattcagtaataaaaacaattattcttgaatcgtgttgtcagtgcctgacatttacatgcatagaatgaagacctctcctggggtgcaggtcttcactgtgaataaggcagcactctaactataggcagagtaagattctcaaatcaggcaggctggcacagtctgaaggacctaaaaatacctgtttcagggatctgcatcttcagatggtaatgaaacttttagtaaggctttttttttttttggcaaaaaaaaaaaggtagtattgtagaattttacattaaatagtggaattgccatgaaaacaatttattctgacattgatccagcagccgaataagcctgcagggaatggcgactcttggcagcgggtcaggctgtgggcttcagagtgggccgcttcctggcttaccagccctgctagggtaaatctgctctcagcggcttcctcctagaatccagcttgaaaattaaatggaaataaacaaacatcggttatggtctgggaaatttgctacatattgcatgttcttgatgacacactaatacatgtacatgcgtaatattacagatgactgcttatatt

SEQ ID NO: 173 - DNA, 370 bp, Homo sapiens
cctgggcgacacaggagcgatagtggtctctacaaaaaatcaaaaattagcacggcgtggtgccacacacctattgtcccagttacctgagagaagatcacttgtgctcaagaagtcacagctgcagtaaagctatgatcatgccactgcactccatcctgggtgacagagcaggaccctgtctccacatcaaagacaaaaacaaaaacaagctattggggccgggcgcggtggctcacacctgtaatcccagcactttgggaggccgaagtgggtggatcactgagatcaggagttagagaccagtctggccaacatggtgaaaccctatcactttatcttgactttgttccatcattttttgaaacac

SEQ ID NO: 174 - DNA, 645 bp, Homo sapiens
  misc_feature (1)...(645): n = A,T,C or G
cgcggaattcatgtccagaatatataaagaccatcaccaacaagtcaataaggaaagaaaacaccaaaataagccaaaatgaacaaaggaagaaacacgaaaagatgcttcacttcatcagttatcacaaaagtgcaaattaaaaccacaaggagatactactttttacccccagagtggcagacaatatcaagagttcttgagatgtgttacagcaattaaagaatggcaataaaactaaagatatatatatgtaattgtttttaaaaagagttccttcttaggctgggcgcggtggctcaagcctgtaatcccagcacttcgggaggctgaggcgggtggatcatgaggtcaggagatgcanaacatcctggctaacatggtgaaaccccatctctactaaaaatacaaaaaattagccgggcgtggtggcgggcggctgtagtcccagctactcatgaggctgaggcatgaaaatggcgtgaacccaagaggcagagcttgcagtgagcccagatcacgccactgcactccaacctgggtgacagcgagactccatcttaaaaaataaaaatattatatttagagttccttcctgaaaatttggagcttggcacccccacttttaaacaacaattacttttc

SEQ ID NO: 175 - DNA, 635 bp, Homo sapiens
aattccccctgagcgatacaaccaggggcacagcaccccctcctcactgcctgacacgagggtcctgggtccccacttgagcaaccgtgggcagggccacctgagagctgcccgtcagagtgtctgcacccggatggctacagaccagggctgggcacctctggctttcctacaaccttcatgtcacagctaggagccccaagcgtgtgtcccacagagctccgacaatagtgcccgcctgtcatttgcccatcttcatggtccacagacaacgctacctgagtctccagccaggggctggaaatgagctgatgggcccagcccaggtttaatgctccaggcatggggcagcatcactaaaccctgggctgacagggacaaaggtggcttttctaaaggaaattgcagggtaagggagatggatagcaggcaaggctggatcagggggctcagaagatgtgatgcaacgtgtggatgtgcacgtggcaaacataaatacaagatacagttattgtgggtcttttctgctttctgcttttcttgcttctcataaattgtttaaatttgctcaacagtatgtctgatgccgggcacagtgactcacacctgttattccagtacttctgggaggccta

SEQ ID NO: 176 - DNA, 617 bp, Homo sapiens
cttcggaagaggatccgcggaattcttatccctgttcctgcacaagtcaggtgatttcccccggcttctcccaaggctgtctctccatagagttttccgcggtgtgactgttccatgtccagccatgtctgttggtatatttcccgcttggtgttctctgagcttccaggatctttggttcggttctgacattaatttcagaaatttatcagcccttattacttgaaatatttattctgctctaatctcttttccttctaatattccagctatacgtatatgacacgtttgatattgtcccgcagttgttgaatgttgtttcgacttgacttgttttgctgtttgttttcccattgtgtttttctcatgtcaagttgggaagtttttgccgacctgctttgaaattcactgactcccctgggccacgccccatctaccgatgagtccgggaaaggatttcaccatttttgtttcagtgattttcatttctagcatttactgtgaattcctattaagcatattcattttttttcctacccatttgttcttttttcccccaattttatttgacctataattgacaaataaaaattatttttattttaaggattacaatt

SEQ ID NO: 177 - DNA, 749 bp, Homo sapiens
ttcaacaaaaccccaggaaactccagttaagaatgaacacaaatgtggtgtgtgatgagcagccacagcaggcactatctgtcagcaggagggcatctcggcctcactataaattatctgcaagaggaaacgggacagatctacaggcagtggggacgggcactgggtcttctcatctgctctatccacgagagtctagtgggggtttcatctgccaagtgagcccagtgctttggtgaggtcacgcttgaggcattcgttggtgtgttgtacccatggcttccctttttagcccctccatctaagcggtcatttggggtgtgaggatcttcactcactcactcctgccccgagcccagactctaaggctcacatcagctgatggaagccaagatcagactcacacacgtgacgccgcgccctaccctgcactctgtgcaccaggaggctgatctcgcccaacgccgaagacaaggaactcttgccctctaacttctggttggctcttcttggagtcagacctccacggagtggggcctgcctcaccaacgctgggctctctgaaatgggggttaagaaaactggttcaaccgagcacggtggctcgcgcctgtaatgccaacactttgggaggcaaaggccgcctgataacctgaagttgggagtttgatagcaatcctagccaacattggagaaaccccctttctacttaaaaatcaaaaatttttcctggacttgttgatttggct

SEQ ID NO: 178 - DNA, 622 bp, Homo sapiens
cgcggaattcagatactaccaaacagaattggccttagaattcatcgtagatccaaacttgacagaacgaagaaaaaaagtacattaatgctcacctacagttgcagagagatttgagtaggcagaatcattggaatacacaaaagtagcattacgggaaggaagcacagtgagcttgtgggttcgggacgctgggtgaaacaacaaaaagaaaaagcacagcaagtgagtgagacaaaagacaaatgggaccaacatatctctcaacctgcagcaggcaccaggaggggctctttcatccaagagcaccctggactttctcttcggacctcacatcccccagccttcaccacccttgtttactttggtcagcagctcggccactccagtggccccactcagttcccacaccaaggcgtgatggctgctgaatttggccgcaagcgatagttctaattttctggctccaacacataggcagatacttagttgagagatatgaaattgaacttggccactcataacacaggctcaacaaaaggatgaatggttatgatgtcacaagaactgatgagacagacactttgcatgaaaatgactgcgtgagatgattacaaattga

SEQ ID NO: 179 - DNA, 934 bp, Homo sapiens
ctaactatacttccgaactgaaggtgaaattgagaaattcccagatgaaaaaaagacagagaatgcgttgcttacagacttgctttacaagagataccaatgtgaagtccttgaggctggaagaaaactactctagagagtgatccaagcctgcaggtagaaatgaagagcaccagaaatggtcactatgttaacataaaacactctgcaaatatacgttctcctttattttcttaacttctttaaaagatataagattgcataagacaataactttatccagaatatataaagaactcttaaaattcaaaaataagccaggtacagtggcttacacctattatcccaacactttaggaggctggggtaggaggatcacttgagccctggagttcaagacagcctgggcaacatagtgagaccctatctttacaaaaaaatttaaaaatatccagacatggtgccacgcacctgtagtcccaactactcatgaggcttaggtgggaggatcgcttgagcccagaaggtctaggttgcaatgagccaattactgtgccacttcactcccacctgggtaacacagaatgaccctgtcttatttaaatgttttatttccttttttttttatactcataaatttaacagcccaatttaaaattgcaaaaaatttgaggtaatattttaccttaaaagatctttttattggttttaaatcccataaaaagattgttcacatttgttcattagtaggaaaaattctatttgaaaaccatattgagaaaaccctttctaattttatttattcctgttaggttttaaaaactttatatcattctccatatatttttcaggtttttctataaatttgaaattctttatactattttcttttatttttgtaattaaatttcatcttcattttatataatttatt

SEQ ID NO: 180 - DNA, 601 bp, Homo sapiens
cgcggaattccttaaacccaggaggtggaggttgcagtgagctgagattgcgccagtgcactccggcttgggaaacagagcaagactctgtctcaaacaaacaaacaaataaacaaaacaaaaacacaaaacaacaacaacaaaaagcatcacatttcccatcttctttgcattccttgtattgttttcattggttgtcaagcagtgtaaattttacgtagttggtggctggatatttgtgtatccctataaatattcttgagctttgtactgggatgttattttgccctgggatacaagttacttggaaacaatttaatccctttaggtcttgattttaaggtttgaggcaaggtgagggcagcttttaggtctaaagtccaattttacagcatttctaaggtttcaaaaaaagccttctgaggactttacctaatgcccataaataggaagtttttcatgctggcaaaaacagaaactctttccagccctgtgtgtgctctaagatttgtcctccttaatccatttgggtggttctttcccttgccttagataatttcctcacatgcacctatcaatacttcggtaaaaaaacacaatg

SEQ ID NO: 181 - DNA, 723 bp, Homo sapiens
atccaagcaatcaggcaagagacagaaataaagggcatccaaataggaagagaggaagtcaaactatctctgatggcagatgacataaccttttttaattttttgagacagtctcgctctgtcacccaggctggagtgcagtggcacgatctcggctcactgaaacctctacctcccgagttcaagtgattctcctgcctcagcctcccaagtatctgggactacaggcatgtgccaccacacctggctaattttttgtatttttagaagagatggggtttcaccatgtaagccaggctggtcttgatcccctgacctcatgatctgcctgccttggcctcccaaagtactgggattacaggcatgagccaccacacctggcctagataacataattctatatctagaacaccccatagtctcagcccaaaagctccttcagctaataaaaatcttcggcaaagtttcaggatacaaaagcaatgtacaaaaatcactagcattcctgtacaccaacaacagtcaaaccaagaaccaaatcagaaaggcaatcccattcacaattgccacaaaaaagaacaaaatacctaggaatacaactaaccaggaaggtcaaagtgctctacaatgaaaattacaaaacactactcaagttaatcagagaagatacaaacaaatggaaaaacatcccatgcttatggataggaagaatcaatatcatta

SEQ ID NO: 182 - DNA, 687 bp, Homo sapiens
agagcatccgcggaattctccatgaacaaagtttaggttgcctatggttgcctaaaaggctgacctatgaacactccataatataatcaactgaaccagtcccttcctgttaacagttcaactgttaaagctgcttccagcatttcagcatcacatataacactgcaattaacctgaatttggtggatccaaaataacagctttcctagatacatccactagacagagtgggatgcagtaagattttacacatgactgatatctctcttggagaatgcaagagtctgtaactacctgagtctccacaaacatagccatgtccatgaacatctcatgcaactctcggatgctggtctccagcttcatgatgtccttgtgacgtgactcgatttcattgagagcttgtctagtaatttgtgaatctgatataatcttggaaaaacaaaaataaaagataatattaataaacttatgatgggtttggaagttaaagggtttttaaaaagctctgtctacagaagaggacatggagccacagggccgcacccccactcacgttggaagtgaagatggatggcttcccgctctccagcatctcttctagctcgtcgtctgtggtggttctcccaactggaaagacccgcaaccacagccccactcagaatgcagcacaatttaaaaacaaag

SEQ ID NO: 183 - DNA, 675 bp, Homo sapiens
accagattgctgactatgcggacctttcccatctccatgaccgaacaaagccagcatggtttcttttcatcataaaattgtcatcagataatgggagacaccccgattcaatgactgtaataaaaactagatagcaaagcaattcagcagagcttgccctgcaggcatctgcactcatcctcagactcactctgactctccatcccggactacagtctcgtgcctcatgctatttgcctgcgtcctgtctcaggccttgttcagaggcccagatgaagagcccgcctccatgtaaagcagcgtgtcctgaagcctggagatttgagacagggccttgagtggtccatgggcctggaaccaagcaactctgatgtctctgagcatctcattccatcacccaaacgtcggggtgttcggcacccaaacatcaccttgacagcaggtctccctccccctaaagccctcccctgctgtattttctcgatcccactaaccacgatccaatgtacttcatatcttagacgtttatttcatttattgtcagtctctccccaccgaggcgtaggccccatgagagcagagaccttctttctgcctgttcgctctgcaccccagccccgagaacagggcttggtacttggtgagcactcagcgtttgtcaccaaacccagcctg

SEQ ID NO: 184 - DNA, 515 bp, Homo sapiens
actactatgggagaggatccgcggaattctaacacatggctgccctgcgccatctgccacctgccctggctcagcgcacaggccctcccggcactgtggagacactgggctatgtggatgggggaagtccagggcttccagactgctgggtcatctgaacccctccacaggggcctggtgatggtccccacacgtctcaacagttagagcaaaaatcagcagaaaggggccaaacccccaaatgatgcagtgagtgagacccagtgtagtgagtaagacccagtgcagtgagaactggtgtagtgagtgagacccggtgcagtgagtgaggcctggtgtagtgagtgaggctccatgcagtgagtgagaccccagtgcagtgagtaagacccattgcagtgagtggggcccggagcagtgagtgaggccccatgcagggagtaagatcctggtgcattgagaccctgcgtggtgagtgaggcttattcctgtaagttagatcctagtgcattgag

SEQ ID NO: 185 - DNA, 799 bp, Homo sapiens
tatctgacatggctccttccttcaccttctgtgggtctctgctcaaacattaccatcttatggaaggtctcttgggcacccgacactgagcaaccacctccttccttcgaccgtctgtatgttttttgtttgtttgtttgtttgttttgagatggagtctccctctgttgcccaggctggagtgcagtggtgcaatctctgctcactgcaacctccgtctcctggattcaagcaattctcctgcctcagcctcctgagtagctgggattacaggtgctcgccaccacacctgggtaatttttgtatttttagtagagatggggttccaccatgttggcctatccttgtttttaacttttgactttttattatccacctgactctgcctcccaaattgcatgatttcaggtgttagacactacacccggactgaatgtattttttacacaaaagtctcactatttttcacccaatctatatttgagtggtggatatctaatttacttgtatcctcttctttgcaggtttcattatacttttttgttttgccttttgatatttcatgttttttcggtactaaccatcatgttccattttatttttttattatactttatttatgttttttctttcaatccatttctgttcattttatttctggtctttagtttattcatttctatacttattttcttctaataggctttttttttactattttataaagttggttttttttctttttttacataatttttttttttaatcgtttattaattcattattttattaactactc

SEQ ID NO: 186 - DNA, 618 bp, Homo sapiens
cgcggaattctcaatcttgctggaaacacaaacccacaggaaactccagttaagaatgaacacaaatgtggtgtgtgatgagcagccacagcaggcactagctgtcagctggagggcatctcggcctcactataaattatctgcaggaggaaacgggacagatctacaggcagtggggacgggcactgggtcttctcatctgctctatccacgagagtctagtgggggtttcatctgccaagtgagcccagtgctttggtgaggtcacgcttgaggcattcgttggtgtgttgttcccatggcttccctttttagcccctccatctaagcggtcatttggggtgtgaggatcttcactcactcactcctgccccgagcccagactcgaaggctcacatcagctgatggaagccaagatcagactcacacacgtgacgccgcgccctcccctgcactctgtgcaccaggaggctgatctcgcccaacgccgtcgacaaggaactcttgccctctagcttctggttggctctgcttggagtcagacctccaaggagtggggcctgcctcaccaaggctgggctctttgagatgggggttaagaagactggttcaaccgag

SEQ ID NO: 187 - DNA, 750 bp, Homo sapiens
ccccacaactcccatgggagcagggctgggagacagtgcaaaagagtcttgaagccggacaacagcgggggattccagcactgccattctctactggaatgctcagctggatgcttgaccctggagaaattctttctctctctgaagttttccttagtggagagggagaaaatgaaaaaatatgcatatgcctattttgttaaatgtaaggtaataatagctattaagattcaactatttgtaagaaggtgagagttaaaagacagtctgggagacaagcacaacaggcaggacctgacatggagcagagtgctcatcagattgggtttttctcaaccttcagtgatcaccataaattttctatgactttctattcatcccatctatatcattcatcatttgaatacttttggctgtttaattaaacacattgactcacttttcttttttacttaaatatgttttaaaggaagcctcatatctcaaccaaaaatggaaaactaatatatccattgccattaataaaaggtaacaatataataaagaaaattcaacagtatcatcaaactgcagctagcttgtacagtcagttgaaggcgtcatgcttgaggcccacttctgcctttttctttttcaaacaagaagtttagaaaggttagagaatgatgggtacccaaaagagactcccttgttgatttaattattagaaaaatgggtaattaaaaaatgatttaacttcactttggattc

SEQ ID NO: 188 - DNA, 624 bp, Homo sapiens
atccgactcactatcgggagaggctccgcggaattctcaatcttgctggaaacacaaacccacaggaaactccagttaagaatgaacacaaatgtggtgtatgatgagcagccacagcaggcactagctgtcagctggagggcatctcggcctcactataaattatctgcaggaggaaacgggacagatctacaggcagtggggacgggcactgggtcttctcatctgctctatccacgagagtctagtgggggtttcatctgccaagtgagcccagtgctttggtgaggtcacgcttgaggcattcgttggtgtgttgttcccatggcttccctttttagcccctccatctaagcggtcatttggggtgtgaggatcttcactcactcactcctgccccgagcccagactcgaaggctcacatcagctgatggaagccaagatcagactcacacacgtgacgccgtgccctcccctgcactctgtgcaccaggaggctgatctctcccaacgccgtttacaatgaactcttgccctctagcttctggttggctctgcttggagtcagacctccagggagtggggcctgcctcaccagggcttgggctctctgagatgggggtt

SEQ ID NO: 189 - DNA, 814 bp, Homo sapiens
tcttctgaggacgcaagaatcgagattgctgcagacccgcacggacatgaattcaccaccaggaacgttttgatgccatgactcaaatacgtattttggtgctgcatgactcagatctgttcctggtggtaagacacctctatgcctcaccttcttcggctagagatgctcaacgcctgtacacaattttcttctccccttttgctctcctgtttactaaccaatgcccagaacaattccccttcgttgtaagtgactctgctgatctctcagttcaccctgatgggtggcttgcaggggtgggaagaaccctggggtctgcaccgagtggaactgaagcactgatggccccctggagacagaagacttgtgagggtggcggggcttaacccttaagcataaatccatgccttgtaataggcttacgtctcggtattgcaaataccattcaagctcattaccaaaaacccactagtgcctactgatactgaattcctctgcataatgttctccactgtggcgcttttaacacactaccttgctattcccctgggcgagcccagctctgactgccttttttacagcaccccaatacaatgacctcccttcgctgatcaccccctcgtcatctattattggtctattaggccctcccacgctcaaatttaccttacccctccctttccttgttttttctgctttaacattccctgcgcacttgttctttacttgtccctttcctatttctttttaggataccttttttgaacctattcattagggattcctcaatctcccccaaaaacaaggttta

SEQ ID NO: 190 - DNA, 673 bp, Homo sapiens
cgcggaattccacgacgaaatctttctcaaggttcagactccgagcctcagcgttctgctctgctgcccccctcgtggagatgggtgtctactgagctcgcggagcaggtgggtgtcacctgcgctaacaggtacttagtaagggggtccgttcgtcaaatggaaacacgccacccttatcgtgaaaaggggagccgtcagtccccactttcccctgatatccactatctttaccatcatctaatgacggaggatgacccggtgtcctagcgggattaccaggatcccaccaacgctagcctcacctccagatactccacgctcacccagcgtgtgcccaccatgttccaaccacacagaccagccgggtcctccaaaagcccgcatccctcctgcctcagaggctttgcacacacgccccctttccctggaatatgatccaccccaccccacctgtggctctcttggccaatgaaccccggttcttccttgaacctcagcacttccccgacttctgaagctcacagcccccgttagacacgttcacagctgcccgctgcgcttcctcgctgacagcatttaaaagttaggaattaccagtctctgtgcttgtctcccaaactaaaataataagcctcaacaggagaggtaccaagctgagtctgactcaccc

SEQ ID NO: 191 - DNA, 735 bp, Homo sapiens
aaaccaatcaggacaagagacagaaataaagggcatccaaataggaagagaggaagtcaaactatctctgatggcagatgacataacctttttttattttttgagacagtctcgctctgtcacccaggctggagtgcagtggcacgatctcggctcactgaaacctctacctcccgagttcaagtgattctcctgcctcagcctcccaagtatctgggactacaggcatgtgccaccacacctggctaattttttgtattttgagaagagatggggtttcaccatgtaagccaggctggtctcgatcccctgacctcatgatctgcctgccttggcctcccaaagtactgggattacaggcatgagccaccacacctggcctagataacataattctatatctagaacaccccatagtctcagcccaaaagctccttcagctaataaaaatcttcggcaaagtttcaggatacaaaagcaatgtacaaaaatcactagcattcctgtacaccaacaacagtcaaaccaagaaccaaatcagaaaggcaatcccattcacaattgccacaaaaagaacaaaatacctaggaatacaactaaccaggaaggtcaaagtgctctacaatgaaaattacaaaacactactcaagtaaatcagagaagatacaaacaaatggaaaaacatcccatgcttatggataggaagaatcaatatcattaaaatgaccatactgc

SEQ ID NO: 192 - DNA, 578 bp, Homo sapiens
cgcggaattctgagttttcagggccaaacaagttgactgtggcatatggtgcagatcagtagactatggcccatagaaccaattctggcccaccgcttgtttttataaatgaagttttaatggaacgctgtcacagctaattgcttacatattctccatggcagcttctgcactcttatggcaaggttaactagtagtgacagagactataaggccagctgagcctaaaatatttactgtctcattctttacagaaaacgtttgctgttccctggtcaaatgttttgtttgtttttggtcaaagttttttccaaacattttgatcatatacatatatttagcatacctctactggcaggaatgatcaaagatttctaaattttagatatccctactggtaaaaaagctatgggggctgcacctctaatatatgggtgaaataccagatatttacacagcttcaaagcatctccccatgaactatttattaattacaaaggggaaaccattagcctcagagtgggaaatctataacagacactacctgaaccaggctaccaaagtcaacattaccagca

SEQ ID NO: 193 - DNA, 594 bp, Homo sapiens
caagagcaagctcagatttctgagcgtaagtgataaaacttgattctgggaggagaaaggtcaggataatgcctcctctgtctgagcacatggacctaaactctgaagagagaagaacaggagagatggccagagtgaatgctcaggggacagagttttgttccctccattcagccctgctgtggtctcaccaatgcctgggctcaccaggcagttcacacaacttctggatctgttaacttttctcctacggtggcgtccctagatcggaatgaaaatctaatgctgtggccgctgctgcagcaaacaaacccaaacaccgaatggctcacacgtgatggatgtttctgtctcattctcacaagtccaaagggtgcttccatgtagccagcaactgtgtccttcacgtggtgactcagggaccatggtcccttccattcgtggctctgtttgtaatgtgtggacattgaagctgccttgttagtcaccttaagccagtagcagacaaagggaatggcttgccgtgtggctgaaatattttgccggtcacgactgcaagtgtcacgtacggcttctattcacattccatcggcc

SEQ ID NO: 194 - DNA, 567 bp, Homo sapiens
  misc_feature (1)...(567): n = A,T,C or G
cgcggaattcaaaagatccagggatttattaatatttttccctttcaaaaaaaattgtttcctagttgtgtccccaaaatagtcgagtagcaatgacaaactggtaacagcaaacatcttgagcccctagacccaggtctctgcagagcatttctcgttaacaagagtcagggcttgctggggaaactctgatacttagtctggagccagaaatatgtacgatcatcccaggacattttgtcatgactgaaagcaaaaacgttattaaacgggaaaagtgtcatactgcagtgatgccaaagatagtgtaatttgaccatcaaaagagaaaataatgaccaggcgtggtggctcatgcctgtnatcccagcactttgggaggccaaggaggcaggcggatcacttgaggtcaggagttcaagaccagcctggccaacatggtgaaaccccatctccactaaaaatacaaaaaaattacctgggtatggtggtgcaagcctgtaatttcaactattcgggaagcttaggcatgagaatcacttgagcccgggaaatggatattgcatt

SEQ ID NO: 195 - DNA, 685 bp, Homo sapiens
  misc_feature (1)...(685): n = A,T,C or G
cctacgggtcctttgtacaaaaaggaaggacttgtcccagggtgctttctgttgcttctccaattaaggctcactttacaagtttttaaaaaaatgggctccttagttaaaccaacacatcctcccatcaccgtggttttgcttgtgatcttaaaggaatcgcaaaggtctcaaacctagacagccagaggaaacctcttcccaagacaactttttcaacactgtggcagacgggtccagcgagttttcccagtcaggactcattttggcctcccagataggcttctgaattatatgcctctgaatttggctgcaagactggaggcttctttcaagtcccatgtagagtggccccagcctctgtgcatggaacaaagagatacgtgctgtatccaggagtaggtggcaaaccacagacgattccttttcaccctgcagcagagttatcaggtcacagaaactacaagactgcagaaaatcgtggaagggactggttaccagatactcgtacacacatgttcacagctgcgctgctctcaacagccaaagggtagaaatgacacaagtgcccatcaatggatgaatggngaaacaaaatgtggcatatccatacaatggaatattattcagccaggaaaaaggaatggagtatgtgattcctgctaccacatggattgaccttgag

SEQ ID NO: 196 - DNA, 699 bp, Homo sapiens
cgcggaattcagtaataaaaacaattattcttgaatcgtgttgtcagtgcctgacatttacatgcatagaatgaaaacctctcctggggtgcaggtcttcactgtgaataaggcagcactctaactataggcagagtaagattctcaaatcaggcaggctggcacagtctgaaggacctaaaaatacctgtttcagggatctgcatcttcagatggtaatgaaacttttagtaaggctttttttttttttggcaaaaaaaaaaaggtagtattgtagaattttacattaaatagtggaattgccatgaaaacaatttattctgacattgatccagcagccgaataagcctgcagggaatggcgactcttggcagcgggtcaggctgtgggcttcagagtgggccgcttcctggcttaccagccctgctagggtaaatctgctctcagcggcttcctcctagaatccagcttgaaaattaaatggaaataaacaaacatctgttatggtctgggaaatttgctacatattgcatgttctgtatgacacactaatacatgttcatgcctagtattacagatgactgcatttttttggtgaaccattagcctgaattggagaggagatcttaagttaagattggaaacattcacttatttttgcagtgcaacccaccttttatttcttaaaattaattgtgc

SEQ ID NO: 197 - DNA, 733 bp, Homo sapiens
  misc_feature (1)...(733): n = A,T,C or G
gtcttccgtacanaatgcgatagtgtctctacaaagaatcaaaaattagcacggttgtggtgccactcacctattgtcccagatacctgagagatgatcacttgtgctcaagaagtcacagctgcagtaaagctatgatcatgccactgcactccagcctgggtgacagagcaagaccctgtctccacaacaaaaacaaaaacaaaaacaagctattggggccgggcgcggtggctcacacctgtaatcccagcactttgggaggccgaagtgggtggatcactgagatcaggagtttgagaccagcctggccaacatggtgaaaccctattgctttttcttttttttttcctttttttttttgagacagagtcttgctctgtctcccaggctggagtgcaggggcttgttcactgcttatctgcagcagtgcctcccagagcccacgcgttctcctccccgggatccgggacctattggggtgtggctccaagccgttctatttttagtattttttatgttttcccttgaaatcttaattccatttgtttaataaccttattgtttttctacgtttcttcgatttagcgatttcatcatgtcgctttttaatatttatcaaaatttttttaatttatttattattctattgtgtatctgattatttttaattttttgattttctaatatactattcaactttttatttttttaatttttaatttatcttttt

SEQ ID NO: 198 - DNA, 563 bp, Homo sapiens
cgcggaattcatgtccagaatatataaagaccatcaccaacaagtcaataaggaaagaaaacaccaaaataagccaaaatgaacaaaggaagaaacacgaaaagatgcttcacttcatcagttatcacaaaagtgcaaattaaaaccacaaggagatactactttttacccccagagtggcagacaatatcaagagttcttgagatgtgttacagcaattaaagaatggcaataaaactaaagatatatatatgtaattgtttttaaaaagagttccttcttaggctgggcgcggtggctcaagcctgtaatcccagcacttcgggaggctgaggcgggtggatcatgaggtcaggagatgcagaacatcctggctaacatggtgaaaccccatctctactaaaaatacaaaaaattagccgggcgtggtggcgggcggctgtagtcccagctactcaggaggctgaggcaggagaatggcgtgaacccaggaggcagagcttgcagtgagccgagatcacgccactgcactccagcctgtgtgacagcgagactccatctcc

SEQ ID NO: 199 - DNA, 607 bp, Homo sapiens
ttccccctgagcgatacaaccaggggcacagcaccccctcctcactgcctgacacgagggtcctgggtccccacatgagcaaccgtgggcagggccacctgagagctgcccgtcagagtgtctgcacccggatggctacagaccagggctgggcacctctggctttcctacaaccttcatgtcacagctaggagccccaagcgtgtgtcccacagagctccgacaatagtgcccgcctgtcatttgcccatcttcatggtccacagacaacgctacctgagtctccagccaggggctggaaatgagctgatgggcccagcccaggtttaatgctccaggcatggggcagcatcactaaaccctgggctgacagggacaaaggtggcttttctaaaggaaattgcagggtaagggagatggatagcaggcaaggctggatcaaggggctcagaagatgtgatgcaacgtgtggatgtgcacgtggcaaacataaatacaagatacagttattgtgggtcttttctgctttctgcttttcttgcttctcataaaattgttaatttgctcaacagtatgtctgaggccgggcacagttactcacaccttg

SEQ ID NO: 200 - DNA, 681 bp, Homo sapiens
gactgactatagggagaggatccgcggaattccagtatgtatgaattctttgaaaattatatgacttttatttctactgatttgattctagatactaaggatgtgccaaatgagtcagatactaagattcatcctttgaaatcatctagtgtgttttacgcagctatcctcaaaaacatcagtgatgtctgaacttttaaaacatctgttggagcaaaattaaaagagcatttggtagtaatctaagtttttgttcagttaataagtggttgataaagcttccgtattttcccggaaaagttaaaaaaaagttacatgtcattgggggaaaatatgtgatcagaaatgtttgcacagatcgatgccacaaaagacatctccagcgttgtggaacatggggagacactatataaaataccagaaagaaagcaagtgggtttacagatttgttgtaagacacaaatcctctgctactaagaaatgtgtatgctaaccatatatgctgtatttattttgttggtaagcatactttcagtttactcagaattttcaatttgctacaacaatgtatccattcgcatatagaaaaatattactttaagatgacttgtttcctttgaaaaatacatatgtactgaggggtatgatttatgtcaaaaattaacattataagttcttgga

SEQ ID NO: 201 - DNA, 544 bp, Homo sapiens
gatgcagggcatcaatctttttcatttcagtcatgctagctgctgctggagtattgcattttgattttggactgtgagatctctaaggttcggaatattagtacatgctttcaacaaatatttgctgaggacccatgaagcactgggcactgtgccaggagcaaaaacaagcatagtcgctgctcctctggtatgtccaggttcaggggtgagactgacatttaacagctgtggggttacagggcctttcagtgcatgagaggccaggaaactgtgaggcagaaaagcgtgacctgttcttgtggagagagaatcagggcaggctcccctgagtaaatgactttttaagaactagctggttggctgggcacggtggctttacttttgttttttcggctttatctgtggtctatgattgtttattaccttttgcatgatcttctgaagtatttattatatcatattttaatcattagtatgatgtttattattgaattgttttgttggttttttattactagggtgtgatcgtatgatacttatt

SEQ ID NO: 202 - DNA, 565 bp, Homo sapiens
cgcggaattcacctgggcgcctgaggcaggaatttgatgggatttttctgtgtgtgccccctctgccccaccgagttcctgttttctgatgcttctctgctcttcagcctccggagttttgtggcatcagagacttccttgggaattcaccgaactttgttttggggactttagaattgtcacaaatagcactatctctgaaaatccctaagggggacagacagcccctatcaaatataaacatgaattctggctcacataactgaagtccagcattggttagcttcaggtaacagcttgatctaggtgacacgatgtcctcaggaccctgtcccttttcatcccttggctctgccatctttcacagggtcttggtgtgttagcaggaaggaagccggtgactccaggccttcctccaggttcaaggccagcaaaaagagagaactcttccttcttctctccgcatttctagccccaaactgcttttcctcctcaccatgagtgggcccatgcctgtcctaaaacctgtcattgtggcccgagtagggggtgtattgtgaatctt

SEQ ID NO: 203 - DNA, 748 bp, Homo sapiens
ccgcaaaagctttcctacattcactacattcaaagggcttttctccagtatgggttctctgatgatgaatgagactagaatactcactgaaggttttcctgcattcactgcattcatagggtttctcacctgtatgtgttctctgatgtgatatcaggcttgacttctgggtgaaggccttcccacactcactgcattcataaggcttctccccagtgtgtgttctgtgatgcgttaggagctgggacttcccaaagaaagttttcccacattgaatgcatccatatggtttctctcctaagtgaattttttgatgtcttattaactctgacttcttaaagaaggcctcctcacaatcactgcatcgatagttcttctctcctgtgtgagttatctgatgtttaatcagctgtggttttctgatgaaggcttcaccacattcgttgcattcgtagggcttctctcctgtatgaatcctctgatgcctaatgagaagtgagttcctgcttgaagctttttgacactcaccacatcccgtaggtttctttccctgtgtgggtcctctgatgagtaatcagctgcgacttccaaaaaaaggctttttccagtgactacatggattaggttttttctcctgtgtgccctcttctgatgtttaagaattttaaattctgggaaaatcttttccccactttactgcaacttgtgggtttttctattgtgtgcgttatcttatttctttttaagt

SEQ ID NO: 204 - DNA, 618 bp, Homo sapiens
  misc_feature (1)...(618): n = A,T,C or G
ccgagtcactatanggagaggatccgcggaattcttggactcaagacatcctctggtctcagtctcccaccgtgttggaattacaggtttgagacactgttcccagcctgtttctttttattgttgaggagtactccttggtgtgaacgtaccggtttgtctgttgcccgctgatggaccatttggattgtttccagttctttgttttccatctttttttttaataagggtaacacatgaacagttcacattgaaagatatccaaacaacacagaaatacatagagctcgttaagagttcctttgccctttctccccattcatcagctccccacagctaccaaatttggaattcatttttctgggtttctttccatacatcagaacatgcattctcagtgagggcgatatctccaacaagggagtgaaaattagttattggaagaagggtgaaaaaacttagggattacagtgatttgtggccttcccaagatcccatttcctgaacagatgtacagtgttgtttttttttgtacaactgtagttttaaaatttcatggggaggcaattaggagagaaacttattcagattttccttatcgggggcccggtgaaaata

SEQ ID NO: 205 - DNA, 543 bp, Homo sapiens
  misc_feature (1)...(543): n = A,T,C or G
tatccatacctaattgaaaaatgactatggttgggccgggcgtantagctcacacctgtaatcccagcactttgggtggccaaggcgggcagacagcatagacaatgagtttgcaaccagcctgggcaacatggtgaaaccccatctctactaaaatacacacacaaaaaattagctgggcatggtgacgtgtgcctgtagtcccagctactcgggaggctgaggcagaattgcttgaacccgggaggtggagattgcggtaagccgagattgcaccactgcactccagcctgggcgacagagcaagacgccatctcaaaaaaagaaaaaagagtatggtttcagctgaaaaatgagtgtagttctaacatgaatattgtctgatatttttattttttgttaacaagagaaaagatgcttatacttggtgtaagcaactgtgtaagtaacaattataacactgcgttatcagatttataacatgcgcaggtgtaatatgtattgacaataataacatggggaaggggtggaaagttntttttt

SEQ ID NO: 206 - DNA, 628 bp, Homo sapiens
cacgcataggatctctcctggctctccagacggcagatcatgggacttattggcctctgtaatcacacgaggaaactccccaaataagtatcttcatgtgtatctatcctgtcctgtttctccagggaaccctgactaaccaccccgcttccatccaacagaagaaagtgacccaggcccaacatttcctgacccccgacctcaccagagaaggtcccccaggtggctcagttctcctctgggggtcggggtccctctgaccatatcaccaaggagggttaatcaaggccctgccaacatcagtgtcaggatttcatttttttttaaaatggctgaacagcattccgttgtgtagagaacacattttcttgatccattcatccatcgatggacacttaagttgattccacaccttggctagtgggaatggagctgtataaacgtgggggggcagacagctttgtgacatactcatatcattacttggggtgcagacagctttgctacaaacttcattcatttttctttgggtcggtacccaattacttagtgggacttttggccattccatttttttcttttttgaggaaacttccataccatctttttgacaaacttgaattaacct

SEQ ID NO: 207 - DNA, 1032 bp, Homo sapiens
acgcattcaccaaaaggcatggcatggagagatctggatgtgggcagaacatcaactttgttcattacaaatacaaaccaaatattcacactggatgctgtaaaagtttcagctgtggccgggcatggtggctcacgcctgtaatcccagcactttgggaggccaagacagatgaatcacctgaggttgggagttcgagaccagcctggccaacatggtgaaaccccatctctactaaaaatacaaaaattagctgggtgtgatggtgcacacctgtaatcccagctactagggaggtctgaggcatgagaatcacttgaacccaggaggcggaggttgcagtgaaccaagattgtaccactgcactccagactgggtgacagagaaagactccgtctcaaaaaaaaaagaagaaagaaaagaaagaaagaaagaaaaagaaagaaagaaagaaagaaagaaagaaaaagaaagtttcagctgtggaaaatgtttaggggaggaagacagtgctaggacaagttgtaaggagggcaccttatgtggtcagggaagtcagcaaaggccacgcagaggaaatattgtttgaccggatacttatgattcattagaaaaggtttgaattctaaataaatacccttcttaaaaaagcacatgtgccaagacttcaaacaaaaaagtagaattttcctaaaacttgggcttttaaaacaaaaatttaataataaaccccatgtttttggatagagttttcccgggctatgaaaaattctgtgttcccttttcaaactggtgaggttatcatttttttgtaaattgggtcccaatcccttttttatactttggctttttataagtggatatttttcaattccttttattgggttgtaaattcacaacatttgtcttttcccttgtagtgctggtaggattttttattctataaatttttttctaggtgaacatatttggtgtgtttccttcgtattgtacctgttataaaagatttatctattcttctctttactctta

SEQ ID NO: 208 - DNA, 820 bp, Homo sapiens
cgcggaattcactgccgcactcacaaagaacaaagcaaagactccgtgaaatcccaatttctcctttcacgtgggatgtgcgtatctgagtgggatgtccaaaagctttagtgttaaacacactgacctcaggctctcccttcccaaagcttcgtctgaccagtctacctggtggttcctgaaggaaccccagggatttggtgggtggttccccaaaagtgcatgcctgtaggaagtctgtccactcttttctgggtacattttccttcaaaattcaaaaatgtgacactcattgaagcattctatttagcaattttacacgcattccctaagtcctacaggagttttttggagtaatctcctgaacctgctgcttacacacagtgacggctctggctctctcctcagagtcaaatagaaagtattttcaacagcagtttcattctgatactatgatacgagtcttcagatatttcgtacatttctaagtaaaaacttaaagtttgtgtaaatggtattgtcattcaaatacaagatttcaaaagctaagtttaattttctttaccttcattattactacccaatgattttaaaaattcatttgtgtacaataaagaaactggtaaattttcaagattagtcaggaggaattcccttcacttggaattagatgaacctttctttctaggccaccattaaaagaaggcttcatggcctctacaattcttatttaaaccttcccttttaagcaccccttttgcttccattaacttaatattgggcaccttaaaaattttgaacttcggatttccaactcttt

SEQ ID NO: 209 - DNA, 593 bp, Homo sapiens
gggcgaaaccctatgaatgcagcgaatgtgggaaagcatttgttcataaagtgcagctcattaagcatcaaattaatcacacaggagagaaaacctaaagagcaacgattgtgcaaaagctttctttgagaaggcacagctgattatacatcagagaattcatacaggagagagaccatataaatgtggtgaatgtgggaaatctttcacaagaaagtcacaccttatgaggcatcagaggattcatacaggagataaatactatggatgcaatgagtgtgggaccaccttcaacaggaagtcgcagcttatgatacatcagagaaatcatataatataaaaatcatgactttggcgaatgcagaaaggttgctatcaagtgtcatactttctgacacttttgaggatgcatgtgggagagaaaccctattgaggcagtgactgttgaaaaagcttgaattgaggagtcaagagtcactaagcagaatttataaagagaagtttttaaaaagcaaacagtgtaaaaaaagtcatctcccaaaagacacttctcgttacattttggattacttattgaggtgaaaaccttatag

SEQ ID NO: 210 - DNA, 623 bp, Homo sapiens
  misc_feature (1)...(623): n = A,T,C or G
nactccactgagctgaggtccccttcttctataatcttctgtttgaagaaagagcccctagataaaacaggctttatctctgctatattggtcacgataagtgacagcagctactgtaacaaacaacccctgcatctcagtggcttaaggctcatctgtcagcccgagggttctgctccacacagtcattcacgcacccaggctccctccatcttgtggctccaccctccttgataccctcggagtcctctttattcagccagcggatgaagaatgaatgcgagggtggtttctatgggtctggtattagagcacattcattccacttacattgtgttgtttataattcaatcctttggtgccaccctacccctcggattcttgggcgattttctataccttggttttctgaacgaagagattatcttgttatcccatttgctttagtgtttttcacagattggcatctttgttctttttttctttggtatcacctgtccgttctttgtttaattttctactttgttgttccttctttattgttctttacagccgcttttttcatctttctacatattgatttgttttaattcccttctatttatcttcttttatcttcattg

SEQ ID NO: 211 - DNA, 782 bp, Homo sapiens
aagaccctcggaattcatcccatgacaccaggtttgaggactcttaaggggactccggtttgctccaggaagttcaagaaattggctgacccagtgcatacatttggaagtgtagtgggcatctcgaaacgtaacatgcctgtgactgaagtcttgatttccttactcactctgaggcacctgccctcgggcaagagcatcaccatccgtccagtagcccagacagccgctgggtgtcatccttcacccccctttctttcccctttccctatatgaaatccatcaacaagtcctcccaccctccttctgaagccagtctcaaattcgtcccttcatcaacaccttcaactgcctcctcgctggacttcctgctgccactctggctggccagtccattcttcacccatcagccggggtgaacttgcagattgaaatcattcttactcccccattggctttccaagatccatggcacccaagctcatctcctaggccttcaaagatggccagatcttgtttccgtccacatttagaccttgctaactaccctcactttttttccccttcaactttttcatcatgacttctttattgtccctttgacaatcaacctggtttcaaccttatgaccttttgtacaacctttcccttctgctgtgaatcttcttccttcagggctttaccgtggcttttttaagcttttctgtggttttttaaaattttcccattttcttggtggcctcccaaaggtcgtatattttttattttatttaagctttata

SEQ ID NO: 212 - DNA, 585 bp, Homo sapiens
agctcatgctcactctggctgggggaagcaatctgccatggtcctggggcatctttgtgtgtccttgctgcaaggatagcgtcccctgatactgagacgaatgactgcagatggtatggaggcaaccaaggaggctgaggtgcccacagagtgactgccacgcacctgcgaactccacagggacgaggactggttcgttggccgcgcgctaccacaggcctgcagccctgggcttcccagctgcggggcatcctgctttgtgggtagccactgcaccgtggcatttgggagagagaagcgggctctgtgatgctgaggctctctccatttcctgtaccctgtgagtgacaaacgccttgctctgattccagcttgttgtctatttttggcaacttgctggccagcctccacattgacattggggcctaattcccgctcctctcctctgtgaggctggggcccttccccgacggccagtgtctcagcaacagcacatggtgggggagtctggacatgtgggctctgacccctaaagtgggaaagtgagattcattatgtgaggctttccttgtggaggcttaacaa

SEQ ID NO: 213 - DNA, 850 bp, Homo sapiens
cgcggaattcctgtaatgaaaataaagaatgccttcaatgggctcataagtattctgtgtagatatatcaatagaaacgtccaaaactgaaaaacagataaaatattgagggaaaaaaaaggaacagattatccaagaactgtaggacaactacaaatgatgtaatatacgcataacagaaatactaaaaaagaaggaagaacagaagcagtctttgaggaaataatgacggagaatttccccaaattaatgtcataaaccaaaccacagatggaggaaacacagagaacaccaagcaaggtaagtgccctctcgcccctcacaaaaacccctacaattaggtatattatattccaatttcagaaaatcaaatacaaagaaaaaagaagtcaaaggaaaaaaaccttacctataaaggaacaaggctgggaattacagtagtcctctcctctgtagtttttcaccacttcagttacctttgttcaatatttaaaagtattaaatagaaaattccagaaataattcatgtttaaactgtacaccattctgagtagtgtgacgtctcgcaccatcctgctccaccccaccccgaatgtgaaatgtcctggcatatctatgctgcgaatgctacccacctgttagtcacttaggaactgtcagatcacctgatgccgaatcgtagtgcttgtgttcaaatgacccttattttacttaatcatggccccaaagcacaaaaattgtgattctgaccattcaaatatgcccaaaaagaagcttcaaaaatgctttccttaattgggaaaaatttgaaaaattttttttccacttcaattaaggaaaaacatctttt

SEQ ID NO: 214 - DNA, 592 bp, Homo sapiens
  misc_feature (1)...(592): n = A,T,C or G
cgactgactatagggagaggatccccngaattcccaaaagctcttcctaaaactgtcctttgatactaccaggctctattaagattccttctgttgtaaccaagttctactctttttttttgagacggagtctcgctctgtcatccaggctgcagtgcagtggcttgatctcagttcactgcaaccattgcctcccaggttcaagcgattctcctgccacagcctcccaagcagctgggattacaggtgcatgccactgcgcccagctaatttttttgtatttttagtagagacggggcttcaccatgttggtcaggctggtgtcaacctcctgacttcaaatgatccacctgccttggcctcccaaagtgctgggattacaggcatgagctgccgagcccggccgtcaccaacacctgggatcacaggcgttagccactatgtgaattatggctctgaacttggtaagagatatcatataatagcatgttatgtttcctgggaagcaagaataggaacaaagccactgcgaaatcaaaagcttcggataaactatttttggttccctctgttagctgggtgcttatgttgc

SEQ ID NO: 215 - DNA, 619 bp, Homo sapiens
tctcttcaccatccacccagaactccacgcggcatccacccggggcctcgcggggctcccagaacgaaggccagatcggcttgacacagccagcgtgggatgctgactatcacaggaacccccgactcacaccaaccccccactgacaccaacaccccccactcaaaccaaccttccattcacactaatcctaacccaccccttatttatactatatctctttcttattcctttacttttttctttttattttttctcatttctaattatactcttctttccctaacatccctaccactccattctccaacatcaaccactcttacacaacatatactatttacttctctactctctttttttttttttttttttcacttttatatttgtttgtttttcttttatattatttttcttttttcatgtttcttatatatattttctctccatctctcttaattttttttattcttattcctctctatttctcttattcattctttataatttagtctatcttttattcttttattttctcattttttctctatctctttaattctattcttcttttctattctttctttttttttttttctttcttttctttctctttgta

SEQ ID NO: 216 - DNA, 523 bp, Homo sapiens
tattggagaggatccgcggaattccactgctatgaattcagcctccagatattaagctcaacaataatacacatggctccagcaaggctgctaaaagtagcacagtttgagaagcaacttacttgtgcattggtgaagaccaactctttttttttggagctctgtgtgtgtgtgtgtgtgtgtgtgtgtgtactcacatagaaagactggccaaaaaaaaaacgcatattggtgaacaaaagatgcttgcacaaaaacaaaagccataaacacacatttctatatgcacagagcatctgtgatagtacacaaaataataactgttgtcacctctgggaaagagacctggaagactacagatctgggatgggccaagtgcggtggatcacacctgtaatgccagcactttggaaggcctatgagggcagatcacctgaggcctggagtttgagatcaacctgggcaacaccgcaaaattctgtttctattttttgtaaaaattcgaaaattagccaggtgttgt

SEQ ID NO: 217 - DNA, 840 bp, Homo sapiens
  misc_feature (1)...(840): n = A,T,C or G
acaaaaatccaaccacattcatcaaaagtagtttcatttgggaagggtttttatgatactaataaaactttaaagcttctcactgctgntgaatgcaaatataaaaaaaaagtctcaacaatatacagccatttgaaaagcaatactgatctaggaaaatagcaaaccaaagcggagacaaaaaataattatttaagccaatattgagtctaagtccaagcaacaagacaacccaggacagtagatttaaaccagactctgacagcgagggtcaccctggcaagactgcaggcccagggttggttttcttggacttcctggctcaagtgctgatttgtcacagcacaattttcagttctcagtcctaggagactggagtagaagacctaccatgcctcttccaaaggacgtcctttctgagcgcctacagcattaacttctcagcggctacaccatccccaggtcacttcctgagccatgcttgcagtcttcactcattaaagttacagtcaaatgaagactcgaaatctcaccctaaccacagagagagaatgagagccttgaacagggggattggcctttttcccacatcgtttctcaaggcaggacatctcggacaggtcatttaacatgaaaaccaggagaaccgatttattaagctccatagttccctccaaagggaatgacacactaattgaatgaaaaatttgagagacacacacttagtttagaatccccgaaaggaaattgggcttcactaaccctgctacctgaactgtaaataatgccattaattttctttgaacctgacttcattttttatttacttaattaactgaa

SEQ ID NO: 218 - DNA, 547 bp, Homo sapiens
cgcggaattccaattagaaaaggaaaggaaggcactgcagacatcccccaggtctgggacgggactggcttaagctagaattccacaacatccacaaggaattagaccttcacgaaaaggaccaagtctcccagaaaagacttctggaaattggtactttgaagctgtgatttgaccttctgtcattaatcaaaacgcaaccaactgtgtgccccacgctgctgcggctcagcctttcagtaccttcccactctctcaaagcctctttccgggtccgacttcttgacgtggtgaaggaagcctgctttctctcgaggtggagttttccagagcttgcgaaaatcttctgcctatgaagaaaaaaaaatgtattgagccgtgtcatgcactgcgcccctcagctgcggaaacctgaagagccgtcgtcatcgcaatagctgcctgtctccgcacacccttccttctctccccttcactagcaaaaccctgggccacgtgcccacctgtggcatggctgaattggtcgcacggctgcacttctgacctg

SEQ ID NO: 219 - DNA, 794 bp, Homo sapiens
atctgctcaataaacatttaggagtactgttcaacagtgccttcactgacaacttctgttgtttttagtctgtattcgtaagcctaagtaactgtcatagaataagaaggtgatgttagtagggtcactttatgagggccgtatattgtatccatttcataaccacaaacatgaggtttcacacctagttcagatgcactctctacctgtttgtgttggatctcaggagagtcattaggatgcttgaatgagggggcagaatgctaatcactccctgggcacttcctgtgtgctaggtactttagcaaacgttgaactgaattatgtcatttatgccccagaaaagccctctgaggtgcataagaattgaggaaactgaagctcagaaaagttgagactggtctaagatctcacacttagtgatgatgggacaggaaattgaagtctggattcctgtacctgcttccagagtccctattctttgctattacatatgctttctctctcttttttgtctataattaattcactgctttcctagatcaatgagtttacagatggtcacttcttgtgcttcaaacttggaacacagtttgcttgcagtaaatgttttcttgacctatgaataaaatttgattttcttttcgccctttgaaatttttactgtgaatcccataaaatttagaagtcctttaatttcaaaaccttttttttttttctttgaggccaccccccaactaacttaatttttacttttattttcctaacaattttttccatcttttatttataaa

SEQ ID NO: 220 - DNA, 989 bp, Homo sapiens
  misc_feature (1)...(989): n = A,T,C or G
tgactatatggaaaggatccccnnaattcttnctttcctttcagtgtgcaatcccaggcattcccttgacacattctggagtaaggagccctatgcaggggccatataggggcactcctctcccgcaaaggaacttctcccagtccatgctcaaacatccccccgcatctagcccctttctcctctctgcccccagccactcctccccacccttgggacccagccaagaaggcaccagctgggattccctcctggatgaatggctttttctggtggcctctcacctttcccatgagttttaagggtgtaatttattggtggccctgatttccaacttcagaggtgccatggtcagggagaaccctctgaggccagggggcatcacctgaatggctttttcctgcctccctttctgatcatctgggtcagactccctctgtcccaatcaaagtttgctgcttgcctacatggacaggttcatagcctggggacatgctccctcttgtaccttcttaaaaagccagcttcatcctttgccttttcattttcaaaacgtacccccttattgctgtattgacttggacaatcccacttacccttcttttgtgccctttggtttcttcttcttttgtgtggggcattctttggtaaaccccaccctcacaagggtaatctttttgtgtatttaaattaacctaaaaatttttaaaagcgtttttactatgtgggctccacaaaggtgaatttttttccttgtctggcgttattaatttacttcatttttttctatatcttatttttatcttattgtgacttaaattaaaatttcttaatattagcttactatcatttaattttatgatttctctttacactatatgtatgatatatatttattgttatataatacatcaatattagtttttattcataatcttcttatttatttcgcttttatctatatatatgtatttattattaatttttac

SEQ ID NO: 221 - DNA, 827 bp, Homo sapiens
  misc_feature (1)...(827): n = A,T,C or G
ctatggaaaggacccgnggaattctacccctaagtctataaccaaaagaactgaaattaagaattcaaacagatacttgtagatgaatgttcctaacagcactattcacaagagccagaagttggaaacagcacaaatggccaattaatgaataaataaaatatggtctgtccatgcaacggaacatttttcagctttaacaaggaatgaagcactcacacatatgacagcatggatgagccttcagaatatccctaagtgaaagaagccgggaacaaaagatcatatattgcacgatttcatttatgttaaaaagatccagaatagttaaatccagagacggcagataagtggctgtcatgggctgtggaggacggaggacaaaagggatgaaaatgttctggaggtgactgtcacacaacagtgtgaatgtactgaatggcactggattgtacaccttaaaaggatttttatgttatgtgagactcacttcaattaaaaacaagctatgagtaaaagaatgtgtatagggggtgggtcaaaaaaatatttatttcacattacttattacttactttctggatagttgctaatattacaatttcattcattctaaaatatgataataaataaggttatctagtgttttttactgtctttctcggttttaaatgtaatttaattttaataaatgtttaaaattgtataatggatttgtttttttaatattgatattcttaatcttatttattttatgatttttatatagtttatattatttacaatattttattaaaacaatttgtatagttagattgtattaattt

SEQ ID NO: 222 - DNA, 579 bp, Homo sapiens
  misc_feature (1)...(579): n = A,T,C or G
tctaatgtacttnncccangttcttcanangaatcactattgatgactatggcagctatagcctcatttaatgtatttccttttttttttagggatgagataaggtctcattcggttgcccaggtgggagtgcagtggtgtgtaatcatggttcactgcagcctcgacctcctaggctgaagccatgcgctcacctcagcctcccaagtggctgggaccacaggaacatgcctgtgaatagcgaggcctgctgtctttctcatgcctggctaatttttaattttttaaaatagagatgggagtctctgtgttgcccaggctggtgtatttcttgaattagacttgaaagtaaaaaaattactccttgatccatgggctgcaaaatggatattgtgtttacaggaattaatcttcttgtacatctccatcagagctcttgagagacaaggtgcatcttcaatgagcagtagtattttgaaagaaatcttttcttctgagcagttgatctcaacagtgggcttaaaatattgaataaaccatgctgtaagcagatttgctgttatccaggctttgttgttc

SEQ ID NO: 223 - DNA, 685 bp, Homo sapiens
  misc_feature (1)...(685): n = A,T,C or G
cgcggaattcccaagcacacttacatttgtaaaaaatcaacgtgctttttaaagttacactttgtcagacacggtgacccctttcccaagaacagccacaacttgaggactctcttttgtgaggaaatttttaataaaaacaagtaactcaaaagcactgaattttccagaccctctaacacatttccctccggatcctgtgagagcctgagatcacttatgacgagattcacctggaccttccggtcagtgagctcagaacacctcacaccacagcgtcactcaactcaagtccctcctcacatcagagggctcctcgaaggggggccccaggacggttctctcagatttgctggtccctcccctcctagaatcttcacgtacaacattctgtttttgtttttaaagacctcagggaactagaactcggttgtgggaaccctgcaccaaggagagttgagggccagctccttagcgcagcacagcacggactgtgttcttgtgggcagggcccctgctggacccacccgaggagagtccatttcacatcctatcaaaaacactgcctgatccatattgcanaaagtgggaacgggtgtgagtccgtaagacccttagcatcaatcttacatataccacggtaaaaacacattaaaaccaatttacgttgtttttggaaacgtca

SEQ ID NO: 224 - DNA, 755 bp, Homo sapiens
ttatcgctttatatatttttatggtctgttattagatatataagtattataatgtcctatgttgaatattttattaatctacaaggttatatctttgtctaagagatctgttttggtttaaaggctattttgtctgatgcaaccatcactgctttctttgggatatttacatggaatatctttttcaatcctttcactttctactatttgtgtttttggatgtaaagtcagtctcttataacagcatatagtggaattatgtatttttattcaatcttcaaatgtaagtcttttgattgaaaagtttatcatttacatgttaattaactactaatgaggaagttttttttttgagatggagtttcactctgtcacccacgctggagtgcagtggcgcaatctcagctcactgcaacctccgactcccgggttcaagtgattctactgcctcagcctacctagtagctgggactacagatgcgtgccaccacgcccagctaatgtttgcatttttaacagacacgagggtttcaccatattggtcatgctggtctcgaactccttacctcaggtgatccacctgtctcagccttccaaaatgctgggattacatgtgtgagccaccgtgccttgcccgaagatattatttctgccaatttgctttgtttttgaaggggcttattagcgtttttatctctaattttcctgcattgctgtctttcttttgtggttaatttatctatttttttttgaaa

SEQ ID NO: 225 - DNA, 686 bp, Homo sapiens
tgatccgcggaattctgacagctctaaaaagatgtccttcctcttcccccatatggagaacggaattttctttttacctacaatacactggcattaagcataatttctctgtctgtaggactttactactgaagagtagaagggattagatttttacatcacaacctattttaagcaattataatccacaagtaatcttcctcattcatcccccctggggcgaggaagatgtaagagactgttctggggcctcaatttggatcagtgtttgcattcctactagctgaattagctgggattctggagtgtggagcccatttatctcagacgctgtgggaatgtgggcctcactcacaaaaggaggtttttgccaactgagtgccattagtgcagtcaaataacatatgacccccatcctttgccctcaaacatgtcttttggtctttggcctacttgtgccaatgcaggaagaaacttctcgctttgtgggaagccatttgggagttaacgacctggcttttcttcaatccacttacatttctggtcattctcagcatcagggaattgtgcactggaatctgttcatacaggcttttttttttttttcccggaaattttgtgagcccattgtaaaacccgaatttattaaaaaattaaaattacataaattgtaccatttaaaagcc

SEQ ID NO: 226 - DNA, 641 bp, Homo sapiens
  misc_feature (1)...(641): n = A,T,C or G
ttaacgagttttangagaaacttaaccaatgaagatgagagttttgcattggtgcccagaaggtttggcgaatgcaacaggatgcccttcccagaggtggatgtaggggcctgtgtctgggcactagaggatggaggcagtgtgagagccctatgggcactgctgaggggtgcaaagtggctctccttttgccagttaagaaggcggctgtggggtgcatgcccgtcaggcctgtcataaccggcacgaatgatgttgtccgacaggcatggggatctacacaggaatgaaaacaactccaatttcggctactttctatgtgctgaccgttgcactgatggctttaaatattttattctaaagctgtttctcaccacgaccctatagatgttattgtctccattttatggcaacggaatcccaaaagggcagagaggtggtgagtgcatcaaaggaaactgtcaagcagtcatgaacacgggggtcccatgaagcagagatctggtacgggttgtctactgctgggtcacaaattacctcccaaactgagcattttaaacaacaaacattcactgcttatttctgtgggtcaggagtttgggagcaacgtagctcaagggttctggtttaaggtctttctg

SEQ ID NO: 227 - DNA, 719 bp, Homo sapiens
actatacggaaaggatccgcggaattcacactggagagaaaccttatgaatgcagtgactgtgggaaagccttcactcagaagtcagcactcacagtgcatcagagaattcatacaggagaaaaatcgtatatatgcatgaaatgtggactggccttcattcagaaggcacacttgattgcacatcaaataattcatactggagagaaacctcataaatgtggtcactgtgggaaattgtttacctccaagtcgcaactccatgttcataaacgaattcacacaggagaaaagccctatatgtgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagccttcactcagaagtcacacctcaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagttaaactttattactcattaaagaattaatactggagagaacccttat

SEQ ID NO: 228 - DNA, 719 bp, Homo sapiens
gaaaggatccgcggaattcaatggtaccatcacagctcactgcaacttcaacctcctgggcgcaagtgattctcccagctcaaactgctaagtcgctgggaccataggcgagagccaccacacctggctgatgtatttttgattttttgtagagacaaagtctcactttgttgcccaggctgggcttgaacttctgggctcaagcaatcctcctgcctcagcttcccaaagagctgggattacagatatgagccaacacaccagctattgtttgctcagtttgcttatgggataagcataagatgaaattcctttgtcgttgcatttgtttgatgaataacgagattatgctgattttgttttttaaaaaatcactagctattggagtgactatctatgctttgcccattttttcactgggtacattagctgttcttgattgatttataagaatttcttaaatatttgaaattgtaaaactttttcctcaatacttctagttatatgtattttgcatgataagtttacttttttaatttttttaaattaatgggaaaagttcatatttccttcgttgccgtgaataataatcgttttcctttatcttcttttaacgtagaatcttttggttttcatttctccgttaaggccttttatttaccctttgaatactgaacctttttgacctttgtaatatttgaggattttactctttatct

SEQ ID NO: 229 - DNA, 795 bp, Homo sapiens
  misc_feature (1)...(795): n = A,T,C or G
cgcggaattcatctgcaatanaaattttgaataaatgcagcctcttactgccttgcataatatcattagaattttcttgaattagcagaaccagtgagtaaccgggtactaccccattctaggtaacataatctctaggttgttctgttgagtttcacttagtaatcaatctctgagtttgcagaagctggccaggtacaaacgaaatgtgcaactctatccaactgaatgagcttgggacttctggccatgttctaaatatctccttggtgtcttcatatgggcatccacttttcttggatgtagctggccaaatagttgagaccatttctggagtcttcaatggggctctgctactgaattgttcttttcacatggtgctttgaatactagggccaccatgaaggcaaatgccatttgttccccatgaatagagggaggtggcccggatcaccacccagcaacgtgcccggcacaaggagggcactcatcagtcaccagggggcaggtaagtccaacttaccatgactgcttccacggctctggcattcccatagaaggggctgggccatccgtcgcaaatacattccgataaagatgaatgtttagaagaaaataaaacaggggtaaagggatagaggtaacatcagcacaaggaagcaaggtgaggaggatgctgtagatgggtgttttgtgtttttggttttttttttttttttttgttttttctttgttttgatttataagttttatttttttatatttttaattccaatttatattgttttatgtaat

SEQ ID NO: 230 - DNA, 763 bp, Homo sapiens
ccaaggcagcaggcccaagacagagcagttcacccccatttcttagcactcgtgaagacccagccttttgtctcacagatgctccaacagctctgagcgtagaggcttggcctgaggctgacctgacagtatttcaaaggcagatatccctgcccttcagctggcatcgggcagccagagtcccgtgatctgtttagggaccaagcttcagtgcagttgccaccctcactagatccttaaactctgttcatgcaaaggaggtgactcttgatttaagccagtccatacaccttgaataccttttgctttctccagcaagagctgtttctaacaccattaagaggatcagcggatcacattccgctcgttggtaatacaccagttccaccaaagcaaacccatttctgaggttcaggtagcagaagcactggggtagatgcccctgggctgtgggctcccattagaatccagcccaggcagatgtgaatgctggctgcacccaggtgggggcaagcccaccatccgctcatctgtcaccatgctggaggacagcatcacagcgctgagaggctattgcatgcagacgcacagggccacagttggcggggccaggatgaagacccagtcctacccctggctccttcagtccggttcttgctgtgtgtggagcaagcccatgcgcagccattcacagaaccctcaatgcaacacaggggcagcgctgggctggtgtcctctgagcctggcacatgctgaggtgggt

SEQ ID NO: 231 - DNA, 702 bp, Homo sapiens
cgcggaattcaagcaattctcttgcctcagcctcccgagtagctgggactacaggcatgcaccaccacacctggctaatttttgtatttttagtagagatggtgtttcgtcatgttggccaggctggtctcgaactcctgacctcaggtgatctgcctgcctcagcctcccaaggtgctgggattacaggcgtgagccaccgcacccagccttattacactacttttaggtccactaccccttgttaaaaatctggagatctgtccagatgtgaagggccataattattccattgttgagaaaatgggtgggttgtcacatctgcatagctctttctcttgaccacatttgcctttgtatgcttacaaatatttttgatttctcttgcaaattacatttattctttagtcctttgggagagcttcctgtgggaaaattggagcacatttagaaccacactacgattaatgttaattagggttgcaaagcactacagctccatggaggtacaggaagtgatcccttcggcacggacaagattgattggaattacagaaatttcatggggaggtgaagacggctgctttatttatgtttgtattttaattcttttcctttttatctgttttttaaattaacttttttctttataattttttttttatatttttttttagatctttatttttattttatattgtt

SEQ ID NO: 232 - DNA, 944 bp, Homo sapiens
ttctccagaaggcatcatgtgtccttgctgaggcagtaccatatcggggctcgtggtgtctgtttgtgccatcgcattctcgttggttgacgctgaatttgatctaaaagattgagagctgggcaggcccactgcgctgggggtgccctttcccctctgtggttcatacgtggtctgtatgttatgttccagcattttccgttcatctggcttttgcatttctgtgtgttcttcagatgcttgggaaacctctgaatggcagaatctcccgtcccctctccctggcttgcttatcaagatgcctttgccctcatggcctgattttccataggacccgtttgcatgtgcctgagggtgatggaggtaaagcgagattatgatgcaggaaggccattgtcacccaaccccggtgttggatgtccccgggtgttggatgtcccccgccttactgctgcaaaaagagcgctgatgaaatcccatgctttaagcaatcttgttccctcccattgaggcgatggcttggccttgtttgactgaattctcatgcatccacaattttgcttacctggttcctttatttaaactttccattttgaaaattgtccaacataacccaatgtaggtagagtttagtgaacccttttttaacccaaattttccatgttgcaaccttttgccattcttgttacttttttcctttcttaaatgtttatgagggttccttgaataatattttaaaccttattccattatattatttaactttgtatattctatttgcattctttataatataaaacattcgtaaaaatttaaactcattatctccctgtattgtggtttattataatgttctttatctgactaataattttatttttatttttttatacttttttattttttaatttgtatatttctatcgtattttttattattttttt

SEQ ID NO: 233 - DNA, 532 bp, Homo sapiens
cgcggaattctcctgtctcggcctcctgagcagctgggattataggcatgcaccacctcgcctggctaatttttttgtatttttgtagagatggggtttcaccgtgttggccaagctggtctcgaactctggacctcaagtgacccacctgcctcggcctcccaaagtgctgggatagcaggcgtgagccactgtgcccagcctcacctaatggtttcttagcaaacttcagtagaatgtttagaacgcggccctgataaacttgagtgctggtaggaggtgctacctcgctcaatctgtgagcaaccagccctgtgccctggatgcttggcgggtggagagaaagacagtgttatgtgggcaagcctccaactcaccagttgcagtaaagcatctggctctctgtctgctgctatagccctgtgagtcagccaaacgtgtggtccccaagccagctttccacctagcacccttgttctgctacagctcccccacctgccctcctgcattgcctaagatcccacccccctct

SEQ ID NO: 234 - DNA, 815 bp, Homo sapiens
  misc_feature (1)...(815): n = A,T,C or G
cgcagagacaanatcgtntaggagttaatagacaatgtgtagactgaaatgtgttgctaaaaaatgaattcaaactttttgaatttttactactgaaatataatatgtacaagagtctgtatacataatgtgtaagtatggtttaaataataaaatgaacatcatatacctacgatcaagctgaagaaacagtacaatctcagagcctttgaagcatgtaaattttcccattggacctcgctctccccatccttcatccccagcagtaacctaaattcagggtttgtcatagttttgtgcttgtaactgatcctttaggaaacaacatttgtggccaaaaaacatctaacaaaaactcagtaatttcttcagacttactttagggttttgtttccctttcgggttaaagtaaaattcagtttttgtcttttagtgctgcccaacggaaatataacgcaagcaatatgtaatttaaaattttccagtagctccatacgtaagggggaaagacatagataaaattaggctgaataacatattttatttaacccaatatacccaaagctttcattttaaattgtaatcaatataaaaatcactaattgtcataaccaccgacacaaagcatggttttaaaacatacctgttggaggagccctgaatctgagtctaaaacacatgcatcaatcaaaatattctaaaagaaacattttgaaaatattacaggaataataacaaatatgattaccctatactgagaacctactacatgccatactctatgctttaaatagctcacttaatatgcaacgtga

SEQ ID NO: 235 - DNA, 389 bp, Homo sapiens
tgattcttctgttccacgaggtgtcaactgaggttactcaatgatattcagctggcagattgcctatctgtaggctgaaagatggctgagttcatatgcctggtatcttggtggggatggctggaagactgggctctgctgggacttctggccacagcacctccacgtggcttttccagcatggtgccccgggtatgagacttcttaaatggtagcacgctcctgccagtgagcatccccaaaagaaccaggcagagctacctggatttcctggtccagcccgtaagtcactgagcgtcacctccgctatactttatagaacaaaccatacaccagcccacctatattggtggggaggggatatataatttcctctttcctctttgtat

SEQ ID NO: 236 - DNA, 607 bp, Homo sapiens
cgcggaattcacatgaatgtttttcacacacattctcattcttaatgagtgtgacttctgtgactaggacagacagtcgtgatgccatgaaaacaaacagctttaaagaccttgtctttcttgcttttgaagacgtgggttctgtgagtgcttgcattccttctgccaggtgctgggtgaaagcaaatcgtgtgtacataaatgcttcattatttctaccacgcgtagcagatcccactaatgtgacattcaaagtgtcaccgttagctcctatttggggaaattggtttttccttaatttcttcgctcaggcaaggcagcatccaagcacgggacaagtccacgtttgatctgacgttgaggagataattcagttttgcttcaggttcgttcgttccgtgtcacatccgagcttttccctgggatagcggcaccctgacatttgtaggcagcttaaatgctggcgtgaatgtcgacagtcagctataaatatcgctgctttaaaaataaatcctgccacaggcagagcgtttcatacaggcaattttggccgtggcgcataatcctgagtacttttcaaatgtgaagcctttccatgaatgacagc

SEQ ID NO: 237 - DNA, 814 bp, Homo sapiens
cactggtaccatcacagctcactgcaacttcaacctcccgggcgcaagtgattctcccagctcagcctcctaagtcgctgggaccataggcgagagccaccacacacatggctgatttatttttgattttttgtagagacaaagtctcactttgttgcccaggctgggcttgaacttctgggctcaagcaatcctcctgcctcagcttcccaaagagctgggattacagatatgagccaacacaccagctattgttttctaggtttgcttatgggataagcataaaatgaaattcctttgttgttgcatttgtttgatgaataatgagattatgctgtttttgttttttaaaaaattactagctattgaagtgactatctattctttgcccatttttccactgggtacattagctatacttgattgatttataagaattctttagatatttgaaattttaaaactttatccacaatactttttgtagtttgttatttgcattttaagttagcttttgaaattttttaattttatggaaaagtttaaatgtttctgtattcatgaatatcaatcctttccttattctcttttaaagaagatatttcattttcattcttggaaaggcatttttaccatggaaacagacatttagccatgtaatattgtggtctaacatttccttattttcattttttacacttacatttttaaacttcctaaaatttatttaagaaaaagtcattttttagggatttaaattaataaaatttattttaaattggctttttaaatggtctttcttattggtctcaaa

SEQ ID NO: 238 - DNA, 237 bp, Homo sapiens
cgcggaattcacatattctgaagggcttcctttatagaaaggccacaaattcatgtttagtatttttattagtggccaatgtcgaacgaattagcaaatttcacagaaaatttccagtttttcaggaggtgctgaggtgctgccggtgcagccccactcaggaggactgggtgggggcggaaggtacctcaatgctcaattatatcttccacccttatgagatcctactcatgcgta

SEQ ID NO: 239 - DNA, 578 bp, Homo sapiens
cacaactggggtgcatctgcggaccttccaggactgaaggtgctgggctgcttagcgtcaggtcatagacactcagcccaaggccctctctgttactttctgaagacaaagctgaaataagaagcagcccacctttgctaaaggaaaggctgcctccaggcccttctcaatacctcccactaagcagcttctagcagtatctaaagctggtgtcagctgaaacctgcttgtcgtttctgcctggagctgtagctggcctaggcctgtggggccacagcattgactgaactctcagctggtgccccagggcaatgtgtgctaggaaaaaaatggagtctggtgaagggagatggtgactcactccttccagtgaggagggagaggaaatgtcagtgagaggcaaagggcagggatgacgccatttgcatgaggatggacctgggttctaagcctggtccagcagcttccagctgcatggcgtgggcctgggctctagttccctaagccttgcatcccttgtgtgctggatggatgtggcagcactaactcggtgcggtggtttggggtttgttattctg

SEQ ID NO: 240 - DNA, 614 bp, Homo sapiens
actcactatatggagaggatccgcggaattctaaaatatttttgatattcaatctcttatttttcagctggtgatttggttgtagtaactagtcccccacagagcctggtgtcctatgattgattttctttttttcccccctccgtgactgagctttttaagaggaaatgcatgctaggtaagagttatctgcgaccctggtgcccacgtagagccagagtcatggggatttgattcgtattttcggataagagaattttgttgacacagctgctcctctcttcccattcccttccgcctttgatctcccttcatagactgctgtgatctgcagtgacaaacacagcagacctagcattttccgctcccctaagtgcaggggccagctgagggttctttcaaaggatcaggaaattcccaggttgcatctacaagagccagaagttagaaggcaaccagctgcagacttggttatttctcagtagattcagaacccagcattgccactgtaactgcagatttgagtaaatgacttctcttctccaagctaaaagtttcctttcagttaggattcatgaccttctcatgaggattaatatatgtaaggcaccagg

SEQ ID NO: 241 - DNA, 545 bp, Homo sapiens
  misc_feature (1)...(545): n = A,T,C or G
tctggtagaactctctagcctagaggtttctttttcnggagcttttaaattattaatttaaattaatttaatggtcattagatggtttatcttatccattttcaaaagtttgagttttggtagtttgtgatgtttgaggaattggcttatttttttctaagttattgaatttattagcttggagtgtttatttttctcattgtattttaaatggctgctgcatctataatgatatttactgttttattcctaatattggtgtctttttatctttgccagtctggttgactaatagaccaatcagtgaatttatcggttttattattttgttctctaataactggattgtgttacagtgatttttctctctatcttttgntttcagttttgttgatttctactttttattatttagttccttctgcttgcttttgagttcttttgctcttctttttctagttatttatttatctatttatttatttatttatttatttattaatttttgagacagtttctttgttttttcttcgtctgtattcttt

SEQ ID NO: 242 - DNA, 586 bp, Homo sapiens
cgcggaattcctgacctcaggtgatccgcccacctcagcctcccaaagtgctgggattacaggcataagccaccatgcccagccagtgactgagagatattactgtcattagcagacagaggccaggcatgctgaagggctcaactgcatggaacagtattccttacctaagaatggttctcaaatactagtggcaccttctttgagaaccactgtattgtttaaagacaacctattctggtttcttgttcagtggataggtacatggatgaatgaattcacaatgataaatatttttaaaacattccttcctcaaggcataatgcaagattattatatttattatattagattatattggttattcattattgtgtcacaaattaccccaaacctcaagggctgaaaacaacaaacattgatctgtttctgggttttggaatctgccaggtacttgcccagttggttctggttgagggtctcacatgatgcagtgatgaaagttgttgagaagggctgcatctaggaaggagctggttttttcatgctcactcagtggctgttgggaagcctcattttcaatgta

SEQ ID NO: 243 - DNA, 589 bp, Homo sapiens
gcacactcacatttgtaaaaaatcaacgtgctttttaaagttacactttgtcagacacggtgacccctttcccaagtaacagccacaacttgaggactctaataagtgaggaaatttttaataaaaacaagtgactcaaaagcactgaattttccagaccctctaacacatttccctccggatcctgtgagagcctgagatcacttatgacgagattcacctggaccttccggtcagtgagctcagaacacctcacaccacagcgtcactcaactcaagtccctcctcacatcaaagggctcctcgaaggggggccccaggacggttctctcagatttgctggtccctcccctcctagaatcttcacgtacaacattctgtttatgtttttaaagacctcagggaactagaactcggttgtgggaacccttcaccaaagagagttgagggccagctccttagcgcatcacagcacggactgtgttctggtgggcaaggcccctgctggacccacccgaggagagtccattttacatcctatcagaaacactgcctgatccatattgcaaagagtgggaactggtgtgag

SEQ ID NO: 244 - DNA, 283 bp, Homo sapiens
cgcggaattcacaactgttttttttttttttgaaacggagtcttgctctgttgcccaggctggagggcagtaaaaagatcttggttcactgcagcctccacctccgaggttcaagcaattctcctgcctcatccttccaagtagctgagactacaggtgtgtgccaccaccccctgctgattttttgtagttatggtacagacaggttttctccattttggccaatctgggttaaatctccttatctcagtgatctactcttcctcttctttccctaaatgct

SEQ ID NO: 245 - DNA, 611 bp, Homo sapiens
ctcatccccctctaataacaacaaatataacaagacaggtatggtgctgagtgttttccacaaatgcactcaagttagcctcagggcaaccctaagaaaaaggtattagctgcattcccattttatagaccaggttacagaggcacagagagggtaagtaacgtgcttgaggtcacacagccaatgaagggaggggctgccgttggaactcagaccttctggctccctgagcctgctcacaaaggggaagggaaaggtggacaaggcccgaagccagttcctctgtgaggccagggcatgccgaaggaataggggccatctcctcagcaggacaccataatgaggctttggagatgtgaggggagcccaagcttgggaggggcctggataggaaagtctgggagctagagtttcctggagaggctgagaggaagagactggaaaacagggaagttggagaatctcaaaaaaaaaaaaaaaaagtggagcagcgtggtgctgtgaaaccactccattctccccaaattttaacaaagtttgatgcacccagaaataatccaggctaggggtaggggatgggaaagatgcatttttttttggtgtgcttttct

SEQ ID NO: 246 - DNA, 757 bp, Homo sapiens
ccatagggagaggatccgcggaattcactgctgaattctaccaacatacaaagaagagctggtaccaattctactgaaactattccaaaaaattgaggagaaaggactccaccctaactcattctatgaagccaacatcaccctgatacccaaatctgacagacacaacaaaaagagaaaactacaggctaatatccctgatgaacacagatgcaaaaatcctcaataaaatactagcaaactgaatccagcagcacatcaaaaagacaattcaccatgatcaagtaggctttatccctcagatgcaagattggttcaacatatgcaaatcaataaatatgattcaccacagaaacagaactaaaacaaaaaccatatgattatctcaatagtgcagaaaaagcttgcaataaaatccaacatcccttcatgattaaaaaaaccctcaacaatctaggcattgaaagatgtacctcaaaaatagtaagaggcatctgtgacaaacccacagccaatatcatattgaacaggcaaaagctggaagccttcaccttaagaactggagcaaggcaaggatgcctgctctcaccattcctgttcaacactggagtgctataaccagaacaatcaagcaagagaaagaaaataaaaggcttccatttaggaaaatagaaatcaaaataattttctcactgatgatacgggatccatataggaaacaagaagtcaaattcttttctcttcactgatgaacaag

SEQ ID NO: 247 - DNA, 717 bp, Homo sapiens
  misc_feature (1)...(717): n = A,T,C or G
atctgaaagtcnaacactccaatccctcccagaaactcactcaagaacagcagtttctaaccacatctgcacctggggagcccgagggggccgaaccagtgcctcaccctgaggactgtgggttagctgctctgggatgtggctggggctttgggagtttaaaaaaatcccctggtaatttcagtgtgaagataagtttgcaaagcctggcttcaaggtaggctctaattttcactgggaatcagggtgggttcaggaggagctattcaaactgggtcaatttttaaaaaattaaaaatacttaatttttaattttaaagataataatgtctataagggtacactgtgatgtttctatctatttatacattgcggaaggattaaatcaagataacacatccatcacctcacctatttagtatttttctgtggtgagaacaaactgggcatggctggcactccattcgtcagtcatttggtggagtttcaggagttaactgcctttgtggcatgactggaagccattacctttattttctcctgtggctgaccttatcctccatcaaagattttaaagcagccttttgggaaaataaggaacttttttttcatagaagaaatgttttatttagtacattatttagtggtttttaccataagctttttgtttttttcttttttctttttttaaagagtttttcttatttcttttttgca

SEQ ID NO: 248 - DNA, 686 bp, Homo sapiens
cgcggaattcccaaccacacttacatttgtaaaaaatcaacgtgctttttaaagttacactttgtcagacacagaaacccctttcccaagaacagccacaacttgaggactctcttttgtgaggaaatttttaataaaaacaagtaactcaaaagcactgaattttccagaccctctaacacatttccctccggatcctgtgagagcctgagatcacttatgacgagattcacctggaccttccggtcagtgagctcagaacacctcacaccacagcgtcactcaactcaagtccctcctcacatcagagggctcctcgaagggaggccccaggacggttctctcagatttgctggtccctcccctcctagaatcttcacgtacaacattctgtttttgtttttaaagacctcagggaactagaactcggttgtgggaaccctgcaccaaagagagttgaaggccagctccttagcgcagcacagcacggactgtgttctggtgggcagggcccctgctggacccaccctaggagattccatttcacatcctatcagaaacactgcctgatccatattgcatagatatggaaaccggtgtaagtccgtaaagacccgtaacatcaattttacatataccatggaaaaaacacattaaaaaccaagtttactttgttttttgaactt

SEQ ID NO: 249 - DNA, 605 bp, Homo sapiens
  misc_feature (1)...(605): n = A,T,C or G
gttgaagctaccgngagccaagatcatgccactgcactccagcctgggtgacagagcaagaccctgtcttaaagaaaaaaatgtggccggacgtggtggctcacacctgtaatcccagcactttgggaggctgaggtgggcggatcacctgaggtcaggagttcgagactagcctggccaatatggtgaaaccccgactctactaaaaatacaaaaaaattgtccacgcgtgatggtgggcacttgtaatcccagctacttgggagtctgaggcacaagaatcgcttgaacccatcaggcggaggttgcattaagccgagatcattccattgcactccagcctgggctacaacagataaactctgcctcaaaaaaaaaccaaaaaaaaacaagggggtgaatctctttctgtatttgcatgacggaaaattatggattttttactccttttaaatctatttttgccctttccagcctgttagcacacattcccctttgggtttcatcttgtcccccacttggtctttatattcccttgagggaaaggcttaatgcccggctttattttcttaatttttttattagttgaaacaaatgggctctta

SEQ ID NO: 250 - DNA, 531 bp, Homo sapiens
cgcggaattctttcctgggtggagccaagaaccctcccaggctaagccctgattctggggctagcctgccctagtcaccttaaccccaaactggggctctaggaattcctgtttccatcagcaacagttattttccccagagagcccaaagcagaccaaaagaggcaaagcagtggggaaaaaacaagcccactccatttgcaatgtccttctgctcatttccacctggtaaaatccatatcaaaagcccccaggggatgctggggagatgtgggctggggaagatctattatttttttcatacagttgatttatgcttattacaggatattttatatatcttttttttattcattttatattatattttttatattttatgagattttatattatttctgttttttctcttatttaattatttttctctttattttatatttatatttttcttttacgttttttttacttttataattcaattttataatttttaattcctatatttttattcttactttttattctgta

SEQ ID NO: 251 - DNA, 693 bp, Homo sapiens
  misc_feature (1)...(693): n = A,T,C or G
atgctattataccttgttcttttcttttcttttttgtttcaatcaagctttactctgactctaataggttcagagagactaggtgtaggtttaacttgtnggtgaactgccaaactgttttcttccccttcctttcggattatgatgagcaaaacttctcaatatagagactttcagctcatccttgaatctctctgcaaagcagccagtgattgccttaaaactggtgcacgactcctgccccatccctgcttaaaccccatcaactgcttcttcccaatgcctacacaaaaaatgcaacttcctctgcgaatgcttcaaggccctacatgaccagggcctcccgatccttgccccccttaccactcatgtctgaggtcaaagtcagttccttggagagactccctgattgtcctatctgttgttcgttccacaccgtctctgtctcctactatgaacctgagtttgtttttcatctttctcattccatccttatcttattgaaggatgatacctctctgtataccatcatgttcatcttccctgggcccgttcatggtggcactttcctttttcacggtttgtgcttctactgtctatcccagtttctgtctcagtgcccttttgcacttgttgccctccgctttaccctgaatgcttttgcttttcatggggtgtcttttttcttaactt

SEQ ID NO: 252 - DNA, 776 bp, Homo sapiens
tcactctagggagaggatccgcggaattcaagaccagcctggccaacacggtgaacaacagcctatctctactaaaaatataaaaattatattaaagtgagcaaccctgcaagcctctctttggagaagtagcagatgaataaaacttcctgtgttgtgtgattaaaaaaaaaaaaaaaaagccaggcatggtggtgtgcacctgtaatcccagctactcaggaggctgaggcaagaaaatctcttgaacccaggaggtgcaggttgcagtgagccgagattgcgccactgcactccagactaggcaacagagcaagactccgtctcaaaaaaagaaaaagagaaaataaagaaaaaggtcagagtcagaaactaaattggagagtgttacttataaccatcctgatggctgggagtgttgaactaaagtatgtttgtaagatcaatgactggcatatactcattttacctggatttccaaataattcttcttcattaccactattatagcttaaaaattttactacaaaatctttgtgtcattatcccttgaaattaaacaaaataaaatttaatgtgcaccattttactaggaaaattattctccttagtggttaccctaaaaattgcatttttgtaatacaaaagtgtacttctcgttaaattaaaatcataaattggcccattagaaaacaagttctaaacttaagtttttatggggttattaatattgaaaaattttgaaaaagagggaaaaaaaaatttcttttctattg

SEQ ID NO: 253 - DNA, 771 bp, Homo sapiens
  misc_feature (1)...(771): n = A,T,C or G
ntgagccaaggtcatgcctcttcactccagcctgggcaacagagtgagactctgtctcaaaaaaacaaacataaaaaaacaaaaacaaacaaacnnnctaaaactctttaaatattgttttagtgtaaaggggctctgaggccaaaaagtttcagaacttctgccttataacatcctaagaggtaaattttattatcttattttacaaatgaggaaactgaggcacagagaggttaaaaggctcacccaaagccaggcagctggtgaaggtaaattcagggtcagacctgcgcagtctggcctcgagtctgtgccataaccttctcatccttgttccttacacgtgctaagcactctaaaccttctggatccttccaacaacccaaatgaagctgacatattattgctgtcccctttcttttcttttttcttttattgagacggattctcgctctgtcacccaggctggagtgcggtggcaaaatctcagctcactttaatctctgcctcccaggttcaagcaattctcctgcctcagcctccttagtagcttggactacaagcaccctgacaccatgcccaactaatttttggatttttagtagatacaaaggtttaccattttggccaggctggtcttgaacttctgaccttaagtgaatcacccactttggtctccaaaatgctggaattaaattttaaccattttccctgccaatgctgacccctttttcttattctttttaatttattattttttttttgaaaatt

SEQ ID NO: 254 - DNA, 678 bp, Homo sapiens
cgcggaattcagaacaaaaccaaaaacacttccttagaaaaacgaagatttatagttacttaaagctaaatcaaaagcaaaatccactcaggcttacacagccacggcagtctgcatggcttcccagggtttggacgggacactgtgctgtccaagcttatcactctgtatggtcgcccctcaccaaaaacaggttcctagagctctgtgtgctactcaggcacaaagctgtattatctacacaccatcaacaggatgaacctcttgaaatgccgagaaaggtggcggccacaggcagagccacatcagaagtcctgggctggagccaggctgacctatgttaacagcctggccctacagaccgctgagtgaccaggactgccctgagccaccagttatcaccagtaacaggggatgacacacctacctcctggggctgttgtgagaattaagaaacactaagtaaggaaagcacactctcaggtatgcggcaagtagtaaagaaaggtagctgcccttccttgatctttctgtccatagcacctgtgcccactgaacgcccctgcatttatctgtgggatctatgccattgtacaaagcttcaataaaataatgataaaatacaattcttaaaaatcataaacaagagaaaccaaaataaaaacgaaaacaaaaagg

SEQ ID NO: 255 - DNA, 759 bp, Homo sapiens
cgcggaattccactgctatgaattcagcctccagatattaagctcaacaataatacacatggctccagcaaggatgctaaaagtagcacagtttgagaagcaacttacttgtgcattggtgaagaccaactctttttttttggagctctgtgtgtgtgtgtgtgtgtgtgtgtgtgtactcacatagaaagactggccaaaaaaaaaacgcatattggtgaacaaaagatgcttgcacaaaaacaaaagccataaacacacatttctatatgcacagagcatctgtgatagtacacaaaataataactgttgtcacctctgggaaagagacctggaagactacagatctgggatgggccaggtgcggtggctcacacctgtaatgccagcactttggaaggccaatgagggcagatcacctgaggccgggagtttgagatcagcctgggcaacacggcaaaattctgtctctatttttgtaaaaatacgaaaattacccaggtgtggtggggcacaacctgtattcaacctacttcggaggcttgaggatgagaataacttgaaccccgtaggcataagttggaatgagcttaaatcaactcacctcactttaaccttggtgaattgaacgagaacttcttcctcaaaaaaaaaaaaaaaaattttgtttttggaagtaagaatttattttttaactttttgaaacattttatttttggtttgaaatttttttataacaaacccttttaaaaaattttt

SEQ ID NO: 256 - DNA, 547 bp, Homo sapiens
tcacaaaagcattcaccaaaaggcatggcatggagagatctggatgtgggcagaacatcaactttgttcattacaaatacttaccaaattttcacactggatgctgtaaaagtttcagctgtggccgggcatggtggctcacgcctgtaatcccagcactttgggaggccaagacagatgaatcacctgaggttgggagttcgagaccagcctggccaacatggtgaaaccccatctctactaaaaatacaaaaattagctgggtgtgatggtgcacacctgtaatcccagctactagggaggtctgaggcatgagaatcacttgaacccaggaggcggaggttgcagtgaaccaagattgtaccactgcactccagactgggtgacagagaaagactccgtctcaaaaaaaaaagaagaaagataagaaagaaagaaagaaaaagaaagaaagaaagaaagaaagaaagaaaaagaaagtttcagctgtggaaaatgttaaggggaggaagacagtgctaggacaagttgttaggagggcacctta

SEQ ID NO: 257 - DNA, 637 bp, Homo sapiens
gggaaaggatccgcggaattcagactaaaatagtgacatacccttgcattggcacatcatctccattgcagcatcacattggaaaattaaaatatcataagcctgggtgtcacagattaaacataaagaaggctatatccatcttttaacccaatatgaagaaacacaaggttataagagatctatggattggaatcacactgagtataaaatcactgatcagttccctccacagcctccctacaaggggtcttctgtgctgtgagccactgagctttgcctacagagtaaaaaatatctcacacacacatgtgctactattttttaaatgttacataaatctactgtaattaccaaaacctactcattcaaaagcattactaagttgatggcaactttcgatcaatctgtttttctttttccactgagagttaccaaacccacaattctcataccgaggagctggataattttttctgacattaaaaatgatggcttggttttgaacactgtcagtgtcctataaacatacattcacagaccattccctacttgaacatttaaggcaaattttgtcttttaaaggaccagacccagaagcagacatgttatttaggctttgcaagccatattgata

SEQ ID NO: 258 - DNA, 676 bp, Homo sapiens
cgcggaattctcagatctgcttcttcatttactgtgttatgacagcttgttttgattgaagtatattaaaaatataaagccctcctcagatggaaaaatagaattcaaaaaacctattcagataaatgtagctattcttctttgatactatacccaaaatcaacacgttgcatttaaaaattattaggtgtattatggatttgaaactatatcaatatgcatttcctactctgctatattaaaatccattggtatctcttgcgtatcgaatagttcttttagctctgttggattttgtaacatgatgcattaatcgtttgaaagagtttggttcactgtttcttcagatcttttctttttcacaatatattttttaaaatcatatttattcatgtctcagtgatctcattagcagtcttgagtattgaaaacatattaagcttgtgatgatagatacaaagtttcaaaaattattattgttacttgaaagttcagattttatcttgggtatcaaatgtcatcagtttccccccgcccttgaagtgacaagcagctcacttgattcatatttgagaaaatgtctgccaaattccaaaatctgaataactcacagtttgtcagtttgtctttcatacaaaaaaaggacttccatgaacgtttttttttttttagctta

SEQ ID NO: 259 - DNA, 710 bp, Homo sapiens
aaaggtaactggccacttttacaaggggaaataaaccaactaaacgtgacattggatttttcccagattctttattaatggtgcttctgcatcgctttacctattcaagtataagttacagcagataattcttctgagaatgatctcctaaggcatgtcttcctctttgcatttttatctggaccctgtcccatctatagggtcacattttttattagaaatgttgctgaagatcccctcaaaataacaaatacgtgtgacataattatatatgctttatgtattttacatatacacgtgtacacttgtgtaaggaattattagttttggttaaatagtattttatatatgctgcttcatataacacattgcaaatgcttcccgtgagattatattatcttcaagtcatggttctgatggagatttaatatcctatttatagcatgtctgaaccacatttatttaatcattttaatgatggatattcaggttgctttcaaaggcttcttgctgtcataaataatggttaccatgaacatcttggcacatatatctctttccaaaatgtttgattatttccatagaataagttattagatgatgaactagaaatatacactttaaaaagtatatcctgatttctttatgcagtcccttattaattaccatttaatgctaattattaataaaaacaatagcaaggggatatt

SEQ ID NO: 260 - DNA, 698 bp, Homo sapiens
cgcggaattctcagatctgcttcttcatttactgtgttatgacagcttgttttgattgaagtatattaaaaatataaagccctcctcagatggaaaaatagaattcaaaaaacctattcagataaatgtagctattcttctttgatactatacccaaaatcaacacgttgcatttaaaaattattaggtgtattatggatttgaaactatatcaatatgcatttcctactctgctatattaaaatccattggtatctcttgcgtatcgaatagttcttttagctctgttggattttgtaacatgatgcattaatcgtttgaaagagtttggttcactgtttcttcagatcttttctttttcacaatatattttttaaaatcatatttattcatgtctcagtgatctcattagcagtcttgagtattgaaaacatattaagcttgtgatgatagatacaaagtttcaaaaattattattgttacttgaaagttcagattttatcttgggtatcaaatgtcatcagtttccccccgcccttgaagtgacaagcagctcacttgattcatatttgagaaaatgtctgccaaattccaaaatctgaataactcacagtttgtcagtttgtctttcatacaaaaaaaggacttccatgaacgtttttttttttttagcttaaaactcaaacaataacataatt

SEQ ID NO: 261 - DNA, 732 bp, Homo sapiens
accagaaaggtaactggccacttttacaaggggaaataaaccaactaaacgtgacattggatttttcccagattctttattaatggtgcttctgcatcgctttaccttttcaagtataagttacagcagataattcttctgagaatgatctcctaaggcatgtcttcctctttgcatttttatctggaccctgtcccatctatagggtcacattttttattagaaatgttgctgaagatcccctcaaaataacaaatacgtgtgacataattatatatgctttatgtattttacatatacacgtgtacacttgtgtaaggaattattagttttggttaaatagtattttatatatgctgcttcatataacacattgcaaatgcttcccgtgagattatattatcttcaagtcatggttctgatggagatttaatatcctatttatagcatgtctgaaccacatttatttaatcattttaatgatggatattcaggttgctttcaaaggcttcttgctgtcataaataatggttaccatgaacatcttggcacatatatctctttccaaaatgtttgattatttccatagaataagttattagatgatgaactagaaatatacactttaaaaagtatatcctgatttctttatgcagtcccttattaattaaccattaatgctaattattaataaagacaatagcaaggggatatttatgatttaaacatgcc

SEQ ID NO: 262 - DNA, 877 bp, Homo sapiens
ccatagggagaggatccgcggaattctatttttttctcccttcttttctttcctttcctctcttattcgatttttatcaaaatgatacgtctaatttttaaaagtcagatacaactgaagaatatttattccttatgcatgaggtccctattgctgtgttttgacttcattggctgcagccagacctcacaatttaaactaaaacccgattagctaacagttcaaaaattttttaaataggtaaaagcagtgaggaacataggaaaaaaggatgttccttacgaaaggacttagaaaagtaataatattcctaaataaggaagagtgtaggctgcaagctgggacatgcctgggcacgtccagcacgaatattttgacaaaggtacaaggacatagaatgtactacgtgcctgtgagcatgtttagcacagataccgaagtcagagtgtgcttattctgttacatttgctacctaaggcttaacagagagttattactataaaataaaaaatttgaagaaagttagttctgagaaaagatattaataacatttatgatttaaaggggaagctttgaagaggaacttttgctttctacatttccttcccttttaatttttataatttttcctttttaaactgttttaacatgttttggcttaattgttctacttgagctttttaaaaggagaaatttcttataataaggtggaagagagttaagatagggttcttagtgttttttttttttatctgctgtgtttttgggggaaatgtatttttcttcttaattcaatgttatatattttcgtatgttgtatattagtgttaaacatcatatctcttttttttttttgttataaataatttatttttgt

SEQ ID NO: 263 - DNA, 655 bp, Homo sapiens
aagtgacacggcaaaagctgagagatgggccaggcagcctcgtcccaaacaccaggtctcagttcccaaatgtcctctaggccccaaggggacccaatgagggtcacacgtgggaacaaggggtgacctccaggagccctacccgtgaggcttctgagcgggggtcccaggcctctgttccccacactccactgagacatcaggtatggagctggggccaggggccactcaaattgaccttaccactggccgcagcccaggcagccactgacattcagtctgagcgtgctctctcactctctctctccctctcttttaaaaagctttttttcacttccctgggggaaacatcttagcaattcctgaacgcagctctgaagatgaagggcgacttagaaacaatggaatgaaggcggtcccctcccatcaccccccctcagccggggaggcccctgggcctcgctccatctgcgatgcacagtctgtgatcaccttccttcgttcagcccaccatgtgcctgagccttctctgagttcccagaaggtggtcgggaacaagctccctccactaggcctggcagcctcctggggaaggacagacagtcaacaagaaagcaaacaaacgcagcaacggcagaaaaagcttcgtgctgct

SEQ ID NO: 264 - DNA, 579 bp, Homo sapiens
cgcggaattcagagaagaaaaggaaattcccgggaattctcaaggattcatgaaatcatgggttattcgtaaaacatttttaatgtttttcatattttttactcacttttatccatgtataacagatcagaaatattcagttaagttgcatttacaaatatctgtagcctatagtgaacaggcaaacactgtaaaacaccagcacgcattcaaacacagtaaaacatcagtttctagaaaacatccgattaggatttcatattaagattagcagtgatgcatagaagcatagaactgggtgtcaaaattgccaatttagggacttacttgcttccaaggtgtgttatttttgatacatccttcctggagtgtgtataaagtatactatgactgcaagtgtattagcttttcttttatcagcaacaatgactcacttttggcagcagacagagccaccagcagacatcatagtacggccacaactacaatcaagactgacccatgaaatcatacgggttctacttctacgtgctcctgtcccaatgacccccaatgttaactttgaagctggatgccctt

SEQ ID NO: 265 - DNA, 966 bp, Homo sapiens
gaattctcgctgaaaaacttgcattctggttatctatcactgtatcagtaaccaccccacacttagtgatttaaaacagccatcgatttttcttgacaatttgttgtgtcagaaactcaggaaggattcagctgggtggttcatcttgactccaggtggcatcatctggggcagctggtggaggatgacccacttccaagatgactgctaaagttcaagatcagcctggacaacatgacgaaaccccatccctacaaacaaacaaacaacaaaaaaaaaattagccatgtattgttatatgtacctgtattcacagctattcaggaggctgaggcaggaggatcccttgatcccgggagttggaggttgcagtgagccaagattgtactaccacactccagcctggatgacagagtgagaccccagacaggggtctcattgctaaaaggactgctaaagtcacacatctggcaccttggtgctctttggcctctctctcttccacatggcctctcatccttcattacctgtccatgtggcttgaccttctcacagcttggtgggctcagagcagtcatgattacattctgaattaatagttgaatgcgtaaagtaaatgcaggcaccaaataacctgcaggcttccaaaaatgaatattttaaggaattaggctgaagcttcaaggcttcttaagctgcagtctcaaaagccccaccatgttacctcccattatactttattcttcaagcagtttttttaagccaccccaaatttcagggcagacccttcatgttgtttggaggattaaagaatttcaaacaattttaagccctctttaatttcccatttggggtttgctaaactaactttgtaatgcctgttcgtaaaggcccgttttttgtccccaattattcaaaatctaattaaaagttttcaggaatttaattaataccttccttgttttg

SEQ ID NO: 266 - DNA, 775 bp, Homo sapiens
cgcggaattccaggttcccgtcagtggtaggaagatctccatggcacgatctctggaacctgcgagtacatcaactagaaggccacgtctgagcaaatgtgattaaagtaaggatgtggaggctgtgcagctttcctggattacccagatagagtgtaaacgcagactagtcctcacgagagagcaggggaagccccgacacagaggtggccacctgaggacaaggcacggagaacaggctagtttggacacccagggcattccagggtccatgcctgtcctgggactccactcccttgctggtgaggggtccaggcattgccaggaggagcccagcagggcgtctgggaggcttcgtccttcttcggtgcctttgcccgtccaggacacacctggcccctgctgcgtgccaggccctgagtctcgtagtaacagaatggactttgatgctgttcctctctctcctgggctggccaggagtcactgcagctgcttgacaaatgtcacccaggttgagtgtttttaaagccctgtatctattctatgaaagatagaatgttaaaacatatattaaaacctttatttttctgtcaacatcagatgtacttccatttgcccgacttgcatttttcagggcttgttgaaaaaaaatagaattttaacttctgatttttaccagcagggtcaatcttaccccaatttttaatttacccaggttccaagttttacaaggagggtaacttaacccaatttcttaattaccaggtgaaaatga

SEQ ID NO: 267 - DNA, 684 bp, Homo sapiens
ccacttcctcttaatttgcttaatttaaacaagagggaacctttgtatttctctacatgtgtgcctctcagcctcctgctggcccagaagcccagtgacatcacaagttcctggctcagctgcctcccttgttgtcagatgaaatctctttttccaaagcagctcatgggggtgctttgaccttgagcctttgaggccagttctgcaaagaggacttccaaaaacagtggtcagtgaggaactaggctcataaggtaccgttggcaggggtgaggccctcctaccttcttccgcagcaggcagggacaggggcggcgtccaggatcactcacaggcagggacgagggcagtgtccagggtcactcacaggcgggggcgagggcagtgtccagggtcactcacaggcggggacgagggcagtgtccagggccactcacaggcgggggcgagggcagtgtccagggtcactcacaggcggtggcgagggcagtgtccagggtcactcacaagcgggggcgagggcagtgtccagggtcactcacaagcgggggcgagggcagtgtccagggtcactcacaggccggggcgagggcagtgtccatggccactcacatgcggtggcgagggcaatgtcccaggtcactcacaagctgaggacaaagcggtgtccaagggtcactcaca

SEQ ID NO: 268 - DNA, 899 bp, Homo sapiens
cgcggaattccagattccttttgtaacatacacgataattttatttttaggtttttaattttaagttctgggatacatgtgcagaatgtgccggtttgttacataggtatacatgtgccttggtggtttgctgcacccatcaacccatcatctaggttttaaaccctgcctgcattagatatttgtcctaatgctctccctccccttgccccccaccccccgacaggccccggtgtgtgatgttccccaatctgtctccatgtgttctcattgttcaattcccacttatgagtgagaacatgtggtgtatggttttctgttcctatgttagtttgctgacaatgatgactttcagcttcatccatgcccctgcaaaggacatgaactcatttttttatggctgcagtaatgtatacaataattttcaataagctttgtatcccttttcttgctgctgcttctacttgtgatttaaattcttccactgtcatctcactgtgttttctctgcatttcttactccttactggtagtaaagcttatttggctctaaagacaatcatattatccattttctagatgctgttgagaggaaacaaaaatagagtaaactttattcaggatccaaaacatacatgctgaaaacaatcagaatttaacagaaaaatctcagctctgttataatgaacttcaatacaaatcctacatgagaaagtcccccaaactaatatggctaagggtttaaaacataaaacgagccaggcgtggtggctcacgcctgtaaatcccaccccttttggaggccaaggtgggtggattcatgaggtcaggaattctaaaaaaattttggccatcaatatttaaaccccttttttccttaaaattcaaaaaatttatccc

SEQ ID NO: 269 - DNA, 671 bp, Homo sapiens
acaatttttttaaggtagcagtgattacaaaacaatgacatttatgggttcttactaagcggttgggtggggctgcccctgggccaatgttttagaggactctgttacttcacagagagccaaagggacatggtcacctgcagcctctcacctccttctagccaacattccaggtgcccaggcctgttaagaccgtgagataagcttgcaggtgcaagcactgaatttggaaggtgatcccagaaaccagtgcaggagagtgtggtggtgagatgggaggcaaacacatatacgtggtacattactgagcatggggggtcactgcaaggtgccaggctcactcccacggggaaacccaggagacagtgtgaaacatacctcagacaacccaacaggagatgaggaggcagggatatgtatccaccatctcctgtcagtcacaggtggaaggtggctccaggaggcattacctccccacactttcagcctgcccatggatgagcagaatggattccagccaccatggaaaactcccaggaaaaatcacaggcacttggatttggagtctgaggtccacattcaaggctacagcgagtgctgggaggctacaggtcacgcaccatcaatgtctgccattgcaagaccctaaaatgtgttgtccaatgggccaa

SEQ ID NO: 270 - DNA, 656 bp, Homo sapiens
  misc_feature (1)...(656): n = A,T,C or G
ggttttagtttttttntgggtgcttgagaccttgagagccgtcgncattaactctactaactatccggagaggatccgcggaattccatttagatgaactttctaaaaaaggcaaaactatatggacagaaagcatgatcagagatacagaaagggctggattttgaagcacatattaatcgcaaatagcacaagggactttctgcataacggtgttccaaaactggattgtggtacaggctacacaattgtataaaattactaaactccatggcactatacgcttaaattgttaagttttatggcatgtatatttcccctcagtagggctctggaggtgttgacaatatgagaggagtaaagtccgttttcctttggtcaggtgtgtgagcttcagctttgttctttgttcacaaaagttcgcgacaggtaagatgtttgctgggactctttgtgctgccattctttgccacaagatggctgtgccatctattatttaaatggcaggtgctgggctttcaaccctgtggttaggggtcaagaatgaattaatgggggtttggggggccaatcagtcgtttataggggagaaattattctcctttttttcttgataacattttatttaaacttatttgttctttttttattttgat

SEQ ID NO: 271 - DNA, 581 bp, Homo sapiens
  misc_feature (1)...(581): n = A,T,C or G
cgcggaattcagttttaagtgtagtgaaacacagtctgagctttgtctctgaatgtgaaagaagtgtagagtttaactttccttataggccaagatgaagttcggaatccctgatagctcagtaggaacctttgtaaggttgtcactgactgttgcaactctttcatgcagtcacaaagcctcagccctgagtttagtgattctgttgacagtgagttgtgttgttttcttttctttttttcttcagcttttaagttcagcagtacatgtgcaggatgtgcagatttgttacataggtaaacgtgtgccatggtggtttgctgtacagatcatcccatcacttangtattaagaccagaatccattagctattcttcctgatgttctccctcttcccccaccccacccccaacaagttgtcaagttgtgtcattttctgtaaagtgatacttattatttttttctttttctttctttctttctttctttctttctttctttctttctttctttctttctttctttctttctttctttctttctttcctttttttgggggggtggggcagaatatttatttt

SEQ ID NO: 272 - DNA, 930 bp, Homo sapiens
attctcaggacaggcctcagaatccacccctgtgcctcgtcgagcccctctagggaactctgcaggacgggcctcagaatccaccccgtgcctgcaggggaaagtggtcagcacatgccctgttgaggacgttctcaggatacacccgcatgggagtgaagacagtagaaggggaagaagaggggctaagcaaggtcaggtccaggtgcagcacagccagctccttgaggagctcttaagaatgagctgtgctgtgcatgggtccctccttgaggcaaacagcctgggcttctcaccccaccaggtagtcactgggcagagaagcggggtgagcaggacataactcccgggtaactctgagggacacagctccactcacctaagggcagtcttctacggaagatgtggcaggagctgtcggcaacacacgcagcccctggggaggagttcaccaacctagccacagggaccccaggaagcctgggtactcagagagcacctttcataacagcgtctgctattattactcaaaagcaacacccaatgtctgctccataccaggacctcctcccccatagtaaggggaaggtaggtctatttttctaatttttttttatattattttttttgttatttttttttgttattttattttattttatagtttatatttgtattttttttatgatttttatatatttttttctcattttattttctttttgtttgtttcttacgtttcatttactgtttctatatcataatgattctatagcgtaattcttattttgctttttattatattctgcggcatcgtgtatcttatttagttctccatttttttatattcattaattttatttttattattaatgtagatttattttattgtttttttttgtgttttattattatcttcttgtatttatt

SEQ ID NO: 273 - DNA, 912 bp, Homo sapiens
  misc_feature (1)...(912): n = A,T,C or G
ctctatggagaggatccgcggaattccctttgacggtttttagggaatttatggtttttggggagtttatggagtgcaggccccgtccccgggctttgggttgcactgattggttgtaacggcccctcccgcccagggcaccctggctggcgggtgcatgtgtggccttgctgtgccatggtggtggcgcctgggcctggcccctgcagatgaatgagggcccgacccccatactcatctgtgacccaacctgcatggggcctgggggcagggagagcaggtgtcatcagccccattttacagatgagaaaactaaggctcagagagtgtggataacctgtccacggtcacacagcacacggtcagtgatggagctgtggtgtggtcccagcaaccacgtctgacccactcagccatgcggggttcccctgcaccggcctcctctgggggctgaccctcggttggagtgacccccttgctccaaccttttccgcanggacactgccagatcccctgaatccgtctgtctgaacaactgtgggaaagactgagaccgcgggaccccatcccactgtccacaggggaagacgggatcgtgaggaaaaaaattgcaaacacctgaacacatacacgcctttcatgcggtcattttgtccctaacataaataactgctttatttgatcctaacatccaacagttttttcagcacttacccatcacttcccactttatttttggccctgttccttaaggcactgtaagggttgggggtgggcccttcttgaaagggttcctctgcacaatatactgttttttatatggcaatttatgggttaaacccctatgaaatggggggttctttttttatcttccctttattattatataattaatcacttgagttaacaagt

SEQ ID NO: 274 - DNA, 1067 bp, Homo sapiens
caccagcggcgcagacacccacccgcggctggacgcgcggagcccgccctgggcctccctccccggcttcaggtccccgcctcggccctgcccacctgaggctgcgctccctgcaagtctgcggcccccacgcggccctcggccccggcgcgggtcttctgcggacgcctccagccagctccgggtccctgcgcggaggacgctgattcgtgtcgttaagcgggtgaagcgggtgtagacagaggtgcgtcctgccctccccacccgctgcccccgcagcagccaccgagcctcgaccggcggcttccgaatgcacgaagtccacgctcctgcccgggaccctgagtcggggcctggtccacgcgctgccgccgcctctagagccctgacccctcccgggcacagcgggcccgtccccggaggcgatgccgggcccgggtctgccctgcggttccccctcccgcgctgcttcctgcccgcagtaggggccgctcctcaccgcgcaggccccgctcagaggagccccagagctggagaggcccccgcggctggagaggccccgccgtcccccagatgcccccggggccctgcccggtttcttccttcccagccccgacgcctttggcttcaacttttcccttcatttcaccggatccgcttatttcaagggagccttcatgagggcagggaattttgtccgtttctttcaatttttggatctgccagaacccaaggaccagcacctggtcccctaattatgtggcctcatagaaacgccttttttaatatgaagggaaggaaattaacctcacctaccatttgcaggaaggattaaaattaaaaaaacaattttcttcccacctctaccggtaataaggcactccctttttcctacacaatccctaaaattggaaaaaattgtgttcatttccttccctaggcttgaccacaaagtcaataaggatacttgtagatacatatactatcgtgtccttttttaaaaatgttttattttacattgggtatatatggtatgtcttgactaatgttgatttaataatatttat

SEQ ID NO: 275 - DNA, 749 bp, Homo sapiens
actcactatacggagaggatccgcggaattcaggagctggttttttgaaaagatcaacaaaattgatagacagcaagactaataaagaagaaaagagagaagaatcaaatagacgcaataaaaaatgataaaggggatatcaccaccgatcccacagaaatacaaactaccatcagagaatactataaacacctctatgcaaataaactacaaaatctagaagaaatggataaattccttgacacatacatcctcccaagactaaaccaggaagaagttgaatctctgaatataccaataacaggcactgaaattgaggaaataatcaatagcttaccaaccaaaaaaagtccaggaacagatggattcacagccgaattctaccagaggtacaaggaggagctggtaccattccttctgaaactattccaatcaatagaaaaagagggaatcctccctaactcattttatgtggccagaatcatcctgataccaaagcctggcagagacacaaccaaaaaagagaattttagaccaatatccttgatgaacattgatgcaaaaatcctcaataaaatactggcaaaccaaatacagcagcacatcaaaaagtttatccaccatgatctagtgggctttctccctgggatgcaaggctggttcaacatacgaaaatcaataaacgttatccagcttataaacagaacccaagacaaaaaccacatgattatctcaatggatgcagaaaa

SEQ ID NO: 276 - DNA, 737 bp, Homo sapiens
taccgcgagtccatagagtaaagggaaagcaagtttattaagaaagtaaaggaataaagaatggctattccatagacagatcagcccgagggctgctggttgcccattaatatggtgatttcttgatgatatgctaaacaaggggtggattattcatgcctcccctgtttagaccatatagggtaacttcctgacgttgccatggcattcctaaactgtcatggcgctagtgagagtgtagcagttgaggacaaccagaggtcactttcattgccatcttggttttggtgggttttggccggcttctttactgcaaactgttttatcagcaagatctttgtggcctgtatcttgtaccgacctcctatctcatcctgtcacttagaatgccttaacctcctgggaggcagcccagcgggtctcagcctcattttacccagcccctattcaagagtgagttgctctgattcaaatgcctctgccatttcctcttttaatctattaatttagattgctatggcagaggtgacttacttgaaacctattctgccacttttttttagtaaccacgattgtatttaggtggcagtgtacccagttaatagaccccatgtcttagccttcttggatgcaagaaatggtcacgtggccaacacaataaaggcatagggctgtttgcattttaggaatacactttaaaataaaatacaccatcttggagtgccccacttttgcct

SEQ ID NO: 277 - DNA, 416 bp, Homo sapiens
  misc_feature (1)...(416): n = A,T,C or G
cgcggaattcagtggcacgatctcagctcactgcaacctccacctctcgggttcaagcgattctcctgccttagccttccgagtagctgggattacaggtgcctgccaccacaactggctaatttttgtattttgagtagagatggggtttcaccacgttggtcaggctggtcttgaactcctgacctcaagcaatccaccagcctcgggctcccaaagtgctgtgattacaagcatgagccactgtgcccagccaagaacagtttttatattttattttcacattgaaaatcagtcacatttgcttcagcctcaaagagcgtgtttatgtaaaattaaatgagtactggcagcaaactgcacttttttttttctaaacaggaaatgggttaatgggtatggagttgtnnnnnnnn

SEQ ID NO: 278 - DNA, 389 bp, Homo sapiens
  misc_feature (1)...(389): n = A,T,C or G
atttccagtgctggagggcatcagtctttttcatttcagtcatgctagctgctgctggagtattgcattttgattttggactgtgagatctctaaggttaggaatattcattcatgctttcaacaaatatttgttgaggacccatgaagcactgggcactgtgccaggagcaaaaacaagcatagtcgctgctcctctggtatgtccaggttcaggggtgagactgacatttaacagctgtggggttacagggcctttcagtgcatgagaggccaggaaactgtgaggcagaaaagcgtgacctgttcttgtggagagagaatcagggcaggctcccctgagtaaatgactttttaagaactagctggttggctgggcacngnnggcna

SEQ ID NO: 279 - DNA, 896 bp, Homo sapiens
gactcactataaggagaggatccgcggaattctacatattatccgagggtagatacgaaaagtcttttcttgacaaatcatcccaacatttaaaaacatttacctccagaaaagcatctgagtattttctcttagacgacattcctcaacgataacctcattgtgaacaaggatgtaacgcgtggtgatggttacaaatggtaacagagcttccagtaaaatgtgttctattagtaagccctcatggtgttttagctcatcagaaacagaaaagaaggctgatttccctccctacattatattataaaaactttcaaccatacagaaaaatggaaagaactgtagagagaacttgtaatgcccacactgagactgtgcacctggcattccgcttggcctgcttcctcccagcctctcatctccccatccgtccagtcatccatcaatccttcttggtcttttgctgccaggagcctaattggagctgtcggcggctctgtctctgggaggggacatgatgatacatctccattgggcttgtctgaagagcatatggaggacacacaccctggctgccggaagagggcactgtactctcccaacagcagaagagcagacccttcaaagattggatgctcctccctgtcttgacagggccctttcctcattaggctcctccaccaaaattcgtacccagcttacaatactgcaatatagatcttaatatccaaccagaaagaaaccaggtattcccctgggtcctaaggcagacaatggcttttagaacctctatgcctctgtaaaaaggggcccttttttatatacattggaacataacattaagtgttccaaaatctttttttttttttatgattttaaaaaaaataaaaaaggct

SEQ ID NO: 280 - DNA, 913 bp, Homo sapiens
ccttaaggagttttaggagaaacttaagcaatgaagatgagagttttgcattggtgcccagaaggtttggcgaatgcaacaggatgcccttcccagaggtggatgtaagggcctgtgtctgggcactagaggatggaggcagtgtgagagccctatgggcactgctgaggggtgcaaagtggctctccttttgccagttaagaaggcggctgtggggtgcatgcccgtcagccctgtcataaccggcacgaatgatgttgtccgacaggcatggggatctacacaggaatgaaaacaactccaatttcggctactttctatgtgctgaccgatgtactgatggctttaaatattttatactaaagctgtttctcaccacgaccctatagatgttattgtctccattttatggcaacggaatcccaaaagggcaaagaggtggtgagtgcagcaaaagaaactgtcaagcagtcattaacacgggggtcccatgaagcagagatctggtacgggttgtctactgcttggtcacaaattaccttccaaactgagcatttaaacaacaaacattcactgcttatttctgtgggtcaggagtttgggatcagctgaccctcaagggttctgggtttaaggtcttttttaagtttggccagagatgggtcttccccctcttgaatgtcgataaatgggtgaatctttttccaaaaaggtattgcttcacttggcgttttaacgtctttctattcctttattacatgggtccctttttttcttccatagtgaaggtattctcttatattagtctattagtagattttccttgtttttctctaaatcttgttatcattaattttcactatctttgtatttttttattctatattttctttagtgattattgtcttttttg

SEQ ID NO: 281 - DNA, 563 bp, Homo sapiens
cgcggaattcagcaatatttctcccatttgcttttgaaagaagagaaatacggctctgttccgcctggctcaccggcagtcagagtttaaggttatctctcttgttccctgaacattgctgttatcctgttcttttttctaggtgcccagatttcatattgttcaaacacacatgctctacaaacaatttgtgcagttaacaaaatcatcacagggtcctgaggcgacatacatcctcctcagcttacgaagatgatgggattaagagattaaagtaaagacaggcctatgaaatcacaagggtattgactggggaagtgataagtgtccatgaaatcttcacaatttatgttcaaagattacagtaaagacaggcataagaaattataaaagtattaatttggggaactaataaaatgtccatgaaatcttcataatttatgttcttcttccatggctttaaaccggtccctccattcagggtcccttaatttccacaacgattattcacaacttccattttttttcttcttgcaggataaggaaaagtttttaaggtttgg

SEQ ID NO: 282 - DNA, 650 bp, Homo sapiens
acacccaagaagtattaatgtggccaggtgcagaggctcatgcctgtaatcccagtgctctgggaggtgaaggcgggagaactggttgaggccaggagctcaagaccagcctgagtcacatagcaagacccctctctacaaaatatctctacaaaatagccgggtatggtggtggacgcctgtggtcccagctactcaggaggctgaggcgagaggattgcttgagcccaggagttcaaggctgcagtgggctatgattgcaccactgttctccagcctgggtgcagagggagacctggcctctttaaaaaaatcataataattgtggtagaattggcaagccttggcaactgattggagatagaagttcaaggaggaatattctgcaattgtgcttgtccttactaaattggatgtggtgccatcaaccttcatcaagaacacacaagggaaattatccaggcacagtggtgcccacctgtggtcccagctactccaaaggctgaagctggaggatcgcctgagtccaggaagtcaacgcagcaatgagctatgattgcactgctgcactccagcctgggccacaaagcaagaccccatctctttaaaaaaacaaaaataaaagtggaaagaagggcgagtgttggtga

SEQ ID NO: 283 - DNA, 634 bp, Homo sapiens
cgcggaattcatgcagtatgactctatttttatgaacttctgggacaggcaaaactaatctagtgacagacgttagaatgatagctgccggctgggcgccgtggctcacgcctgtaatcccagcactttgggaggccaaggcaggtggatcgctttgaggtcaggagttcaagactagcctggccaacatggtgaaaccctatctttactaaaaatacaaaaattagctgggcatggtggtgagcatctgtaatcccagctacttgggaggctgaggcatgagaatctcttgaattcgggaggcagaggttgcagtgagccaagatcacaccactgcactccagcctgggcaacagagtgagattccatctcaaaaaaaaaaaaaaaaaaaaaagtgatgactgccaggggtggtacattgattgggatagggcaaaacggagcttcctggattgatgaaaacgttccgcgtctcttagggtgttggggacatgaatatatacagatttcacaactaattaggcggaggcaggaacatcacttgaggccaggagtttaagatcagcctgggcaatatagtgggacctccatttttacaaaaaaaaaaaaaaaaaaattttcaatttacctgggc

SEQ ID NO: 284 - DNA, 240 bp, Homo sapiens
  misc_feature (1)...(240): n = A,T,C or G
atccgcggaattcacgaggggacccctaacagacaaatgggcagggtaaggacaccttcaagggacaacagggcactccaggatggttccccagtgatggggaagccctcacctcccacagacctgaagaagcaatggcttccaaggcatgcaggggatggaaagtgctaaaggcgcctgtggagaatggcaagcgtgccgggtttaatgagagatgtggggggggggggcnnnnnnntt

SEQ ID NO: 285 - DNA, 573 bp, Homo sapiens
cgcggaattccagtccgaccgcacagggctcatcccgtgctcctggcatccactggcttccccacggcggggagcccgcctgacccccttgcagatgcccccactcctcacctgagcccagcacccacccggggccgcccacccggcacagcgcctgccctctgctcggccccggccaccccaagccggcgcagggtccatgctgtactcccaacccctggctccccacggcccgtgaggatgctcagcctcatgcaaaggtctcaggacgaaattgtccaggaagggaaggcgagcgggaggaagggggcgggcagacaagctgtgcggcctcttctcgcctctcctggctgcgccctcaggtccccgattcgagcttcctgcccccactgcctgcatcctaccggcgcctgactgcacttagggcctcctggaagtgcagactcgcctctccatctcaagacccttaacttacttacacctgcgaagctcctgttaccacatgtggcagcactcccaggttccacggcggggatgcgtctccgtgccctcgctcaaccgaccacgcagccc

SEQ ID NO: 286 - DNA, 473 bp, Homo sapiens
  misc_feature (1)...(473): n = A,T,C or G
cgcggaattctcccacctctagaggctttcagcaagctgaaacccaactagtacatggaaggtaattggctgtaattaattacacaaccctgggcctcttgcaaggcctcctgggtaaacaaaagcaaaaacacattgcagcaaacccctccccgctgcctaactctggatacatgagactagagtccttttgaccgtgccctgccaactgccaaaaacccgtcgacaggctgggtcctaaaggaccctcgggaagccctcgccctggggagggagcaccgaggccggctctttgcagttgctgtgtttttgctttccgcaggcccagctatgtaagccccactgggtcccagttggccaagttgcttttgttccttctttattctgtttctagtagtacaaagcagtttcagctgcttaccctcatgggccatgagctgctggaagaaggtggcagtgtggggaggttatnn

SEQ ID NO: 287 - DNA, 469 bp, Homo sapiens
  misc_feature (1)...(469): n = A,T,C or G
taacctgcccacaggggcacagtcagtaggtgacagagggggatttgttccagggctgtatgattagagagcagcctttccacacatgcacacccacacacatgcgcacacacacacatgcacacccgcacacatgcgcacccgcacacacacacgtgcacacccacacacatgcgcgcgcacacacatgcacacccgcacacatgcgcgcgcacacacacatgcacacccgcacacatgcgcacacacacatgcacacccgcacacaggcgcacccgcacacccctgtagacacaggcacatgcacatgctcacgcacactcccactcccacccccgcccccacccccaccctggtgaaccgtggggcctctgggggtcaaaagagaaagagaggggagggccctgagctccagggtgaaggaggcgttttggtgggggcgggggggtttntttttttttttatgctt

SEQ ID NO: 288 - DNA, 524 bp, Homo sapiens
cgcggaattcacagctgacaacactgcatagctcatgcctgagcaaagtttatctaacacaaacagcaaagttagtctcaaaatgaacaaaaataggaaaagcatggaactgagcagaccacagaaggacccttgcttacagagctggacaggaagtgagggcactgccttttttgacctcagtttggatgattcacatttttttgctgctctgcccatgtacaaaaatgacttcagatgttccacaggtattgatttgggggttaaaaataagggttagtaaggagccaaatttgcaaatacggaatgtcaataatgaaaattgactttgtatgtgtgcatgtgtgtgtgtgtgtgtacatgcatatataggagtgacaagtggctggcccaattaaaatttatattgattagaaagatgcttcttatagcctttgcatggtcccataagatgcattcttttgtgttacttaggaaatttaactgttatctaccataaaaattgctctagtcatttttaatta

SEQ ID NO: 289 - DNA, 774 bp, Homo sapiens
ccgcggaattctgcattctagaaatgaaagataataattttgtgttgtttaaaccatgacatttgtgataatatattacaaaaggaaactgatacatgtggtcattagactgatttctttttttcttttcttttttttttttttttttttgagatggagtctcgctctgttgcccaagctggagtgcaatggcgcaatctcggctcactgcaacctctgcctcctgggttcaagcaattctcctgcctcagcctcccaagtagctgggattacaggcatgtgccaccatgcccatctaatttttttttgtatttttagtagagacaggatttcaccatgttagccaggatggtctcgatctcttaacctcatgatccacttgccttggcctcccaaagtgctgggattacaggtgtgagccaacactgcacccagcctcaactgatttctttcactgagtgtaatatttccaaagttcattcacgtagtatgtccttcatgaacttcatttctttttcatggcttagtaatattccattgtatggatgtacaacatttggcttatccattctttagttgacagacagttggcttgtttccacttttgactattctgaataatgcttccgtgaatattcatagacaagtttacatacgttttcacttctcttgggtatatagcaagaaatattaggttagtgcaaaagtaattgtggctttttaccattatttttagtaatggtaaaataataatgggtgtaaattagagtcaca

SEQ ID NO: 290 - DNA, 629 bp, Homo sapiens
cgcggaattcaacgtggaacccagttgtttttaattagccaccctgtgcccaccatttagaatgtttatttttgttcttggaaggtttttagaaacaaagaagggaaaatggccaaatcatgcatttaaccaaactataatcaggatttgcaaaaaattttgacccaggcatgtagatcaaatgaaatattcagctaggagcagtgaccaaaagtgaatttaccagagaagacctcgcacctcgcacctggcacctcgcatctcgcagatggaatctgagttctctagaaaccaaaaagacacttgtctttcttttttgatcctaggaggaatgtaagggcgtttattaaggcaatcttataaccaaaccaaatctggaatacagtggagagcttctacctaaaaagagggaggcctggcctgagagaagattcagcagggcagaaaaggcaagaggcagaagtgaagagctcaggtgggaatcgccagttctgagagccacggcttccttccaacagtgaccgcttttcaagtcccacttctgacaccatttatctcaacggaaatatccgggagaggctctttaaaagaaaactgagatggagtttcactcttgttgcccaggctgg

SEQ ID NO: 291 - DNA, 1000 bp, Homo sapiens
  misc_feature (1)...(1000): n = A,T,C or G
ctcctcgaattccccgcttcgcagcaaactccttcatgcgggggaagccggaggagaaggcccagggaaaatgggttgtagacaaatgacaggcgccccgtcctgggggaatcaggaaggggcgcttgtcntttgtctncagccctttttccctgggccttctcctccggcttcctctgcttgttggtgtttgctgcgatgcttttgttttcgctgtttttttttatgcttttttatttaggtctagtttcttttattatttgttttcttttcttttttataaacctttttgttctttttttgttgaatgccttattctctaatttacattttatttttctttttatttcattcttttttgatttttctttttttttctttttattttgtaaagccttttttttttatttttcttttttttttatttttttattcttttttcttatttatatcctttttaatttctttttttttttttatttctttttttttatattttttatctttcttttttttttcttttattttttctttttataatactttttttttttctattttattttttgtataatcttttttttttttatattcactttttcttttctcatctatttttatttcttttcatgttatttaatctctcttattttcttttttatttttgtgattgttttttttttttttattatttatatttttttttttctcttttaatattcttttttttttttatataatctttttttattatttttttatttttaattatctttttttttttatattttttttattttttctctttctttttttttttttttttcttatattttcttttatttcctttttttttttaatatcttttttttttttttttttcttctttttttctttttctcttatcctttttttttttttttttcttttttttttcttcttatttttcattattattttttcgtttttctttttcttttttttttttttttttctattt

SEQ ID NO: 292 - DNA, 703 bp, Homo sapiens
  misc_feature (1)...(703): n = A,T,C or G
cgcggaattccagcaatgcaagtttcaaaagaccctgtgtgccctaaggaggcactgctgatcacttagtgtctgtgaaggcatcagaaggtgacctggacctggaatgatgaaacagccatgggtttaggagctggcagatggtgtggctggagcacatgtctggaatgtggttggccaggcccaggcagcactgggctatggagggacttaaatgtgaggctaagagggctgaccctggtgagggaatgctgtggactagatttttttattgaggtaaaatttacacaatataaaattaacttttaaaaatgtacatttctgtgacatttagtccatgcacaacattgtgcagccaccacctcttagttccaaaatagtttcatcaccccaaaggaaatcctccatccattaagcagctgtcacacatttcatcctccctccgacccttgacaaccaccaatatgctctctttggatttacccattctgggtatttcatataagtggtatcatacagtatgtgacctttttgtggccagcctctttctgcacattgcttttatttttatctntgtagacatggagtcttgctatgctgcccagactggacttgaactcccaggctcaagcgaccctcccacctcagcctcccgagtaactgggattacaggtgtgtggccttgtgctgggttcttaacaca

SEQ ID NO: 293 - DNA, 661 bp, Homo sapiens
  misc_feature (1)...(661): n = A,T,C or G
cacctggaattatcccggtgagaagccttttgaatgcagggaatgtgggaaagccttcagcaggaagtcacaactcgttacacatcacagaactcacacaggaacaaaaccctttggatgtagtgattgtagaaaagcattctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaggtcacatcttatatcacatcagaggacacatacangggagaaaccctatgaatgcagtgaatgtgggaaggcctttggtgagaagtcaagt

SEQ ID NO: 294 - DNA, 397 bp, Homo sapiens
ggagaggatccgccgaattcaggccaggcacagtggctcacacttgtaatcccaatactttgggaggctgaggcaggaagatcacttgagcagaggcattcaagaccagcctgggcaacatagggagacccccatctctacaggaaacatttttgtaatcagctgggcatagttgagcacacttgtagtcccagctactcacgaggctgaggcaggaggatcgcttgagcctgggatgtcaaggctgcagagagccatgattgtgccactgcactccagcttgggtgacagaggaagaagaaagaagaaaggaagacggaaaaggaataagaaggaggaggaggaggccacaattcactctttttaaaaaatgaggtttttataggaccccttttaa

SEQ ID NO: 295 - DNA, 791 bp, Homo sapiens
  misc_feature (1)...(791): n = A,T,C or G
attatcttcttttatactcttggtacttcttatcgcttatttctacactgtttgaaaggtttgtctttgttcttgtagcaatagttttgccgttgtgtgtctactgtactaagacttggggctcaatgagctttttggcccatttgattaacttacatatttttctccataggaagcagccatcagttgctgggtccagttcagtgatggctcagtcacgcccttggatatttacgatgggaaagacttctccttgatggccacatctttggatgagaaggtagtctccatccaccaagaccccaaattcaagtggcctatcattgctgcggaaacagaaggacaaggcaccctggtcaaggtggaaatggttattagtgaatcctgccagaaatccaagcggaagagtgtgttagctgttggaacggcaaacatcaaagttaaatttggccaaaacgatgctaaccccaacaccagtgacagcagacacacaggggcaggggttcacatggaaaacaatgtcagtgacagaaggcccaaaaaaccctcgcaggaatgggggagtcaggaaggacagtactatggcagttcttttatgggactcatggagggacggngcaccacgacagacaggtccatcctgcataagaagaaagccaggaaagccttttagatgacaacagccactttcagaccatcccaacgacctaaccaacttccagcccaggtggacctccccaaaaccatgggaaatggatgggaatgaccttatgcaggctttccaaagggct

SEQ ID NO: 296 - DNA, 557 bp, Homo sapiens
cgcggaattccatcaaatcagctcaagctcgctctggctgggggaagcaatctgccatggtcctggggcatctttgtgtgtacttgctgcaaggatagcgtcccctgatactgagcactgtctgcagatggtatggaggcaaccaaggaggctgaggtgcccacagagtgactgccaggcacctgcgaactccacagggacggggactggttcgttggccgcgcgctaccacaggcctgcagccctgggcttcccagctgcggggcatcctgctttgtgggtagccactgcaccgtggcatttgggagagagaagcgggctctgtgatgctgaggctctctccatttcctgtaccctgtgagtgacaaacgccttgctccgattacagcttgttgactatttttggcaacttgctggccagcctccacattgacattggggcctagttcccgctcctctcctctgtgaggctggagccctatcccgacggccagtgtctcagcaacagcgcaaggtgggggagtctggacatgtgggctctgacccctaaagtggga

SEQ ID NO: 297 - DNA, 946 bp, Homo sapiens
tctagtgagaccttgtcttcttctaatcaataacttttggctggcgttgggccagaggtggtttctgatgcctggggtggaggctcaggactgacctggtgtggaaacttcattgggacctcctgcgaactagggcttcaaggagagaaatggacaagagggaaacactgcataaatgcactgccattgcctcctaaaaatagactgagctggccgggcgcagtggctcacgcctgtaatcctaacactttgggaggccgaggcgggtggatcacctgaagtcaggagttcgagaccagcctggccaacatggcaaaaccccgtttttactaaaaatacaaattttacccaggtttggtggcacgtgcctataatcccagctacttggaaggaaaatcttttgaacccacggggtggaggttgcattgaaccaaaatcggccaatttaaatccaccttgggaaaaaaaacaacactccttttaaaaaaaaaaatacattataaaaatggctgttcttttttaaaaaacaaaacaaagacaatggggtttttgtcctaaaaggcacttaactttacctaaaaaaatttctccccttccaaaatgttttttctaaacccttaaaaggggttttcattcattgaacttttcaataaaacaaaaaaaaatttttcttaaacaaaatggtcccccctttggattttccaaatatggggtaaaatcagggtgttaaatcttttttttcccaaaacttctccaaataaaaattataatgggtgccaaaaatttgactctttcccccttttttaaaaccatttccaatattttgacgttgtcctctgtcccttttcggaaatatttaattttttaacttaaattctctttattcccttttagtttggttttaaaaatttaattaaaattaattctttctctcttaaaaaacatt

SEQ ID NO: 298 - DNA, 724 bp, Homo sapiens
tcactataaggagacgatccgcggaattctacctgatgctccatgtgtttccactctgtttccacgctggctgctgagaacataaactattcccagccctgcatgagttccaggaattgttcagcctgctgctttccagtgcttcttttcctggcctcagtgcaagtcagtactaagtcaaaggactcaggggactcccagcagacttcttgagccctgtatctagaaggatcccatctctccagtactttcccctggaaattctagctgctgtggcctccccaactgccagtcctgtctcttcaattcagcgagatttattgtttcccttccctgaactgcaacctaggaactgccgtgcgggggcaggctgagaaaccatggtgctcacctcactctgtctgcagtctcctgaggatcacaaacctgtgcttgtcctatgtctaaaaaccattacctattatacgtattgtatagcttccagttgtttaaggcaggagaggaaatctgacccttgttattccatcacagcagtaaggagaactcttcacatttaagtaaacacacctcacacttacaattcactgctttttgtataattgatgtataaagaacaccactttcttacagaactatttcaatagcatcatgcttgtcaaattcttacattattgagactactcttcagtttgaacctctgtaggttttattctcaagtgtacag

SEQ ID NO: 299 - DNA, 1001 bp, Homo sapiens
  misc_feature (1)...(1001): n = A,T,C or G
cacatctgcatatctttaatccatctggaatttgtgaatgtgaggggtgtgtttttttccaaacagaaagccatttgtcttgatatcatttgttaaataattcatccttccccccaccgatttaaagtgccatctttgttatgtactaaatgtctagctacacagaatctgtttctgaagatactgttttgttttctattattgccctaatatcattctgttttacttactagagatttataatgtattttgaaacataatagggtaaggcattttaaagtatttgccttgattttttatatatctttagttttctataaaactttaaaagctacatttcaggaaatccctattaaatacatagattaatcaaaatcccatggtgattcacctagtgaatctcgccatttattcaaatattttttcctattgtttagtaaagttgtttagtgtttgtaattagtgctataactagaaaagaaagaaaactatgaggaatgaagggttaaacctgcaatacaattcttaatatcttttactacaaggcaaacagattttctttcttgaagaggaagcctaactttctttgttgttgttgttgttgttgtttgcgtgtgtannnnnttaaaaaattaacattctccttttactataaaattttatggctttaactaaattaccctttcttcggtatgtaacaaaattcgttttgaattacatggcgtttatattatgagtttatctatattctcttctcaataaagatattttaattttttctctaaaagtataatctttatatattatattctaatgtcttatttcctaatttttaaatccatctcttactttttatactcttcgattataatctttatttactatattaaatatttcacttgtttaatctttcttaagtcttattgctttattgattatatttaattttacatttgtttatttctgatatatttcttgttcttgtactattctcttttatc

SEQ ID NO: 300 - DNA, 600 bp, Homo sapiens
cgcggaattctcagactcaaatagatcaaaaattagcaaatcaaattaatgatcttagacaaactgtcatttggatgggagataggctcatgagcctggaatatctttttcagttagtgtgactggactacgtcagatttttgtattacacctcgagcctataatgaatctgaacatcactgggacatggttaaacgccgtctacaaggaagagaagacaatcttactttagatatttccaaattgaaagaacattatttttgaaacatcaaaacccagttaaatctggtgccagaaactgagacaatggtaaaagctgttgatagcctcacaaatcttaaccctgtcacttgggttaaaaccactggaaattccactattacaaattttgtattaatccttgtatgtctgtcctttctattattagtctacaggtgtatacaacagctccggagagacagcgaccagcgagaacgggtcatgatgacgatggcggttttgtcaaaaagaaaagggggaaatgtagggaaaaaaaagagagatcagactgtcactgtgcctatgtagaaagggaagacctaagagactccattttgaaaa

SEQ ID NO: 301 - DNA, 794 bp, Homo sapiens
tactccgatgcctaagaagctgtggcttccaggcaaaagctttcctacattcactacattcaaagggcttttctccagtatgggttctctgatgatgaatgagacttgacatctcactgaaggttttcctgcattcactgcattcatagggtttctcacctgtatgtgttctctgatgtgatatcaggcttgacttctgggtgaaggccttcccacactcactgcattcataaggcttctccccagtgtgtgttctgtgatgcgttaggagctgggacttcccaaagaaggttttcccacattgaatgcatccatatggtttctctcctaagtgaattttttgatgtcttattaactctgacttcttaaagaaggcctcctcacaatcactgcatcgatagttcttctctcctgtgtgagttatctgatgtttaatcagctgtggttttctgatgaaggcttcaccacattcgttgcattcgtagggcttctctcctgtatgaatcctctgatgcctaatgagaagtgagttcctgctgaaggctttttgacactcaccacatccgtaaggtttcttccctgtgtgggtcctctgatgagtaatcagctgcgacttccaaaagaaagcttttccacagtgactacatggatagggtttctctcctgtgtgcgctctctgatgtgtgatgagttttaattttctgggagaatgctttcccacacttactgcaactgtagggtttctctattgggtgcgttatctgatgtcttttaaactgcgacttcctactgaa

SEQ ID NO: 302 - DNA, 573 bp, Homo sapiens
cgcggaattcctaacttccgagggaacacctatcaaacgtcaggaagccattaggagattattattggctgtacagaaacctaaagaggtagcagtcttacactgctggggtcatcggaaaggaaagggaaatagaagggaaccaccacgcagatattgaagccaaaagagccgcaaggcgggaccttccattagaaatgcttgtagaaggacccctagtatggggtaatcccctccgggaaaccaagccctagtactcagcaggagaaatacaatggagaacctcaggaggacataatttcctcccctcaggatggctagccaccaaagaagggaaaatacttttgcctgcagctaaccaatggaaattacttaaaacccttcaccccaccttccacttaggcattgatagcacccatcagatggccaaatcattatttactggaccaggccttttcaaaactatcaagcagatagtcagggcctgtgaattgtgccaatgaaataatcccctacattacaggccatacattttaatccctgtatctttaacctccttgttaagtttgtctc

SEQ ID NO: 303 - DNA, 577 bp, Homo sapiens
catcctcggaattcactgtctggctgattattagtgaggggggacatcttttcttttgcttaactgttttttgatattccttttctgtgaattacctgctcataatatctgctcattttaatatcgctctttctttctgtttgttattcatttatggaagccacttagaggttgcatgtaccaaactgttgactattaagcatgaggcaaacgtcgctcctcaatctgaccttctcttttcacttgtgtgtggtggtggtgtttacaggaagaggtctacagttcatcgcaaggctctagagggaatcaggaagtgccaacctgaggtatgccattttggcagcagaattcttttgagcagaaagcattggagttcctaaaattctttatctgcctaaaaccagagcctcccccaaacaactccattgtcctaagtgtctccccaggaacaactgtaatcttctcttcttggatgggagaagcccccccacattctggcagacattgtcacaaatgaccatgtctcccatctgccctcctgagggcccatttatctttcaataaagtcctttgcgtt

SEQ ID NO: 304 - DNA, 607 bp, Homo sapiens
cgcggaattcactgccctttggaataatttccctcgttccactgtatagcagtttttccttgaagcatggagttttagttgcaaacgatacaacatatgccatgtaacgttcatattccctgcacaggaaaacccagagcatgcagtttgcagggacctgccgggctcagccttcccacagaggtcactgtgcgcatccacctgcaggatgcttcactgcacagctgatcagacccagagtggtgctcgtggaggggctctgggttgggaggcaggtaaggttctgaaagtcccggctgtgacttacatgatagaccctgtgtgtgtcgctacacatggatctgagttatggaaatccacagtcttcctgtgtgtagttccccaacctatgtggaagccattgtgcctgggggcttcatcacaactttgccaacagacatgtccctggataacctgtaagagggcaggcattctgaattctgggctgcacacctagatggctcagaatatccagtgaacacttagtgtgtaaatgaagctggagacaggagatttcggagatactagtggatcaatgcatccttggtatagttgtttcctctaaatg

SEQ ID NO: 305 - DNA, 536 bp, Homo sapiens
cgccacccacaggtcttttgaagggtgtgctttggcagctgaaggtcagattatgcctgcacaggacacaattgcacatcaaacccggaaggaagcaactttcaaatgagacagagcccaatacaggcctctctcttgagactgtaagctgacacagaggttgagtctcccagagatcctgctcctgtagagtgatgtacacttggaggtggtggaggaggaacctcaaatatgggtagtggagacacatggcagctcacagacctcaagagatgaagtgacgggggtcggtgagaagtctaactgctggctgtgtacaagaatgataggccacaggcttctgctggggaggccatggagtttccctgctctctttaattaagttaactttcggttctgcaaagtggtccctgcctttgacttaattccttttgtttgagctagtttgagcgggattctgttccttacaatcaaaactacacaaagataggctgggtgcggtggctcatgctcgtaattccagcaatttgggatgc

SEQ ID NO: 306 - DNA, 705 bp, Homo sapiens
  misc_feature (1)...(705): n = A,T,C or G
cgcggaattcctgagggaggaaagttggagggacaaataaccggacacccagcccttgcctttcctcctgaaccacatcctatcccgagtgtcccgcccacagcccaccgaaactgatcctcgagaccaagggtcttttctagcctgatacaaggcctgaggacagatttggaacagcatacccacagggtagtaacagtgatttgagccacaattaagacccaaaggtttagaaaccaggggttatcacaaccccttgaggctggaaatgcctcttcccacctctcagcccagaaaacaacccttgctctacagcccacagcctagaaagagattgatttcccgtctgtgtctaagctgtatctcattaacccacggggctctttccccagccccagaagcaggtacttacaaggcaccggagattagtggtctagtggaccagacagactggtccaggcctccccgccggccccccttccggtccccgtggacgccagcctctctgagcctcggatgtttgtgctcggcaccaggctggaaagctatntacttattcatgggctgcccaaggccgccaggaactgctttgtgtcagctgaataggatggtaattcaatctgcgaatgggagcccgttgcacacancacgcctgtcttaatgagtcacaggggggacaagcacccaacgttcaaaaccactggg

SEQ ID NO: 307 - DNA, 673 bp, Homo sapiens
attcacttggttccttttaatactgtcctattctctgacaaaatttatgatcttacattttatctctttgaatgtaattgttttaacgtctgtgtcttgtaactttattaactggtgcctctgtggatgggttagtgttgtctctttttgttgggttttcattcatgtgttattttttttctttgtttgcctggttatttttgattgagttttgagctttgtattggaattatttgcagtaataatttgagtcctgaatggtatatactttttaaagagatgattaatttatatttctggcatatggctacaagcaccaacaattctggatctaattataaggattgagatgatttacactgacgcttcatcccctgtaagggccagcttcccacctgactgttcctcctagggcattgtatcttcaagtcaacacattttactcaacttctctgcatatcaactgccttttatggagcttgcacatgctctcataaaaaaatggctgcaaaactggggcccatgtgtttgggttatttctttgtgagtctactttcctggcctagtaggcctccataggtcttatttctatttttaattatttaattctatttaatttcccaccttgttaggtttttaaatggttttacacaaatttataaaaaatattgtg

SEQ ID NO: 308 - DNA, 684 bp, Homo sapiens
  misc_feature (1)...(684): n = A,T,C or G
tactcactatanggagaggatccgcggaattcatcaaccttttctttggtttcctgtgcacattataaatccagaaggctctgatcccagggattgttctaacaaataattaggaaacgtgagcccatttcaaccacacttcaaagacagggaaggagggggaacgtaaattcctctttctaaatcgaaccatcacagaactcggcatttcaactgtcttcatctattatcagatccaaagcaacataacctcagtgattctggaagaactcagagaacagacaattcatgtaattaaaagactttgtgcgtgataattggctttgaagtttctgagagagatctcatctcaaaaatctttgcagaaaaatatgggtacagggttcttgcagcacgtattagagactgctgagacgcttcactctcctcccactgtatctatctgcaggaaaggggcacgggtggtggaaccacacacaagcagcccaggtcaatcatgagaaagaatctcccgcacaaatcacaccatttctctttaaggaagaatgactgtccagagctaccaaacttgtcttgccatgacagacagggatgttggcacaagataataagaaacattgaggaattcctgccttgacaaaatggttcaagtcaggactccgcttggaaaattcgggttcaaaa

SEQ ID NO: 309 - DNA, 903 bp, Homo sapiens
ctcggaatactcctaacgtgagaaaagtaaactcattacgagttaagtcacaataattagttccaatggcgccaactctgactgtgagaacagattttgtggaaatatatatgtgtatatatgtacttatatgtgtatgtgtgtgcgtgtgcgtgtgtacacatttttttgttttgagacctgttcacagactcctgggctcaagtgatcctcctgcctcagcctccctataaatacatttttaaatgatcatcttgcttttttcattgcgtattgctcaggtggttattaatatgctgctgaactgaaaacgttcttgctctgaaacctttcactggaaggctgggctcagctgggactgtctatcagagcatcttcatgtgaaagctccagttatgaggcagttgaatatcttacacagcagccaagggctccgaccatgaatgttccagcaaatgaggtgggagctacaccagctttgtggacccaatcacaagctggctcagattcaagggtaggagaggaagactccatctctcagtggaagaatatcaaaggatttccttctggtcctaagacctctccattccccaaagctagattcatggccacctcctctaataggtctttcttctgtaccccaaaccatattgatctctccctcctggtaaccttagtaactcattcatttggcattttttcaccttttgccaaatttactgtgtaactaccttgggtgtgggggtgactcttgggcattgagaccatcaactttttggcacaaaaacatctcttggcttctatggtcatctaacccaagagcatcttatccttggtctgagttgccaattctctttcttttgaatcaactctgtccttttctctattggcccttttttcttt

SEQ ID NO: 310 - DNA, 833 bp, Homo sapiens
tactactcactacagggagaggatccgcggaattcactgccgcactcacaaagaacaaagcaaagactccgtgaaatcccaatttctcctttcacgtgggatgtgcgtatctgagtgggatgtccaaaagctttagtgttaaacacactgacctcaggctgtcccttcccaaagcttcgtctgaccagtctacctggtggttcctgaaggaaccccagggatttggtgggtggttccccaaaagtgcatgcctgtaggaagtctgtccactcttttctgggtacattttccttcaaaattcaaaaatgtgacactcattgaagcattctatttagcaattttacacgcattccctaagtcctacacgagttttttggagtaatctcctgaactctgctgcttacacacagtgacgggtctggctctatcctcagagtcaaatataaagtattttgaacagcagtttcattcccatactatgatacgaatccttaaaaatttcatccattgctaagaaaaagcttatactccgtgtaattggtatcggcattcaaattcaagatttcaaaagctagggtaaatttctgtcccataatcattgcttcccaacaattttataattccattgtttccattcagaaattttgaatattccaaaaatagtcacgatggattttctaccccttcccataagaaaacttttatgttttagatcaccatttaaagagatgccttctaggcctgttctctctgaatttagatcccccttaagcaaccccttttttcctaattttaaatttgtcacccaaaaatttgtattttgtgttttcaaa

SEQ ID NO: 311 - DNA, 697 bp, Homo sapiens
  misc_feature (1)...(697): n = A,T,C or G
ttacatatttaggaatgctgttcaacagtgccttcactgacaacttctattgtctctgtttcctctctctaaaatggggataatgatgacacccactgaatagttattttgaactttgaacaaattaatgtttatcaaatgtgtagagcagcacgtaagtgaattcaaatatctgttaaataaacatttaggagtactgttcaacagtgccttcactgacaacttctgttgtttttagtctgtattcgtaagcctaagtaactgtcattgaatttgagggtgatgttagtagggtcactttatgagggccgtatattgtatccatttcataaccacaaacatgaggtttcacacctagttcagatgcactctctacctgtttgtgttggatctcaggagagtcattaggatgcttgaatgagggggcagaatgctaatcactccctgngcacttcctgtgtgctaggtactttagcaaacgttgaactgaattatgtcatttaggccccagaaaagccctctgaggtgcataagaattgaggaaactgaagctcatagaagttgagactggtctaagatctcacacttagtgatgatgggacaggacaatgaagtcgggattcctgtacctgctcccaaaagtccctattctttgctattacatatgcttcctctctctattttggctataggtaat

SEQ ID NO: 312 - DNA, 625 bp, Homo sapiens
cgcggaattcatagagacagaaaggagactggtggttgctgagggctaggaggagaggagatgaggagtgactccttactggagtggggtttccttttggggtggtgagaacacattggaacaagagagaggtggcagttgcacaagactgtgaatgtattaaatgccgctgaattgtttactttaaaatggttaattttatgtgatgtgaactttacctccataaaaacatatgaaaagaccgtagaaagtgcctgtgaattgggccccactgacccagtctgccccttcctgactccatctgtgtggcctggagcaagtcagtcttttcccacatctgtaaaacgatcgtgtctgcttatcacataatgtctacttcacggggctcttctaggggacaaatgaaatatttgacagaaggaaataaagctattcccccttataaaggattcaatcttttaaaaggtcattcaatggcatgaaaatgactctccaccctttgttttttcagcagagaggaaattaattgttaaggaatgccatggaacatttaagccaaaaagccaatgttcgaaaacaaataagctgtaaaaaaatgtttcattcaaaaatgctgggtttttcc

SEQ ID NO: 313 - DNA, 740 bp, Homo sapiens
ggccaataagcacaggaacaattgctcaacgtcactggtcattaggaaaacaaaatcacaatgattttccactggacacatcacacacactctgagcaaggctaacataaagaccgaggaccccaaacgtcgatgagggtatggaggagtcagaactctctctcggttgctgggagccctgaacgtttctgctccggagtgctcaccggaagagaagacagttggctctggaagccaaaaagtcatcagtatctgctctaggggcaccgcacacgtgtggggatcttgggaatatagtcccttctgccaggcagaaatgaggactcagtttggtaagatcatctgatttctgtggggttttttggagaagctgaaaattcagaattttgtttaaaatcttttgatgtttcaacactgaccattcaagtgccctgaaaagatgtactggggccgggcacggagggtcatgcctgtaatcccagcacttcatgaggccgaggtgggcggatcacctgagaccgggagtttgagaccagcctggccaacatggtgaaaccccgtctctactaaaactacaaaaattagccgggtgtggtggcggccacctgtagtcacggctattctcggagtctgaggcatgagaataacttgaacccaagaagcagaggttacagtgagccgagatcacgccactgtacttcaacctgggcaacaaagcaagactctttttcaaaaaaaac

SEQ ID NO: 314 - DNA, 892 bp, Homo sapiens
cgcggaattccgtctccgttggatcggactccctagatggagataaaacttctgaagcagggcgatcttggagtctaaggagaaatggtccctaggaacgtggagaaggccgctgtctttattcaatgtccaggccgacaggcgtcctagctcgagtcaccccggtattttattttggatatgctcgggcagacaagatcaggaagcaggccgggcctgccctccactctccccctccacccacccccacctacccaatctggttctcaaggccgactttccccacaccagcctcagcgccaggcctgcgcccagggaagcaggaggttctctgtgcccaaggttctttttaagaaaactcaggccagggtgctgtggctcatgtctgtaattgcagcacgttgggaggctgatgtgggcggaatgcttgagcccaggagtttgagaccagcctgggcaacatgacaagaccctctttctacaaaaaatacaaaaattagccaggcatggtgacgcgcgcctgtagtcccactttctaaaagctgaattgggaggatcacttgagccaaggaagttgatgtttcattgaactgagaacgagcctcttgtacttcacccctggtgacatatattataccttgttttaaataatagacctttaagaattcctaaagattttttatttcataccttaaatgtattttcataattttttttccacaaaatcttttttataaaatacatttttctcaaaatttttattacctaattcacgtttcaatttttcctctccaaaccatatttttctatatttttaaaattttgctgttttattataaccttcgtcaccttactttttaattattctttttctcttcttatctttttatta

SEQ ID NO: 315 - DNA, 620 bp, Homo sapiens
accgcggaattctcgattaaggtggcagcagggccgtgctccctttgaaggctttacaggagaatcctttgcctcttcctagcttgtggtggttgctagtagtctttggcgttccttggcttgtagacatatcacttcactctctgcagtcatccccacgtggcctttttccctgtctgtgtgtgtgtctgactctccatgtcctctcttttataaggatagcaggcattggatttagggctcacactaacacattatgatgtcatcttaattacatctgcaaagaccctgtttccaaataaggtcacatcctgaggttctggatggatatgaattctggggagacactattcaacccagtatactttttgcctttcttccttagagctccagctaatccagatgcaacattgacgaattagtgccggaatgagtatcagcacttggtactgcaattagaacacggggatttggctgttgatttattttttgggctacactgggagggaggctcagagacggtgtgggtgtctgaaggaaaaaatacgtgttaagtgaagtgaggacttcaaacgaaatcatacagttttgggaaactgcatttggatagggaatgcttg

SEQ ID NO: 316 - DNA, 703 bp, Homo sapiens
  misc_feature (1)...(703): n = A,T,C or G
ctactcactatanggagaggatccgcggaattccaaggaagggctcaccacgggtcctttgtacaaaaaggaaggacttgtcccgaggtgctttctgttgcttctacaattaaggctcactttacaagttttttaaaaaatgggctccttagtaaaaccaacacatcctaccatcaccgtggttttgcttgtgatcttaaaggaatcgcaaaggtctcaaacctagacagccagaggaaacctcttcccaagacaactttttcaacactgtggcagacgggtccagcgagttttcccagtcaggactcattttggcctcccggataggcttctgaattatatgcctctgaatttggctgcaagactggaggcttctttcaagccccgtgtagagtggccccagcctctgtgcatggaacaaagagatacgtgctgtatccaggagtaggtggcaaaccacagatgattccttttcaccctgcagcagagttatcaagtcacagaaactacaagactgcagaaaatcgtggaagggactggttaccagatactcgtacacacatgttcacagctgcgctgctctcaacagccaaagggtagaaatgacacaagtgcccatcaatggatgaatggggaaacaaaatgtggcatatccatacaatgcaatattattcagccaagaaaaaggaatggagtatgtgaa

SEQ ID NO: 317 - DNA, 709 bp, Homo sapiens
agctcacatttctgagcgtaagtgataaaacttgattctgggaggagaaaggtcaggataatgcctcctctgtctgagcacatggacctccactctgaagagagaagaacaggagagatggccagagtgaatgctcaggggacagagttttgttccctccattcagccctgctgtggtctcaccaatgcctgggctcaccaggcagttcacacaacttctggatctgttaactttcctcctacggtggcgtccctagatcggaatgaaaatctaatgctgtggccgctgctgcagcaaacaaacccaaacaccgaatggctcacacgtgatggatgtttctgtctcattctcacaagtccaaagggtgcttccatgtagccagcaactgtgtccttcacgtggtgactcagggaccatggtcccttccatccgtggctctgtttgtaatgtgtggccattgaagctgccttgttagtcacctcaagccagtagcagagaaagggaatggctggccgtgtggcggaaatatttgcgggtcacgactgcaagtgtcacgtacggcttctattcacatcccatcggccacatctaactgtgaggtgaggccaggacattcaaccacatgcccagagagtgaggtcgtttgcccaggaagaggaaatgtgtggcaagtgctgacacttggccacgcaaagactaaacttggaa

SEQ ID NO: 318 - DNA, 696 bp, Homo sapiens
cgcggaattccacggtgttggtgtcctctgaaacgcacgtcagatgctccccacagctggagaatgactaaaggactccaaaaggttggccttctggggggtttgaattttaacaggtggcaaagctgtcagatggaatcttcgtcctcagaaaacaggccaatggaactactttgaaggcaccagaagtcagtctgccagcccataatttcagggtctgcacatcggttgcctggaaaggaagccacgtaaggatttcccacagggaaagctggactacaggcaggcctcaaaaacccattcgatctgaagaaatatggaaacactggaacagtatttctggcagaggcaaaagtgccaatcaaaacgtgcagcggaactcacagagcccattttggacagtgccactcacccttcaacacacaggtgcatcacctgggatcttcttaaaatgcagcctgtgactctgcccgtctgtgggctgggggaaaagggcaagaacttgcatttcttgccaacttccaggagatgtgatactggtcactggaccacccctgggatttagggagtcatgaagcctgctggtcttttctaagtggggagcaagagtgcttgttttaagttgccaagaccacaggtttcctttgttgaagaaatattttttgatctactgctgtatgcttggcaccatgctaa

SEQ ID NO: 319 - DNA, 635 bp, Homo sapiens
aatttctgatgggtgaaattaacctgcattgtgtgttgcccttaggccgggggatcccaggtgttacccttcagcagtgcctagggagcggggagggcaggggtgaacggtaatctgtgccccatctaaacaggcactctatctatctgcacatgtgggatgcttccagttttgtgggatctactcatctatcttgaactcccagcttcaagcatatcttcccatctcagcctaccaatgttctcgcattacaggcgtgagcctatacccatctttctaagtgaatccagtacttctagaagttttaaatgtgatgcatctctttaccacccggagagctattcgcagagaaggtctgagctgatggagggatggacgaggtcttgagcacagaaagcttcccgcagcaatatcgtcgaaggacacaggggggcagcatcgcatcgcatcgcatcagagctcctgcccgcaccgctgccgctgcagcctccttcgcagcgccccgctcgcaccccggcactctccttgccctctttccggaggcttccctgctttggcttgaccttgacctgtccttgtccttcaaggcaccatcctcttccttctttctttaatttcctctcccctaatcctgc

SEQ ID NO: 320 - DNA, 729 bp, Homo sapiens
  misc_feature (1)...(729): n = A,T,C or G
cgcggaattccccaaagcagggcttgccatacctggaccccgaggagcctgcttgctggaaaggctttcctgtctgatgtgcaagaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcangaagaaaccttccgtagaaagacaggcagggaaaagcttangctgaccttaaacttacctaatagagcaagcctgagatagactgccaaaatggccaaataagagactctatgaaataacagtcttgtaactgtagtaatcataaggaaattttctncttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattgg

SEQ ID NO: 321 - DNA, 758 bp, Homo sapiens
  misc_feature (1)...(758): n = A,T,C or G
tcttcccagaagccagatgtagtggctcatgcctgtaatcccagcactttgggaggccaaggcgggtggattgcttgagctcaggagttcgagaccagcctgggcaaaatggtgaaacaacatctctactaaaagtacaaaaaaaaatagccaggtgtggtagctcatacctgtagtcccagctacttaggaggctaaggtgggaggatggcttgagcctgggaggcggaagttgcagtgagccaagatcgtgccattgcactccagcctgggcaacaaagccagaccctgtctcaaacaacaacaaattctctcctagagcctccagaaggagcagccctgctaacgccttgatttcaaccccataatacccattttggacttctgccctccggaacttgggataaggtgacacatttgtgttgtttgaggccactaagtttgtggcagtttattacagtcgcaagaggaaactcatgcacacagcattatagactcaagtccagtggctggggctccaccacacaaaggaaatgcatggcctattggcccatgaagtcacaaaggtcactaccagtgtcagctacaccagatgacatgacaagttcccctttggggttgaaatacaacccaatcacattcacctgcagtttgctgctagcatagccttagggtcagaaatcggtcattttcccttatgcaacnaattcaatccattttaaaatattattattttttagagacagggtctggctatt

SEQ ID NO: 322 - DNA, 610 bp, Homo sapiens
  misc_feature (1)...(610): n = A,T,C or G
cgcggaattcctggctcctgcggcctcactgatcttctatcatgtacccgtgtagtgagagagggacacattcactcctgctttctaggtggaaaaactgggagcccacagattctgctaacttggcatgttataggctgggaggcagtgagtgtgccttgggattcaggcttgaagagtttattgaacccaagactaggctcatctgtttccaaaatggaaatgatgatgatgatattttgtagaccagggtcctaaaaggaggtcagcaggcagaggaaaaggcctctctttgttttttcatttcccactggcaatagctctttgcatgagtggctggggtggcgtggggggtggtaatactnantgaaaaacactattcaagaagaaaccttccgtataaagacatgcatggaaaagcttaggctgaccttaaacttacctattatagcaagccctgagatatactgtcaaaatggccaaattaaatactttattaaaaaacagtcttgtaactgtaataatcttaaggaaattttcttcttgaaacacgaatccaaatatgataaatgatttacaagtgccccattgttagggaattttttttgat

SEQ ID NO: 323 - DNA, 811 bp, Homo sapiens
accgcggaattcaacgcaggcactagtggaactggccttgtgggatcagaaaataattgcaaggaaatctgatctcatgaggggggaaagctgaccctaatgaaaagttctatagaaaaagaaaaaagaaaaggacccagaaaatgcacagaagtcagccctactcatgaattagcaatcctccacgatgacccaatagtttttggaaacaactacagtccttccaggagtgtctcctatgttccaggcactgttctaaatgtcttatgtgtcttacctaatttagccccagagcacagacttcccactactgcaatcaacagggacatgacacagtgggacaaggaccaggctagggtagaattcccaaaataaaaagttttgaatcattgcagaaagcagtcaacacatgggaccaaagatacagacagtcaataaaacagaagatcctgaaagcacaaagaaagattgaggaagaagttaacagaaatgagaagaatgagaaagaaggtgaaagttcctcaacctcccaagtagaaaagacagattcctttcaaatatgcctaaaactggctacttctggggactcttaggctgctgtggccaagactggaagttaattttcaaaaacattaaagaactggtggtagctaagaaagtggcccacactgatattgttattaaatgtaattgcatcagaaggatattcttacatactttacctcctaagtaccattttagcagacatcaatggaaaacactttgttgagaactgcaagtttgctttaaacagagtgttaaaaatgtttat

SEQ ID NO: 324 - DNA, 592 bp, Homo sapiens
  misc_feature (1)...(592): n = A,T,C or G
actatacggagagcaactcgaccttatggagaggatccgcggaattccgtaaatgtgagtggagattttgctacagggagaaaatatttgaaaaccatatatccgacatggaatttatatccagaatatataaagtactttttttttttttttgacagagtcttgttctgtcaccaggctggagtgcantggtgcgatctggtttcactgcaacctccacctcccaggttgaagaaattcttgtgcctcagactcccgagtagctgggactacaggcatgtgccatcacacccagctaatttttgtattttaagagagacgggggtcaccatgttggccaggatggtcttgatctcctgacctggtgatctgcccacctgggcctcccaaagtgctgagattacagacgtgagccaccgtgcccggtctatataaagtactcttacaactcaacaatctaaatacacacaacccgaccaaaaaacatgcagaaataattaacagacatttttcttacaaaagacttaaaacttgtatcaacaccttatccttaggaaatgcatattaaaccacaatgagatttcttttaagc

SEQ ID NO: 325 - DNA, 624 bp, Homo sapiens
ccgatgagcatccgccgaattcagtattgctcgtattttgttgaggatttttggattagtatgcaccagaggtattggcctgtagttttctttttctgatgtctttgcctggttttggtatcagggaaatactagccttgtaaaatgaatttggaagtattccctcctcctctgttttttggaatagtttgaataagattggtattaattcttctttaaatagttggtataatttagcaataaagccctcaggtcccaggcttttctttattgggagactttttgttatggcttggatctcattacttgttattggtctcttcaggttttggatttcttcatgattcaatcatggtgggttaaatgtgtctaggaatttgtccatttcttctagagtttccaatttatttatgtatagttgcttatggtagccactaataatcctttgaatatctgcagtatcagttgtaatgtctgctttttcatccctgcttttgtttatttggatcttatctctttttttcttagatattctacctaaaagtttgtcaattttgtttaacttttcaaaaaaccaattttagaaaaattttattttaggttcaggggtatatgtgcagggtt

SEQ ID NO: 326 - DNA, 567 bp, Homo sapiens
attcaaaccaaatatctctcaactgatgtattgataaacaaaatgtgtttatccatgctataaaaagaaaggaagtactgatacatgaactaacatagataaatcttaaacacactatacaaagtgaaagaagtcagacacaaaaggtcatacatcatatgattccatttatatgaaatatctgtaatgacaaaatccatgaagacagagtggtggttgccgggggccagtgttagagggaatgaggagtgactgctaatggagtgatgaaaatgatccagaatcagatagtgttgatggctgctcaatgatgagaatgcacgaatagcatctgaattgtatacttgtaaaggatacgaacatatgttatgagaattatagctaaataaagccacattacagaaacactaaacagcaggtctaatagatattgttatatataccgtcatttttcttaaaagtcgtgacaactcctcttgtgattctaagttactgcacatcttggccacactagatcagaggaacccttagacaggcagcactctaagttatgaagtacttatgatg

SEQ ID NO: 327 - DNA, 716 bp, Homo sapiens
cgcggaattccttagtttcaaaagtttgaatttcataccacattataattttgtctgtatataatgaagtaattaaatgaataattaaaaattcagtgaatctgcttgtgttaaatattatagattaacataagcagttacttttacttgttttcaagacagcactaaaggaagcataaatcaatttttaaaggcataaagcctttaaaactaaggagataggaaatagagagagagagacactgaggcagaggcagagactgggacagagagatatcttcttgtttaaaccacagtgacaaagaatttaggagcagaaaccatggacataaacttttggatgcttaattccagcagtagatcaagaacgatgaatcattcacagtctgggaaatcaggagtcaattcaattcgtgctacagaaacccccaaatactcaggaaaatttagcaccaggtgcctctaaacatgagagtagaaacagagttaagacatttttagcccttctaaaaaacactgatattcatccttttaagtaaacaacctctggactgagcatgggtatctggatatctacgtgtaaaccaggcccagtttacatgtaaatatccagaacacagagacataaaacccgtctccagttggggtctacattcttacaactagggctccaccctccagaaaggagttgaaaactgtctagaaaaattgaccag

SEQ ID NO: 328 - DNA, 592 bp, Homo sapiens
ttcttcggaaaaaaaattttttatagactaagaaaatggaagtactccaacttgtttttaaccaatatagggtccaattcatcacgttatctgttacataatattttatactgaggacctgtaccaagttcattgggccatttcctaactaatggatatttagatagtttttatctttacctattagaaacaatgctttgatgaatatccttcatgaactgatgaccttgattgggcatctctctcagtaaagatacccataggtggagttactgagcagtcagttattttttttttaaatcaatcagagattccttatttcctacattcttctctgtaaagtgaaagtaataatagaagcaacctcattaattaatatgaagcccttgtcacaatcccgagcacatagcagatgctctcttgtatgagagctattattattcttttctctcaaatgtggtaccagattgtgatgttctcttttgcctatgtatattctgtgggtagttcacctcatccaatggggtttcagattcccaacatagaatgagttgctgctatctttactttgtaaaacaaggtactttaaagg

SEQ ID NO: 329 - DNA, 727 bp, Homo sapiens
  misc_feature (1)...(727): n = A,T,C or G
cgcggaattctgcaggacaggcctcagaatccacccctgtgcctcgtcgagcccctctagggaactctgcaggacgggcctcagaatccaccccgtgcctgcaggggaaagtggtctgcacatgccctgttgaggacgttctcaggatacacccgcatgggagtgaagacagtagaaggggaagaagaggggctaagcaaggtcaggtccaggtgcagcacagccagctccttgaggagctcttaagaatgagctgtgctgtgcatgggtccctccttgaggcaaacagcctgngcttctcaccccaccaggtagtcactgggcagagaagcggggtgagcaggacataactcccgggtaactctgagggacacagctccactcacctaagggcagtcttctacggaagatgtggcaggagctgtcggcaacacacgcagcccctggggaggagtccaccaacctagccacagggaccccaggaagcctgtgtactcagagagcacctttcataacagcgtctgctattattactcaaaaacaacacccaatgtctgctccataccangacctcctcccccatagtaaggggaggtaattttttttttttctttttntttttcttttttttcttctttcttttctttttttccttatgttttctttcttcctataatatttttttattttttattaacttcttatcttcttttttttatttactttt

SEQ ID NO: 330 - DNA, 572 bp, Homo sapiens
agctttaagtgtcgtgaaacacagtctgagctttgtctctgaatgtgaaagaagtgtagagtttaactttccttataggccaagatgaagttcggaatccctgatagctgagtaggaacctttgtaaggttgtcactgactgttgcaactctttcatgcagtcacaaagcctcagccctgagtttagtgattctgttgacagtgagttgtgttgttttcttttctttttttcttcagcttttaagttcagcagtacatgtgcaggatgtgcagatttgttacataggtaaacgtgtgccatggtggtttgctgtacagatcatcccatcacttaggtattaagaccagaatccattagctattcttcctgatgttctccctcttcccccaccccacccccaacaagttgtcaagttgtgtcattttctgtaaagtgatacttattatttttttctttttctttctttctttctttctttctttctttctttctttctttctttctttctttctttctttctttctttctttctttctttttttgggggggtgggcagaattttactctgtgt

SEQ ID NO: 331 - DNA, 980 bp, Homo sapiens
  misc_feature (1)...(980): n = A,T,C or G
ctactatacggagagcgatccgcggaattctgcaggacaggcctcagaatccacccctgtgcctcgtcgagcccctctagggaactctgcaggacgggcctcagaatccaccccgtgcctgcaggggaaagtggtctgcacatgccctgttgaggacgttctcaggatacacccgcatgggagtgaagacagtagaaggggaagaagaggggctaagcaaggtcaggtccaggtgcagcacagccagctccttgaggagctcttaagaatgagctgtgctgtgcatgggtccctccttgaggcaaacagcctgggcttctcaccccaccaggtagtcactgggcagagaagcggggtgagcaggacataactcccgggtaactctgagggacacagctccactcacctaagggcagtcttctacggaagatgtggcangagctgtcggcaacacacgcagcccctggggaggagtccaccaacctagccacagggaccccaggaagcctgggtactcagagagcacctttcataacagcgtctgctattattactcaaaagcaacacccaatgtctgctccataccaggacctccttcccccatagtaaggggaggaannnnnnnnnnnntnnctttnncgntcacccnttttctatttttttttatccatcccctttctaattctaattaaaacatatttctgtatttgattttttattaactttctaataaaatcttccatcttaatgttcctttttttaattgaaattcttctaatcattaaaaacttttatttccaaattctctttctttccttttaccttcttttaataacttatggttgatttaattccctttattgtgtataatatctatttttataaattgtgaatcttttaatatttaatattcttttctttcctttaattgataatcattttctctttcttttatttaaataatatacttgtataaatat

SEQ ID NO: 332 - DNA, 656 bp, Homo sapiens
tccatagaattcatctttaagtgtactgaaacacagtctgagctttgtctctgaatgtgaaagaagtgtagagtttaactttccttataggccaagatgaagttcggaatccctgatagctcagtaggaacctttgtaaggttgtcactgactgttgcaactctttcatgcagtcacaaagcctcagccctgagtttagtgattctgttgacagtgagttgtgttgttttcttttctttttttcttcagcttttaagttcagcagtacatgtgcaggatgtgcagatttgttacataggtaaacgtgtgccatggtggtttgctgtacagatcatcccatcacttaggtattaagaccagaatccattagctattcttcctgatgttctccctcttcccccaccccacccccaacaagttgtcaagttgtgtcattttctgtaaagtgatacttattatttttttctttttctttctttctttctttctttctttctttctttctttctttctttctttctttctttctttctttctttctttctttcttttttttgggggggtgggcagagttttactttgttgtctattcttgatttcattggtcttatcttcggttactgtatgcttttgtttatatgtttaattattctttg

SEQ ID NO: 333 - DNA, 447 bp, Homo sapiens
cgcggaattccctttcctagtctaagaaagggatgacagatggcacctggaaaatcaggtcactcccaccctactactgcactttcccaatgggcttaacaaatggcacaccaggagattatatcctgcacctgcctcggagggtcctatgcccacggagtcttgctcattgctagcacagaagtctgagatcaaactgcaaggaggcaacaaggctgggggaggggcgcctgccattgctgagactagattaggtaaacaaagcagccaagaagctcgaactgggtggagcccaccacagctcaaggaggcctgcctgcctgcctctgtaggctccacctctgggagcagggcacagacaaacaaaaggacaacagtaacctctgcagacttaaatgtccctgtctgatagctttgaagagagtagtgcttctcccagcatgcagt

SEQ ID NO: 334 - DNA, 731 bp, Homo sapiens
ttagggcgagtccttaaagtgaaagcaagtttattaagaaagtaaaaaaataaaagactggctactccatagacagagcagccccaagggctgctggttgcctttttttttattttttttttttttgagacaaagcttcattctttcgcccaggctggagtgcaatggcggggtctcagctcactgcaacctctgccccccggttccagcgattctcctgccttaccttccggagtagctgggattacaggcgcctgccaccacacccagctgatttttgtatttttagtagagacagggtttcaccatgttggccaggctggtctcgaactcctgacctcacgtgatcctttggtcttggcctcccaaagtgctaggattacaggcatgagcaacttcgcctggccttggttgtccatttttatggttatttcttgatgatatgctaaacaaggagtggattattcacacctcccctttccagaacatatagggtaacttcctggcatttccatgcatttgcaaactgtcatggtgccgatgggagtgttgcagtgaggacagccagaggtcgctctcgttgcctatttggttttggacggtcttggctggcttttttactggcattctgttttatcagcaaggtctttatcaccttgtattttggggccgacctcctatctcattctgtgacttaaaatgccttaaccttttgtgattgcagcccatta

SEQ ID NO: 335 - DNA, 632 bp, Homo sapiens
cgcggaattcttcacttaggtgatctcatgggggaggtcagagggaggcactggaccagtttgaggggacagcgcatgactccatcctgcctcgggtctgaactttcctgcagtgaccacccttcctcccgggtcataaggaattctaaaaacaacaagcagaccgacaaaaatgacgatggtgatggcgcgggacttacctgcagcctctgtctgccgtctcctgcttctccctaggtctcagtgcagatgcctcctgcccagggcgactttctgcatccctggagtggctcgggacccctgttctgtgttcccacagctctcagcacttttccttcatgcacgttgctgcagtttgcaatgacagcttctgcgactagagtgctgatgccagtccctccccaagggcaagcctgagcccactgctttcaccgttgtgtgtcccagtgcaagagcctgcacgtaggggccacgcgacaaagaattgctgaatgaatgagttaccacaggacccgatataaaaataaagggaactataagaccagatgataagcaaaataaaaaaaataaaactggagaactaagagagctaaaatcatgtaagtagaaaaatttaatagcttaagagctag

SEQ ID NO: 336 - DNA, 765 bp, Homo sapiens
attatcttgctcagtctgcatagtgtttaactttttaaatttgttgccaatttatacacacatgcacacacacacacacacacacacactcactcaacagtcctagcttctaaaacatagcaggtgtttgggcaattctgggccccacttcctgtaaggcaataatagagaaagtggagctgctattgcccctctagacaagaggtgcaaggtggcttgaaaaatatgtccacaaattacctgatgctctatctttaaggaggcggagattaacttgattatgggctaaacttagtggctcacttctaacagaatagagaagctgtgatacgtcgcttctgaggttaggttataaaagacacagtggtccctctctcatgagttgttctagaagcagcaagctaccattttatgaacagcctatggagaggtccatgagctgagggtcaaagcctccagccaatgaccagcaaggagctgaacctgccagcaaccgcaccagacaagttggaagtgatccatcaccagcttcagctgagcctccggactctgcagccccagccgacagcttgactgcacatctcgtgagaagctgaaaccagaccaggcagccaggctgcttctaggatcctgaccctcagaaatggtgagataaccagagtttgttcttttaaaattgctaagtttggggataatttgttacacagcacttgataactgatacaacacaataactaagcaataccatgctgctcaatgtctcct

SEQ ID NO: 337 - DNA, 756 bp, Homo sapiens
  misc_feature (1)...(756): n = A,T,C or G
cccactatagggagagcgatccgcggaattcttcacttaggtgatctcatgggggaggtcagagggaggcactggaccagtttgaggggacagcgcatgactccatcctgcctcgggtctgaactttcctgcagtgaccacccttcctcccgggtcataaggaattctaaaaacaacaagcagaccgacaaaaatgacgatggtgatggcgcgggacttacctgcagcctctgtctgccgtctcctgcttctccctaggtctcagtgcagatgcctcctgcccagggcgactttctgcatccctggagtggctcgggacccctgttctgtgttcccacagctctcagcacttttccttcatgcacgttgctgcagtttgcaatgacagcttctgcgactagagtgctgatgccagtccctccccaagggcaggcctgagcccactgctttcaccgatgtgtgtcccagtgcaggagcctgcacgtangggccacgcgacaaagaattgctgaatgaatgagttaccacaggacccgatataaaaataaagggaactataagaccagatgataagccaaataaaaaagataaaactggagaactaagagagctaaaatcatgtaagtagaaaaatttaatagctcaagagctagatctcaaggcatcttctttttaagataatgaaagctaaaggtgggattcagtagcgggaagaacaaaaggaggaaataaaattgttaaaacaggggcagtaga

SEQ ID NO: 338 - DNA, 825 bp, Homo sapiens
attactcacgtgctgctctacacatttgataaacattaatttgttcaaagttcaaaataactatgcagtgggtgtcatcattatccccattttagagagaggaaacagagacaatagaagttgtcagtgaaggcactgttgaacagcattcctaaatatctaacaaatatttgaattcacttatgtgccgttctacacattttataaacattaatttgttcaaagttctaaagaactatgaagcaggtgccatcattatttccattttatggagagaaaagagagacaagagaagttgtcaggaaaggcaacgttgaacagcattcctaaatatttagcaaagatttgaattcacttatgtgctgttctaaacattttataaacactaatttattcaaagctcagaataactctgtgaagtaggtgccatcattatccccatcttagagagaaaaaacagagccaagacaagttaaaagactcactgaggtcacacagaaaagacttgaaccctgcgatctgactccagtgtttgggtgcttaactactatcctgtatcagctccctgtggtgaacttctgcctctgttgagatgaatcgggaaaacagcttatgttgaacaatcagattcaggagaaagccctcgcaggaaaaaatggttaattaaaaaataataataataaaaagcctttttcaaaagcccatgttggctcctggctatggcagcagttaatcaaaatgagaagcagcgtgggtctcacatgatgcaccccttaccgttctggacacagacgggcttagtatttatactttagcctctgaact

SEQ ID NO: 339 - DNA, 708 bp, Homo sapiens
cgcggaattcctccttaggggtgatatttctactctctagcctctgacctagaagctttagggtcttaattgctggcacataaatttgcaatgaaggaatcaaattgtgcagcagcctgttgtatgatctcaagggcgctgacatcaactgggcttagaacggccaagtcccctttgcctgtgtcaagaggttttcctctagaaacttgtattagtcttttctcatgctgctaataaacacatactcgagactgggtaatttacaaaggaaagcggtttaatggactcatagttccacctggctggggaggcctcacaatcattgcagaaggccaggagaagcaaaggcatgtcttacatggcggcaggcaagagagaaagatcagctctcgtgagactcgttcactcccacaagaacagtatggggaaaaccgcccacatgattccgtcatctccaactgggtccctcccacaacatgtgggaattgtgggagctacagttcaagatgagatttgggtggggaacagccaaactatatcaaaattattataaagaaggacctcaaccaagagctgacacacatgggttttgtttgtcttgtacagttttaaattaatctgagttatttttggtgggcatgggctcctccagttcccacgagccccactccctgctttctgcctcccggcttcccgcatttatgggtt

SEQ ID NO: 340 - DNA, 853 bp, Homo sapiens
gggaattcttcccctccaacccttttaagcaatattcatgtgacatttccatcaaagtaaagccaagtccccatcagtgaacacatctctttctactttcaccaacgttacagtgtatgcattcacctataataactacgtgacccattcctgcctgcaactgtcgggccctgttctaggcactggggatccaaatgtgcatgaaacacacaaagctttgttctcctcgtcgtgcagcgtgctacctagcacatagatgcaacatgctaagtagtgataagcactgtaaacacaaagcaccatgaaggggatggaggatgaaggagacagagtggtcagcaaaggctgctcagatgtggctgccctggagccgctcacatgggctcacaggaagatctcctcctaagtcgtgtctgttgaagtcatctggtaacttgaaaataatcgtggtggaaatatttacactgtgggaatgggcaaactgcacagcaaaatgttctgggcttttctttacttccccggaaagctggttaacaggacacctccggatatttgaattcataacataggataatgagggagtgaactggttggctttttgcagtgaggatgaacatggtttataaaatactgttctttgtggtaaacttccatagttgaactgtgttcttttcttggatgcttttcttaggtgatcttttagcaaatggtttttgattttttagtgtattttatattttttcgttttattatattatttttctttttcttatttttattttaaattattaatttttgtgtcatttatttcttatttaatatttattttctatttaatatataataattctgt

SEQ ID NO: 341 - DNA, 442 bp, Homo sapiens
  misc_feature (1)...(442): n = A,T,C or G
cgcggaattctctctgtggaaataattagcatgggctctgtctcctgactctgcctcacctgatacacctgtgcctttcagtgcaccttggcctgtcttacctatgccttggagccatcccacgaacatcacctgccatgcaccaattaaaaaaaaaggcccgtggtcccaggaccattatatatgatgtttcctccaaaagatagcctgctgattggaaatctaacatcaggtgtccctccattccagattagttaaggttctctccattgtcagcaacagaaacggcctttggctgtcttaaggtaggatgtaaatttatagaagaaggcagggtttctcataacttctaaagcaaagctcaaccaaccaaccctgcaagaggggagacccaggatatctcaggggactcagcacgggggtgtgggggtttgnnnnnnnn

SEQ ID NO: 342 - DNA, 703 bp, Homo sapiens
tacccggtgaagaaagaacctggggatagagcctccttttttcattttttctttctttttttttttttttttgcgatggtcttgctctgtcacccaggcttggagtgcagaggtgtgatcttggctcactgcagcctcaatctcccaggttcaagtgatccttcctcctcagtctccagagtagctgggactacaggtatgcaccaccatgcctggctaatttttgtgtttttagtagagatgggctttcatcatgttggccagactggtctcaaactcctgacctcaggtgatccacctgcctcagcctcccgaagtgctgggattataggcatgagccactgtgcccggcctcatttttcttttcctttttacagaaatggaaatcacatggtaggtcataaggagctgacagggctggagttccagtgagtatctgccccggcagtgcggcagcagacgggaagggtgggaggtcatctgagctggtagggtgagaacaaatataaatctcatgggggatccacaagggagcccatgtctttggtgccacacaaaatgcataagagctgttgacaccatggaataccctggagtgtttaaaagccccacatgcataacacactcatagaaagcaggatactaagcactgcgggttcttgggaaagagctttttttatttcaaaatcacaagtaaccccat

SEQ ID NO: 343 - DNA, 815 bp, Homo sapiens
ccactcactatagggagagcatccgcggaattcccagggtgaagaaagaacctggggatagagcctccttttttcattttttctttctttttttttttttttttgcgatggtcttgctctgtcacccaggcttggagtgcagtggtgtgatcttggctcactgcagcctcaatctcccaggttcaagtgatccttcctcctcagtctccagagtagctgggactacaggtatgcaccaccatgcctggctaatttttgtgtttttagtagagatgggctttcatcatgttggccagactggtctcaaactcctgacctcaggtgatccacctgcctcagcctcccgaagtgctgggattataggcatgagccactgtgcccggcctcatttttcttttcctttttacagaaatggaaatcacatggtaggtcataaggagctgacagggctggagttccagtgagtatctgccccggcagtgcggcagcagacgggaagggtgggaggtcatctgagctggtaaggtgagaacaaatataaatctcaggggggatccacaagggagcccatgtttttgtgccacacaaatgcattaagagctgtggacactcaggaaatccaaggattgtttaaaaaccccacatgcagtacacacccatagaaaggcagaaactttgcactttgggttcttgggaaagagcttattttatattcaaaagcataggaaaccctcgacatttcatggcttaaagctttaagctttaatccccaccacccttacaatttttttttcttcaggggtattttttgcctt

SEQ ID NO: 344 - DNA, 835 bp, Homo sapiens
  misc_feature (1)...(835): n = A,T,C or G
ctgacaattaatctcctccagactttggtacattaaacactcgggacgtcagccttctgtcctaagccctttctgtcctaagagaagtcggagactgtgtcgataagacttgctaaccagtaattgaaaaatcaatattcagatctccagtgactctaccctcatatcccagctatagtcagtaacaacaatgaaatgtaataatccttttcaggaagaccctggcagggctgtcaacccaattaattccagcaaagtaacgtgggctctttcatcaaaagattcttacatacaaacacacacaccttcacaagtgcacatgtgcgcacacatacaacacacgctttgttctgttttgttttgctttctgctaaaatgaatagaaagactctttaaaaaagaaaaaagaaaaagaaaatagctcttggtgaaaagcactcattgatgtactcaatgaatcactttcttctctgcaaacaaagctccttatttctcccaggaggctgctttgaaatctttgctggaggatagggtcagccccaggacgagatgaaggctatggcttccagtcctgccacacaggcagctaactcctgaaactccaccaaatgactgacggatggagtgccagccatgcccagtttgttctcaccacagaaaaatactaaataggtgaggtgatggatgtgttatcttgatttaatccttccncaatgtataaatagatccgaacatcacattgtacccttatagacattattatctttaaaataaaaattagtattttaatttttaaaaattgacccatttgaatagctccttctggaaccaccct

SEQ ID NO: 345 - DNA, 702 bp, Homo sapiens
cgcggaattcaccctgcaaggggtctatcaggaataattaacacaccccctcccggaagaggagaagaacatatttctcatttatagagatgaggttttcagttgcagcactggtcagtgaagcaatacaatttccacttgtcaatctcgtaattttaaaaccaaaattggcaccatatttcatattcaaaatatatcaagaaacagtactaataaaaagacaagcaaaagataaactcaagtggcaaatgagcacatgaaaacatggccatcactagccatccaggatatgcaaatgtaaacaatgggttcccatcagatgtgcacattttaccaatctgactataccaagtgttgacaaggcagggaagcatgcccacctgtacagaactggcaggatcatcagtcagttggcccagctgctagaagcactgggaagtctctgttgaaatagaagtgagcacatcctataaccctactaacttcaacggactcaacacatgtgctcggaaggcaggtgtaagcacctgcatcatggaagagtggaaacaacccaatagagaaatggataaggaaaatttgtcagccccagtgcatctcaaaacacaatgcagatcaaaaatagaagatgcagaatcatgtgcccagtatgatatttatgaagaaaatttacataaaaccatgtttttatggaaactgaca

SEQ ID NO: 346 - DNA, 678 bp, Homo sapiens
cgcggaattcgactgaggggcatgaggcagaaagagagatcggagccagtttcagaacaggagtgaaagtttattaaaaggctttagaacatgaatgaaaggaaggaaaggatacttggagaaggaccaagcaggcatcttgaaaggcaagtgcttttttttttttttttcattttttaaccccttcctaatgtcactggaataagaggcctgtcccagaccccaagagcgggttcttggatgttggatgaggaacaattccaggtgagtggcagagtatagtaaagttaaaatcgtttatcagagaccactcggttacagagtaggatgtcctccaaaagcaagagaaggaacgcgcacaccttaaatacgattcttatttatataggttaacagagctaagaagagaggtcttttgtgctttattacagaggctggtgatcagcttctgacaggctattagtattattttcctatgttactactgatttcagcaaggatttacgaatgtactattaaccttaaatcaaaacctactcttaaactaagaatgctttttgttcttaaaatattaagagattgccataaaattctgcgtctttatttatttagcatcattaacttgttcccttaaccataaacatcttgtgcccaaaatgccttacccctgggggtgta

SEQ ID NO: 347 - DNA, 826 bp, Homo sapiens
caccgtggaattcctcatgaaattaatctcctccagactttggtacattaaacactcgggacgtcagccttctgtcctaagccctttctgtcctaagagaagtcggagactgtgtcgataagacttgctaaccagtaattgaaaaatcaattttcagatcttcagtgacttttcccttattttccaacttttggccattaccaccattgaatggtattattcttttcaaggagacccttgccgggcttgcaacccaatttattccaaccaagttacctggggctctttattaaaaggatcttaccttccaacccccaccccttcaccagtgcacatgtgcccacacataccacacacgctttgttctgttttggtttgctttctgcttaaattgattaaaagacttttttaaaaagaaaaaagaaaaagaaaattgcttttggtgaaaagcccttcatggtgttcttaatgaattactttcttctcttgaaaccaagcttcttatttcttccaagaagctggtttgaaatctttgctggaggatagggtcagccccaggacgagatgaaggctatggcttccagtcctgccacacaggcagcttactcctgaaacttcaccaaatgactgaccgattgagtgccaacccttcccagttttgttttaccacagaaaaattctaaatttgttaggtgattgattgtgtttctctattttaattcttccctaatgtattaattgttcgattaattttcatttccccctttttgacattctttttcttttaattaaaatttagttttcttcatttttctgtaaatttgac

SEQ ID NO: 348 - DNA, 747 bp, Homo sapiens
  misc_feature (1)...(747): n = A,T,C or G
cgcggaattctagagcctcaaattcatacattttgacaacttgcttcctttacctggcaataggtcatcttgaatttctccaagcttcctaaaatccccattattttaggaattttcccctaaatatctgcagcaagtcagagttccttcttggaaaaatggccgccttctcccctatgtggaccccctcttctacatattcacttgcttgaattaatgagttgctattttctattctattccttactaaccaacaagaaaatgattatgatttctctatcacgtttgtcagaaaactggtctaatgaggcctggcacagtggctcaaacctgtaatcccagcattttgggaggctcaggtgggaggatcacttgagtccaggagtttgagaccagccctgtgaacaacatagccagaccctgtctctacaaattaaaaaatttgtagagacaggaggtcgaggctacagcgagccatgatcacaccactgcactccagcctgggcgaaacagcaagatcctgtctcaaaaaagaataataggccaggcgtgggtgctcatgcctgtaatcccagcactttggaagcagaggcgggtagatcacttgaagtcangagttcgagaccagcctgggaaagatagtgagacccctgtctctacaaaaaataaaagaattagctgggtgtggtagtgcacgcctgttgtcctggcttctggggaggctaaggtggaaggattctttgaacc

SEQ ID NO: 349 - DNA, 804 bp, Homo sapiens
tggagacaacaccatcacgtcaataatgggatcgatatgcagccaagtctcaccttttgatttacacagagctgattttaattgcttatgctggagggccctgactttcactaataaaaatgactggttgaactctctctccttcccatgagaggaactgtatgataaatattcaccagttaaaaaatacacaaggtcaatctacagttatgactgcaatgaagcttttaagtgatcttcttattaattacagcatgatctacatttggaaagacaggcacctagatgtaggagacacattgcttattcaaactgtagacaatgcttacggtagatattgattagcagataccctgtttaaaaaagcagctctgcatggcccaccacaggctgggaaccacggatcagtaccctggaggtctgccatagagttatttccactcaacccacaatctagtcccatccctgtattccagaaagtctaattaatagccaccctagccatgggaaaatccactgagattcaggaaaacaatcctgatctccagagtaaactcatgagtaagaaaaaaagtactggcactgcaaaagatttgcaacgcaaacacatcataaaaagaagaaaatgttcttcttggaaaagattttcttgtgaagcaagtaaaattcacagcatggctgttttcttttatcaataagataaaagaacacactgcatcacatcaagaagaacccatctggataaaatgtgctgtgcagcagaatgaaaaccacagcagactaaataaaacctttgttgaaagc

SEQ ID NO: 350 - DNA, 624 bp, Homo sapiens
cgccgaattctttactttttgacgcatacccattttttttcagatttttaacctaaaaaataatcaaaataaaaaataaggaaaaaagtcataagcacaaagacattatatctattcctctattatatattatggatataaaaaatattgaaatgttacataaataaaaatatatatacgataaatatgtaaatgttaatgtatgacacagaagcatagaaacaatccagttataaaacagtgcaagatttttggtaaaatataatatgtaacggaacactttatattacaatcataattatgaacaatagagtaatatggaaagtggtttatgagtgcacattaagtttaaaagcagacggtgggcctggtgcagtggctcacacctgtaatcccagcactttgggaggccgaggcaggcagattacctggggtcaggagttcaagaccagccacgccaacatggtgaaaccccatctctactaaaaatacaaaaattagccggttatggtggtgtgtgccttgagtcccagttacttgggatgttgaggcaggggaatggcttgatcctgggaggcggaggtttcagtgaaacaagatggtaccactgcactccaagctggg

SEQ ID NO: 351 - DNA, 646 bp, Homo sapiens
tccctgtagaaactaaagacaacatcgtaacaaacgacccggagttgtttttcagaacctggacccccaccaaatggatctgttgacttacagacctctgatatgggggagcggagagctgaactccaccaccgttctttgttctttgttttttgagacagagtctcactctgttgcccaggctggagtgcagtggctcaatctcagctcactgcaacctccgcctcctgggttcaagcgattctcttgcctcagcctcccaagtatcctcctgagtacaggtatgcaccaccacacccggctaatttttgtatttttagtagagacggagtttcgccatgttggccaggctggtctcgaacccctgacctcaggtgatccacctgcctcagcctcccaaagtgttgggatccacccctccgggcccaccactgttctttgttctaaatttcttcctgaggggcctggaggaggtcatgcccacaggccagagctaacattcttttttgctgatctcaaattttttgacaaagccttgccttcttaaccaatcacaaatcagaaaacctctgaatctactacctatatgacctgtgggcccccagttcaagatgtcctagctttttaggtcaaaccaatgtgcagc

SEQ ID NO: 352 - DNA, 631 bp, Homo sapiens
cgcggaattcattacagactaattctctcatagattcgctgctgacatatttgccacttttgctttcacatcagaacagatacacggtggctgaagtaacagtacagaatgtcagctgcctggtacccacgccctgcttttcacaaagcccctgaattccctgcgagggacagcctccccagctttcagccctgtggtttgggggtgctaactgaacagtcacacggtcatatgagtgaatccccctctacagggtctggctcagggagggcacaggtccagcctgagtccccatcgtcctccaggcgcaggcctccgtctcagcaggtgggacagggactcccccgtgggcctgaacccctgccgcagccattcggccaccagggggcagagtcgacctcggcctgaagccaacactaaggatgcgaaggcgagctgggcccggtgctgcaactgccaaagaattcctgcaacgccagggcttctgagctccggacttcacagtcagctgcgtcagggagttccccttctgcttaggccagtgcattctgggatttctgtcacctgcaattggctgggccgtaagagatgcaagtcaggacacccccgatggcagtgagttgtgtggctg

SEQ ID NO: 353 - DNA, 680 bp, Homo sapiens
  misc_feature (1)...(680): n = A,T,C or G
cctgcaattctccgggtcagagaccatgcgatctctgttccttctggctctcagcaagagaccaggtaccatccttgatccttatttctgacccacagctaattgcaacaagtgccaaccaggcaatgaaaaataagagacttgtggttttccaaacataggccggtttcttactacagaaggcagctgtttcgacaggtcagctgacgctggtcccaaacaagcagtgattcacagcatcctaggaacttcatgctaaagatagaggaggagagaggtcggaatcttgaagaacacggcgttctttcatctgctattttaaagtctctaacttagtaaagaatactctttgttttacagttctgcgtgaaagtaagggatatgtttggttgatgtggtttgntnttntttttttttttntttttttttttttttttttttttttgtttttttttntttttttttttttttttttttntnttttttatttttttttttnttnttttttttttttntttttttttttttttttttatttttttttttttttgtttgtttttttttttggtgaatttttttgtattttgttttttttttatcttgtggttttttatgtcattatgtcttattatttttttttatttttttgagttgttttttttttttttttatttgatatt

SEQ ID NO: 354 - DNA, 877 bp, Homo sapiens
cgcggaattccaaatttggtagctgtggggagctgatgaatggggagaaagggcaaaggaactcttaacgagctctatgtatatatgtgttgtttggatatctttcaatgtgaactgttcatgtgttacccttattaaaaaaaaagatggaaaacaaagaactggaaacaatccaaatggtccatcagcgggcaacagacaaaccggtacgttcacaccaaggagtactcctcaacaataaaaagaaacaggctgggaacagtgtctcaaacctgtaattccaacacggtgggagactgagaccagaggatgtcttgagtccaagaattcaagacaagcctgggcaacacagtgagatagtgtctctacaaaaaatcaaaaattagcacggcgtggtgccacacacctatagtcccagttacctgggaggagatcacttgagctcaagaagtcacagctgcagtaaagctatgatcatgccactgcactccagcctgtgtgacagatcaagaccctgtctccacaacaaaaacaaaaacaaaaacaagctaattgggccgggcgcggtggctcacacctgtaatcccagcacttttggaggccgaatggggtggatcacttagatcaggagtttgagaccagcctggccaacatggtgaaaacctatctctctttcttttatattgttttttttttgcacacgattttcttttgtcccccagcttgtgtgcagtggctgttcttggcttactgtagctttatccttctttctctgttatatttatatttatttggctttattttttattcttttatttatcttattttattagtattatatttttgtttttttttctgggtgtttatttcatatcga

SEQ ID NO: 355 - DNA, 690 bp, Homo sapiens
ctcacagaaaggccgtgggtagagacgtgaatggaggaagtggagtagatgaaatggttaaatgttggagaaaagaggctatttatgaatatgaccactgtcattcagataaaatttctggactgttatcattgaaaaaagtctcattatgtttctatttgaaagcaaaccattatgcttttttgaggaaaaaaaaaaactgtgagtcacgttatgcttgcaagtgtttaattcagaccatttcatctttaagaaggcccctggtcacattatacggatgatttgcttattaaatggaactcctgtttcttgcaccatgttgtggggtcaatatgagaagcctaattaacagaataaaaagcattaaagcttctttagctaaagtcaaacttagagaattgtctaatggtatgtagcccctcgttctaagatgggcgttttccccagataacttgaaaatctactggtaacagccacttccctttaaagaattctattactaatagccatgacaaaatggtattgtatttcaaagttaagaatttgcaggccttaaaaactaacttatttttcctgattattgaatttattgtagaattctacgtgtaagcattccccagccgctatagctttgaataagcagagcttttttcagagttctggtagcgcccagcccagcaccttttattc

SEQ ID NO: 356 - DNA, 644 bp, Homo sapiens
  misc_feature (1)...(644): n = A,T,C or G
cgcggaattcctgcccattccacatcccaaagagcaaaccatcctaaaataattcgcccagagatttacagcaggatgggtatttttcgaaatctcatccagaaaagaaaggagaaaattaatagcatatcctgaagctggaattttaaagggcacagacagaggaagggaacaccctgctgttgctctttctttgtgttaaaaaaaaaattgcctctcctgactttgaaagtagctactgctttttttaaaggaaaaaaaaaaaatcaaagctctaccaaccatttctttttgacaatggagagcgcgttttcccctggtactcaactcattttgaatacagttctaccagtcttgtagaatacacaccatgtatggactatttttattatggaaaagctaagcagactcccaccagggagagtgggtgtgtgtgtgctgggggatttntntttttttttttttttttttttttttttttttttttttttttgtttnnttttttttttgtnttttttttnggtttttttnntttttttttttttttttttttttttgttttttgtttgtgtttgtttgttttgtttgttgtgtgttgttttgtttgtttttttgttttttggtttttttttttttttttttgg

SEQ ID NO: 357 - DNA, 691 bp, Homo sapiens
gggaattcctcggccctggccagaaatggagggtggacttacagccaggtgctcaggtaccagattggtggttactcttctggcctcgagggcatcagcattgctgacatgaacacagcagcccctttcagtcaggttttgctttcagttatccacgatcaaccaccgtctgaaaatatgcagtggatcactccagaaataaatcatttataaattctaaactgtgtgccattctgagtagagtgatgaagcctggcacagtccttctccaccttatccctgacatgcattattcctttgcccggcatgttcacgctgcagacaccacactccgcgcccaccagcggctcagtagccatcttggtggtgagctggactttctctgtatcacagtgcttgcatccaggtcacccttatttgacttaaggatggtcccaaaagaacatgtgcacgtggcaaaggcagccgtaaagcactttttttttttttttagtgaaaaggtgaaagttctccacttaatcaggaaataaaagaaatgataagctaaggttgctaagatctttggtaagaacgaaccttcaatctatgaagttgtaaagggggaaaaataaatttgtgcacaacatccatagaggtaagcactatccgagctttcaggcattccctgggggtcttggaacttgtccctggg

SEQ ID NO: 358 - DNA, 212 bp, Homo sapiens
  misc_feature (1)...(212): n = A,T,C or G
cgcggaattcctcagcctgagcaaaggtggtgggggtgccaggtgagggaacggtatgcacaaaggcgcggtgtcttgaagctacgtggcacccctagggagggaagaggatctgcaggggtgccattggtgtgtggcaagatcagatgcgggtcccaaagattacactggtagctttgggaggagaggaggtgaaggtggatannnngnnn

SEQ ID NO: 359 - DNA, 613 bp, Homo sapiens
tccgtggaattcaacttgagaccagcctggtcaacatggtgaaaccctgtctctactaaaaagacaaaaactagccgggcatgggggcgcgtgcctgtaatcccagatacttgggagatagaagcacgagaatcatatgaacccaggaggcagaggttgcagtgagctgagattgcaccactgcactccagcctgggagacagaagaagactccacctaagaaaaataaaaaaagaaagaaagaaaaagaaaaaaaaggagaaacacctcctgcaacatttcatctcagtaaggctccctcccgattagccttttccatcttcgtcatttgtgttggttcttccttccccaaatccctgctttctgaaagttccgtgaggatttggctattgggcatcttttttttccccctaatccacacacactcgcctagataatttcttttgcttcttatggttttaaatctatgcgttggtgactcccagagatcttttgcagggccttcctctctgaattgcagattctcacatccagttgcctatgccccaagcttggacatcaaaatcttgaacttagcatcttcaaaattggtattttggtcttccttttgtgg

SEQ ID NO: 360 - DNA, 578 bp, Homo sapiens
cgataataccactcactatccggagaggatccgcggaattcaccctcttcagcttgatcataagaaaaatttagctcaaatttagaactgctgaacagttcagaggccacggtgataaagtgctacctggagaggtggggagctacccactccagtgctgttttccacttcatgaggaccctggtggtacctgctcagcactgggcattgtgaggattcctgggaacccacattcacgtagtgcaaagtggcccaaaccttgaaaaggctggaaaccagtatgcgtgtcagctgggttgaaacaggtacatgattcagtgagaccaggtgtgtacaatagggagtagtggagactggggcaaattgtgactgcaggcctcatctgaaaaggggaagccgctgctccgttccgctgaatgtcgccatttggtgaacgtatgctgtgacatatgacttttcataggtgttggaaatctatatttaaaaaataatgtaaagacttaaattctggggaaacagaatacatctatagaccaggtttggcctaagaactgctaatttacaacttctgcataaat

SEQ ID NO: 361 - DNA, 738 bp, Homo sapiens
gctcaactcctgttgagaacccccaggtggggtggagctgatgagaccccccaggtggggtggagtatatgcctctctgcaccttctcagaccagacttgtacatcccgtgtttcatgtggatcttcgatagataattgtcttccagaatattttaaaacctcctctagggctgaaaatgagtcttactcatcccgtagtaagaacttggtgagtgcttgtttattctaagatctgtgaaatcctgtaactcagtgtaagaccctcccagcagcagagggataagcaaaaggcagccaggcaccgttgttttgctccttcgtgggcacaaatattgctcacgtaattataatttcatgtatgtgattgaaagtttctgacacataccatgcttaccccagttctagctacatcaatgattctcacattttggtcagttgtattttaaaaactcttaattccagtgaaaatgtatggtagagaattatttgggttctatgattctttagcttgggattttcagacccatttttagcattttatggctgacttttctgccaatcactaaaatggaagagtattgtgttgagcacaccttgacacatactgtcccaaaaaagggctgttgtttcgtttccaaccaacaacatcctttttgcataaattcttaaaccctgtagttggaaaaatttattaagacataccctgatgcacaacattaattacattcccttctttt

SEQ ID NO: 362 - DNA, 752 bp, Homo sapiens
  misc_feature (1)...(752): n = A,T,C or G
cgcggaattctggggcgagccctctttggaaagccagaaccctgacttccttctcagtcttatctccctccaccccttctctctactgcacattcattccctcccaaggatgctcgcccaggtaggggaacatgggcaggaagacccacggagctcactgtgggtccttatctttcatctcctaatgggcacagtgcatgtacccattagattagtgtatggtagaggacaacaatcctgcaccatttaacttaattttttttgctttaatttagctgatttcatatagttaagtttataaaaattaaatgtataatatgtttctactacattagcttagcgcttctaattattttacagaattgaaaagcagttaacctacttggctcttccagaatgtttataaacacacatccatttaaccctttccacatcttttgctaaactattaagaaagacctttaaaaaaatctgactccgtttttctttaaaggattgtgttaggccatttttgcattgctatagagaagtacctagacgataatttataaagaaaagaggtttaattggctcacggttctgtaggctgtacaggaagcatggtgctggcatctgctcagctttccgtggagtctagggagctacagtcatggcangaggggaatgggaagcccagacatcacatggcaagagtgcaatcnagagaagaggatgagggtgccacacagtcttaaacaaccagatctttcaag

SEQ ID NO: 363 - DNA, 686 bp, Homo sapiens
gcttgtaacaaaggtctcatgtaagttgatggagccgctcctctatccactgtctcctggatctgctccatcctcatgcaaacagagaatgacagacactctcgtctgaacagggcgtcttccccatttgctgtgattggggaagataagactggagaaggcacacccattctgtcgtgcccaggcccagcagcaatatgtcatttttgttcacatcgctgcttgacagaactcagtcacatgaccccagtttaaactatgcaggaggctgcaaatgtcaggaagtatacggatgtggctagtgggtgtgccatcgcagcaacttctagggaattgaaaagtcagcatcagaaccgagaggactgtctccagcacccagaagactggctcgagaacccaggcaactgtctccagaacccaggggactgtctccagaaccaaggtgactgtctccagaaccaaggtgactgtctccagaacccagaggactgtctgcagaacccaggggactgtctgcagaacccaggggatcggctccagaacccaaccagcttcagaacccaggggactgtctgcagaacccatgagactggctccagaacccagagtactgtctgcagaatccaggcaactgtctccagaacacatgggactgactccagaacccgggggactggctgtagaac

SEQ ID NO: 364 - DNA, 834 bp, Homo sapiens
cgcggaattccaatctcttcccttcacacggttgggctagcttcaacaccaccccatccaacagagcttccttgaccatctgacttaaaatgcgtccactggtggattattctttaacataacaccaggttctcttcctttctagatgtaagacaattttaaatacgtacgattgttttctcattcgtcatctgccttctgagacagtgggtgggatgtggtgtggcaggcagagaccatgtgaacagacaccttgggtcatgactttacatccagttcctggcacgtgtctggcaaagagtgatgcttatgttaatttcctgtggctgttgtaacaaactaccacagctttggtggctgaaagcagcacaaacgtgttgtcttacagttctgtggatcacaagtgtgaaggagagctcactggactaagtcaaggtgttggcagaactgcattttttctggagtctctagggaagagtttgcattcttgccacttcagcaactataggctgcaagcattccttgtctttgtggcccttcttgcatctaaaacccagcaggttggttttttcaaatcttcctctgactccagcttcctgcctttttccacattaaaaacacccttgtcattaggcccgctcagaaaatccaagatgatctctttatcttgaggtcaactttatagcaaccttcaattccttctttaaccttaatttctcttttggccaggtcaacttaatacattcgtatggttccagggctttagatttgagcatttttttgacggtcattttttcttgcatgcctaccattgttttaaatataaaattgctg

SEQ ID NO: 365 - DNA, 714 bp, Homo sapiens
cgctcggaaatagggaatccacgccctcctaaaccacctgtgcccctgtatccagctgtacttgaaggtcaacatgtgcctgtcgtttccaggttcttgaaccaataaattctctctctctttaacttcatgtctctctcttaatcttaagattctgtaactaacaaccaaagaatccaaaaattaatccaacagttaatggaaaaatatttgcttacagctaccattattgacagtctattaactcatcacaattaatacaacccactttaatatctaagacagcattgaagatgatattagttcacatttctgagacacttgctacatgccaggtattattctaagtgatttacgtggttagtaataaatacacattactaaaatatccaaacagaacaaattggtgtcccattaaaagtaagtcaggagaaacctcatttcctaattgtcttcttcagaatcagtaccataaccagttactctgtattcttgtaggtctgtacaataaataggataaataaacaaatgctgtaaataaatatgcattataataatacagctatatgtatgcatgtattgatttttgacacacacaataccagctgccatatagatggactggttatcatgtgctaagctctattctaagcacaagacaatgcacctattatcttactgaaatcctaccacatgcaggaaggaagtcatcct

SEQ ID NO: 366 - DNA, 664 bp, Homo sapiens
cgcggaattctctgatgtataacaagctgtgaatggaaactgaatgttttcctgcattcactgcattcatgtagtttctatcctgtatgaattctctgatgtacaatgaggtatgatttactactgaagtctttcccacattcattacaaccatagggtttctcttcggcatgagtttgctgatgcactagaaggtatgacttgctgctgaaggctttctcacaacagctgcatccaaagggtttttcgcccatatacatttgttggcacataagttgcgatttcttattgacggtttttccagattcaatactttcacagtattttattccaataacagtttgctcatgtttagaatggaagaatgattttccatgtacctgaaacccattaggattatttctagcataatcactagtgaaatctatatatttcaaactctttccatgcgtgccacatttatgaggtttttgtcttgaaagatactttgtactaagaagacatagttttccaaatgtagtgcattcaaagctttttggcgtacttcccagcttgtctttattttcctgatgccaatccataagatcatcaattttccagactgtgtctagaaatgagaacaattggtcacatgttataaatcacatgattgcggtatactaga

SEQ ID NO: 367 - DNA, 709 bp, Homo sapiens
gaatacctagctgagacctcactccacagtttgggggcagaaacagaagagacgcacagtagaaccgatctcaaccttgctgatcatctcgtacagcagcagaaaatgaccatgttacaggtgagttgattgttgagttcttattttttcccagggaattagaagaaatgtataagccttccggtgaaaaagaaaagtttaaatagttaagaaatcagaggaaaatagcctcagatgatcaggattggaacaaaattggcacagtgatatattaactactggaccatgacaggttcttaggattgagtatttatagcatatttaaagccataacatcttacataattactgcatttgagctgcaaactttgttttcaaatttttggtagtcgtaatagagaaatgtgagcttttatatgctttgcatcgtttaaaggtaaaagcaaactgattgcccataggaagtaaatatttcttggttatcgggtgtccatttctttttccttgatgaagtcttatgaatgagagatatgcagtagttcctccttatctgcagttttgctttttgcagtttcaattttccaatttcccatggtttgaaaatattaaatagaaaatttcagaaataagcaattggtaaagttttaaatggcttcctgttctgagtagcatgatgaactcttgcaccatcccacccaagacctgcctc

SEQ ID NO: 368 - DNA, 851 bp, Homo sapiens
attatcactggaaaacatacatactagaagatacaaagaaaaaacttttttaaagctgctgggccagtcaccaccatctaaaacattggtcaaactccaaacattctaagacaggatttacagaattttctttgctctaaagatattaataagaaacggaatgggattcttaaatatgaagacatgccaagttttctgggactcccgacacctacatattatagcccattctcatgcatatttttttaactggtggacaaattacatcaagaaaaattaagagctcaaattatcattattcaaacagtctcttcaaaaaacaagccttcaactatagggctaatgtggagagccttctaagttctctattttttctttgtctgctaactttgaatctgctgacttttctaatggggtcgagataaaactcacagctttggcattccagccaatattttttgtaattgttgtaagaaagacgagtgggtgtggcaactcacacttgtaaacccagcactttgggaggctgaggcaggaggattgcttgaacctgggagtttgagaccagcctgggcaacatagagagactccatttctacgaaaaataaacataaaattagccaggtgcggaggtgcacagcttcttgggaggctgagggtggtggatcactttaacccaagaggtggaggttgatgcgaacctaaaactgcacattgctttttgccctgacaacatcttatttgatacctttttcggaaaaaaatgtacaaaaataatataaagggtcccttcccctaaacttttttaaaaaaacttttttttttttttctttaaaaaaaggtttgcttct

SEQ ID NO: 369 - DNA, 525 bp, Homo sapiens
gcgaggatccgcggaattccttgctcactggcatcttccctgcctggtggtaactcagaggagagaggggcttggtctgcccggggtagagcagagaatacacagacgtgctctccagatctggaccagcagggtagacggatggacagatggaagttctaactctgagtccatgcagcaacctcctcctcctctcccggtgctggcactacctgcatccagccccctccccgcccatgctgccactgggggctcacctgacccagcccacaccttcctaatctcctggacccattcaagtgcaattaatccaaacttttgattaaagatatttataaaggcactaagaatgtcctctaatatcagcttatatatttctaatctgccgttaaagtgatttaaaacggagcttcgacagataggcatgatgaaaattaaaagtctccatcaccttgtgtctggctgcagtgccctaaccaacaaggacacactggggctgatgccaccctcctcttcaaatttggg

SEQ ID NO: 370 - DNA, 638 bp, Homo sapiens
ctcaaaaacgcaaaacaaaaagagactcccttttatttacctcgtctccctccccctgtttggacatgaccttgagctctgctgacccacaagtggccaagctggagctgtcttgcaaagagaaacaaaaacaacacaaaaagctgcgttcttgactttgaagccttaaagggcccaggggctggctccctgtgggtgttgggggcgattttcctcccaaagcctgcgtgagatatggagacactccgcctgctcagaagctccccaggtcccgggttccaggaagcctcatggcccaaggcctggccgtcttaattttcttgttttctttccctccactccactgtttcttcctgttcactgattgcctgtgctggggagggggaaggaacgggaggggcctgaccttgttcacttcctggcattttgggtgaagttccttacaccttctctggaagcttctagaaggacccttgaggcgctttaaatctccattctttgggttttcctcccaccttcctggctgctctgtcttcttgcctgctgatgcctccttatctccctggcctcctgcctcctgctggtggagctccaggcatcctttctgggtgtcctcatcccttatccctggggtgggg

SEQ ID NO: 371 - DNA, 605 bp, Homo sapiens
gcatccccatgaatccagggtccaggaacgggctgaattcttcctttcctttcagtgtgcaatcccaggcattcccttgacaccttctggagtaaagagccctatgcaggggccagagaggggcactcctctcccgcaaaggaacttctcccagtccatgctcaaacatccccccgcatctagcccctttctcctctctgcccccagccactcctccccacccttgggacccagccaagaaggcaccagctgggattccctcctggatgaatggctttttctggtggcctctcacctttcccaggagttttaagggtgtaatttattggtggccctgatttccagcttcagaggtgccatggtcagggagaaccctctgaggccagggggcatcacctgaatggctttttcctgcctccctttctgaacagctgggtcagactccctctgcccaagtcaggtttgctgctgtcctacagggacaggttcagagcctggggactgtccccttttgtcccctcttagaaagccagctaagcctttgccttgcatctaagaacgtaccccttattgctgtgtgaacgggacaagccacttaccctctc

SEQ ID NO: 372 - DNA, 748 bp, Homo sapiens
cgcggaattccacctcaactttttaaaggccaggggcagccttttcattagtcacaacctaacatcctccagtcccgacttgactcctgctttgcatctggaaggaacaggtgctttggggcagggactatttccgtcctgttgcattcctgaaggctaataacacacttgttgaattcatgcaaaaattaatagcaacatgttcaaacttatcgctcctcaaagacaggccagaagtttttaagcaaactcgtagtggatgtgtggaggccagaaagaggcagcaccagactgaggggactccggatacagagggccagggtcaggccacccaggcaccaaactagcctcatgcacattaacggacctctctgcgtgtcagtttgctcgtctgtccaatgagaactctagcaccttgggattgctcggaggagtaaatgactgagaagacatgaagcgctgagcctgtattcacattcagcctgaccccaggggctgaattcgtaaaactatgctctgctgcctctctggttgctgttagaactgtgcctgggacacagtaactgctatatgtgttgcagaagaaaaaagtcaaatgtcgaagtcttattagaaaaatgctagaagaaaataacgatgagagctacagacgacaccaccaatacaaaataccaatacaataccaatacagatcccaccaccaatacaaaatacatttgttgagagctacaatacaattcaaaataca

SEQ ID NO: 373 - DNA, 627 bp, Homo sapiens
ttctcttcatttgcagcaatctaatgaaaaaggtagacatgcctgatgtcgtggcaagaagagagcagagaagacaaaggagggcagctgccagaaagtctcttttaagattagctgagtattttctgaagcctcatagaagtctttctttcctgtttggtcttgactaattcatctcccttcctggatgaatggagtaactcatcctggggatctgtttcttatcagtgaggggaagggagaaggcggagcgccaggagattcagacttagagagcagcgaaagacgtgcagcatttaatgaggactcagtgatgccagagaatttctttcttagctatccctttccagcttcatttttgtgttttatctaatgacccattccctggcaaaaggagaaatacaaagaatcaataagcatctaagagatgttcatgatgacaaatgaaaacagtccatcatctgttaccttccaaactggcaattctttttttgttgcacctgtttcactgacgctgctacacgttggtgaggcatattaagaaacacaaagaacaataaaagcaagcagttcagctgaccacataggacatagacatatttcacagacacagcctcttagaagatg

SEQ ID NO: 374 - DNA, 576 bp, Homo sapiens
aatcccactcactatagggcgaggatccgcggaattcctcggccctggccagaaatggagggtggacttacagccaggtgctcaggtaccagattggtggttactaattctggactcgagggcatcatcgttgctgacatgaacacagcagcccctttcagtcaggttttgctttcagttacccacgatcaaccaccgtctgaaaatatgcagtggatcactccagaaataaatcatctataagtaataaactgtgtgccattctgagtagtgagatgaatcctggcacagtccttctacaccctatcgctaacatgcattatttctttgcccggcatgttcacgctgcagacacgacacttcatgcccaccagcggctaaacagccatcatggcggtgagctgagactttctctgtatcacagtgcttgcatgcaagtcacacttatttgactctaaggatggtcccaaaagaccatgtgcacgtggcaaaggcaatcgctaagcactttttttttttaatgaaaaggtgaaagtcttccacttaatcacgaaataaaatgaatgataagctaag

SEQ ID NO: 375 - DNA, 757 bp, Homo sapiens
caaattaatattgcctttttatatcccttcccttttaaacttacttcatccttgatatcccttttgtaaacagcatgtagctgagtttctatttgtacccaagttgaaggtgtctttccttttataggggaattgggtgaatagtgtttattatctcatgatgtccttacatgcttgtatttctgtttattttatgttgtttcttttccacgttttgttttttaaaagttgagctaagcaagtctcatttattccatttaactttttataaacaactgctttagtagttatacatactagttatatttttctagaggtaatttaaatttttaaccatcatattcaattttaaatttttattaatgtctaatattaatcaatagcttcaccccaccaaacaagagtctgggcacacattcagttccgtctctaccacctgtgggctctctggggtgcggtctccttcaccatcttcatagccagtagctcctggtggagcactggacaccagcccagactttgatctgattcacccaatcccaactgctcattttcaggtgtttctggaaagtttctcttctactgatggcatcgttattgttttctacagatatttaaatatttttaaatatatattatattttcctgtagtttctggggatttggagcaagaaagggaggcacgtgttaaacattttttttgatcaaacatcctttttgagaacactttgttgggttttaaaatatttaagataat

SEQ ID NO: 376 - DNA, 756 bp, Homo sapiens
  misc_feature (1)...(756): n = A,T,C or G
cgcggaattctgctggcatctgggaacccagatttcaggagggtccccaccatcccctaactgatgagagtagttcactgggccgaaattatttgtacaaacaatatggttcttgctcagcacctgctttccttcccagagcctagaattttggtacctgccaggcagaggtgcccacatgactggcccctagcaaaacaccatgggcactgaatttctaatgagcttccctgctagacaacatctcctacatgttgtcacaactcattgctaaagacattaagtgcatcctgtaggaaccccctggaagaggactctggaagctccagcctggcctcccccgacttcacccaaggtgctttttccctttgctaattttgctttgaattctgtcattacaataagtcttagctgtgataccaccataagcagcgtcctgttgagtcccccgtccccatgccctcccccagtttcaggagcagaaaagtggccacacggaagcagcttccaacacacgttcgtttttcaaggctaaaggccaacaggcagcaagctgatctcctgatccccctccccaacgtgcccagctcaaaaaacaaagaaataaaggccacttcctctccccgtcggccttaagctcatttggaggtagaattggacgcaacagctaaagtggcttcngcaaaacaacctgtttgcccctctctgggctcccaaacttaaccccttctttcttgatgtgaggggaaaaaaaaa

SEQ ID NO: 377 - DNA, 474 bp, Homo sapiens
ttacttccacctagtctcgactagttggacgatccggccacaccagcagtgtccccaccaagctgctgacccttaaatggcctgtgtgcccctcccacccagtaaaaccccactctgcggtctcctcagcctgtgctgctcatttacatgaggcctgactggagcctgtgagcactgtcagttcgtgactgtttatcctgtgcagggactgtaccaggctctctgctaggccctggtgatagagcagtgcacagatactaacctctttgtctcaacgagctagaccaggccatggcgggagatgatatctcgggaagtcatcaggcgagtgcatgtgagtcccacgctgtgaagcactgaccccaaaatgaatcaggtaacaaccaagtggatggagacagatgagtcaattgtgattcgcagcctatttggagaagctatggagtgcagaaaatttgggagggagataatcat

SEQ ID NO: 378 - DNA, 617 bp, Homo sapiens
cgcggaattcaaatctttgctaaatatttaggaatgctgttcaacgttgcctttcctgacaacttctcttgtctctctaatctctccataaaatggaaataatgatggcacctgcttcatagttctttagaactttgaacaaattaatgtttataaaatgtgtagaacggcacataagtgaattcaaatatttgttagatatttaggaatgctgttcaacagtgccttcactgacaacttcttttgtctctgtttcctctctctaaaatggggataatgatgacacccactgcatagttattttgaactttgaacaaattaatgtttatcaaatgtgtagagcagcacgtaagtgaattcaaatatctgttaaataaacatttaggagtactgttcaacagtgccttcactgacaacttctgttgtttttagtctgtattcgtaagcctaagtaactgtcattgaatttgagggtgatgttagtagggtcactttatgagggccgcatattgtatccatttcataaccacaaacatgaggtttcacacctagtttaaatgcactctctacctgtttgtgttggatctcaagagagtcattatgatgctttgaatgag

SEQ ID NO: 379 - DNA, 510 bp, Homo sapiens
  misc_feature (1)...(510): n = A,T,C or G
gcaccgcggaattcactatccagactgaggtggttttgaaactggaaggagataaagctgaaaaccagagttgtgctgggaaacctggacgtagagcgctgagccccccaggtatttaatgaccagcacagcgcgccgccgtgggtttcaggccctggagatgatgagaatcagctggagggctgcttccagtcggcttctaactcgggagggctgagagccgctccccaccccgtaatttctgttcccagccagtccagatgctgcccgtcagggaccaggctttgagaactgacgtgctgctttaggaatatttcctgctggagatgagagttcagcttgtcactgttttttaatcactgtttcacaccgttgtttgtaaggtgtcaagcgacggactgggtgcaaaggcatcaattgtgattcgcagcctagttggagaagctatggagtgcagagatgtggggagggagaaaacatgttaccatgtattatggtgaccnttttcat

SEQ ID NO: 380 - DNA, 821 bp, Homo sapiens
  misc_feature (1)...(821): n = A,T,C or G
acgactcactatangcagaggatccgcggaattcaagtactgcaggggctatgcaactggtggatgagaggacactttcaggccctctaaagatggggcctcacagtaaaactgaagccattctcttccagtccttctgactgcatccaggagaaaggctcaggcctgagctactccggaagagccttttagtaattgcaaatgtccatgttttttaaacaaaaaaggaagctctttctgcacaatgacaacatctagctcaagttactaacatcgatttgtttttattttgattattattatttttgttttctctccttttacttggtgatgcattttgtttaaaaaatatcaagttatgtatgtttatgaagatgggaaatgagtaatggattcagcaatcactacagacaccgttgacaggcaccgtctccacaatatcgacattctccgcatgatggtgagaaatgaagtttgggaaacccttaacaacaagtcgagagctatcagattaatgcttcctgaagatgctataaaaagttcttgaaactacctgtttttccaatttcccacaattaatgaaatgacttggaaatagaaaggcctgtcttagtcaactggcttttttactaaagttgaaagcctttcttgaagttgtgggcactgtaaatactttgaaccatgcatatctttcttggtataggccaccatgaaaatcattttttcccaaaggagcttctttattgcaatctcatactgtcaccttgaatgaagttttattttttgtcaataatcttaccaatttttttttccaacatcaa

SEQ ID NO: 381 - DNA, 685 bp, Homo sapiens
  misc_feature (1)...(685): n = A,T,C or G
ggagaagatccccggaattctcagatctgcttcttcatttactgtgttatgacagcttgttttgattgaagtatnttaaaaatataaaagcctcctgagatggaaaaatagaactcaaaaaacctattcagataaatgtagctattcttctttgatactatacccaaaatcaacacgttgcatttaaaaattattaggtgtattatggatttgaaactatatcaatatgcatttcctactctgctatattaaaatccattggtatctcttgcgtatcgaatagaacttttagctctgtcggattttgtaacatgatgcattaatcgtttgaaagagttcggttcactgttacttcagatcttttctatttcacaatatattttttaaaatcatatttattcatgtctcagcgatctcattagcagtcttgagtattgaaaacatataaagcttgtgatgatagatacaaagtttcaaaaattattattgttacttgaaaattcagattttatcttgcgtatcaaacgtcattcatttccccccgcccttgaagtgacaagcatctcacttgattcatatttgagaaaatgtctgccaaattccaaaatctgaataactcacactttgccattaggcctttatacaaaaaaaggactttcatgaacgtttttctttcttttagcct

SEQ ID NO: 382 - DNA, 851 bp, Homo sapiens
  misc_feature (1)...(851): n = A,T,C or G
tcaaagaacccttactgatatacacaatggccaaagaagaggaagatcagtctcaattagtgagaagtccaaagctaatggactctgtggatggtcccatacaaaatgaagtcaaaggttaagggcacatttaagttgtctcatggtgtgtttttggtgggtggatagactataaaatcccacttagcacagagaaaacaaactgaacctcagaggacttacgtggtttctctcagtacctacagtgggctcatgcaggcctggggctccagctcaggtgtctcagcttctcagggcatcagctgcctcctattcaggtagtgacagagctactaggattgctcagtgaacatccatataccagctcctagattcaacagttaatattttacaatgtttgctcatcacgtatctatccatctggtccactgtccaccctttaatccatcttatttcatgttttaattggaggtcatcttacttgatgcacagatttttattcatttggcaaatatgtaagacctccctctaggcacttgggatgaaacagtgagctaaataccanaaacgttcctctcaggaggctggacattttggggggattgatgattgatagaatagtacaaaattttttcatacgaccattttttgcgcgaataaatgtttttaatgataccaatttggattaatatacctgaatcttttagatcacatttccatctttgtaatacatataatccttctatgttattttaccattaggtattttattactgggtatttttttccctagttgtaatatgatctttaaaaaaaatctttaatttttcttttgtctaaaattactttgt

SEQ ID NO: 383 - DNA, 642 bp, Homo sapiens
cgcggaattcacagctgacaacactgcatagctcatgcctgagcaaagtttatctaacacaaacagcaaagttagtctcaaaatgaacaaaaataggaaaagcatggaactgagcagaccacagaaggacccttgcttacagagctggacaggaagtgagggcactgccttttttgacctcagtttggatgattcacatttttttgctgctctgcccatgtacaaaaatgacttcagatgttccacaggtattgatttgggggttaaaaataagggttagtaaggagccaaatttgcaaatacggaatgtcaataatgaaaattgactttgtatgtgtgcatgtgtgtgtgtgtgtgtacatgcatatataggagtgacaagtggctggcccaattcaaatttatattgattagatagtagctacttatagcctttgcatggtcccataagatgcattctttttgtagctgaggaaatttaactgttttctaccataaaaattgttgtagtcatctgcaataaggaagtagaataatgtaataaggattgtccgagtccttgaaagagacagctcttattagttttgtcttaggctttggggtaggagagtgtgtaggacaatattttattgagtatttttt

SEQ ID NO: 384 - DNA, 898 bp, Homo sapiens
accatataatcaacccctgaatatgactggttattgaaaaagcaaagcataattagacaatggaaaatgtgcatgagacgaagtcaggaggaagccaggtacaaactttcagagtcctcttccagtgaagccatacgggaagcactcaattccttctggaacatgtctcagcatgtccacaatgttgtttttcagggaagctcatcagataatcagcacctggagtttctattgagggctggttacattaggagtctctgcctggcacatatcaaaattctagacttccccccaaaatacaggaggtcaccataaaccacattgtttgcataaataatcttgatgcagtgagtcattcttattaggaaatggcaggaactctcttgacatccaagttccaaggtggcagccaagcaccaaccttgtaaacaaggcattccaaggacagcagtcttaggacagttggcttaactctattctgcacaccccagatgtatgagacttctgggggaaataataactttcatttttgcaagatttaaatttacaggaactacaggtggctcttattgccttcacaaaagaagtgtgtcttggatttgacacaacagaagactaaacttagagatgaaaaaagataaaccatgtccttctgagcccctgaatacaaccgcagctgaaactcaaatgtaccctggatgtttgtttaataaaccaataaaatccgtcttttctatctagaaataatgtgatgttttttcacgtgctaaagaaaagagacctaattctaacattttatacagttagaaccacatattggttaccattggacaatggtatttcttgaaaacacaattaaattttgaaaaaaggtttgaagaaagtaaagaaggaaggc

SEQ ID NO: 385 - DNA, 580 bp, Homo sapiens
  misc_feature (1)...(580): n = A,T,C or G
cgcggaattctttcctgtgcgagatccaggaaccctctctgggggtctggatcaggacccctttcctgtaacacactgaccctccccagtgtcaggatctgtgccagtgccctgaaggtggagttctcagaggctgccccttctggttcctaccttctgagaattgctaggccaactcctgcaggtaggtggaattcctctcctttgcgattacatcagcgtctcttaactcttgtcatcagagaagtagagagtaatcatcttgaaattaaagctgtgagttctcagtaaattataaaaggtgactcagtaaaggaaaataaagctttaggggaagggcaaagcagatggagtgaaacaaagtgtgattaggaatttcaaatacagaatatgaaattaaaatagtagctggttcataatatacacgagtgaattaaatacagatcactgaacatatttcccctctgaggacatttctctcttcttcctctttgttcataaaggaaatgctaacatgtatatgaaggaaggaaaaaagaaagggaaagagaaagagggaggaagggaggaaannnnnnnt

SEQ ID NO: 386 - DNA, 658 bp, Homo sapiens
atcttaaagaatccttactgatatacataatggccaaagaagaggaagatcagtctcaattagtgagaagtccaaagcaaatggactctgtggatggtcccatcaaaatgaagtcaaaggttaagggcacatttaagttgtctcatggtgtgtttttggtgggtggatagactataaaatcccacttagcacagagaaaacaaactgaacctcagaggacttacgtggtttctctcagtacctacagtgggctcatgcaggcctggggctccagctcaggtgtctcagcttctcagggcatcagctgcctcctattcaggtagtgacagagctactaggattgctcagtgaacatccatataccagctcctagattcaacagttaatattttacaatgtttgctcatcacgtatctatccatctggtccactgtccaccctttaatccatcttatttcatgttttaattggaggtcatcttacttgatgcacagatttttattcatttggcaaatatgtaagacctccctctaggcacttgggatgaaacagtgagctaaataccaaaacgtttcctctcaggaggctggacattttggggggattgatgattgatagaagagtaacaaaacgtatcattggaaatttttatgcggca

SEQ ID NO: 387 - DNA, 750 bp, Homo sapiens
cgcggaattcttttgagcagaaagcattggagttcctaaaattctttatctgcctaaaaccagagcctcccccaaacaactccattgtcctaagtgtctccccaggaacaactgtaatcttctcttcttggaggggagaagcccccccacatcccggcagacattgtcacaaaggaccatgtctcccatctgccctcctgagggcccatttatctctcaataaagtcctttgcgtttccgtaagtgcgcctctgccctccctacccccgttaggacgagatgtgagctccagaatctcactgctcctctggtatttgcttatttctgggacaccctcatgcacgttaagtttaaaattccaaatgcatgcttttttcctgttgattttttgtctttttttgagacagtttcactcttgttccccaggctggagggcagtggcgcatctcagctcaccgcaacctccacctcccagattcaagtgattctcctgcctcagcctcccaagtagctgggattacaggcatgtgtcaccatgcctggctaattttgtattttttagtagagacagggtttctccatgttggtcaggctggtctcgaactcccgacctcaggtgatccacccgccttggcctcccaaattgctgggattataggtatgagctacggtacccagccaatttcttcctgttaataactttcatccgtttaactcacaggcccccagccactgaaagtgagagagtaa

SEQ ID NO: 388 - DNA, 736 bp, Homo sapiens
ttaccgtggaacccagttgtttttaattagccaccctgtgcccaccatttagaatgtttatttttgttcttggaaggtttttagaaacaaagaagggaaaatgggagaatcatgcatttaaccaaactataatcaggatttgcaaaaaattttgacccaggcatgtagatcaaatgaaatattcagctaggagcagtgaccaaaagtgaatttaccagagaagacctcgcacctcgcacctggcacctcgcatctcgcagatggaatctgagttctctagaaaccaaaaagacacttgtctttcttttttgatcctaggaggaatgtaagggcgtttattaaggcaatcttataaccaaaccaaatctggaatacagtggagagcttctacctaaaaagagggaggcctggcctgagagaagattcagcagggcagaaaaggcaagaggcagaagtgaagagctcaggtgggaatcgccagttctgagagccacggcttccttccaacagtgaccgcttttcaggtcccacttctgacaccatttatctcaacggaaatatccgggagaggctctttaaaagaaaactgaaatggagtttcactcttgttgcccaagctggaacgtagtggcacgatctcagctcactgcaacctctgcctcccaagttcaagccattcttgctgcctaagcctcctgagtaactgggattacaggcatgttgtaacatgccctgg

SEQ ID NO: 389 - DNA, 649 bp, Homo sapiens
cgcggaattctagacattttcatcacaggcttaaatggtcataaaaaacgagcactttatatcaaagtaagaggtggataggctgtaattggaataaatatgccgtgttgtgattgaataaaataaaattttgatgtactgtattgaggaatgcacaccacatcagaaagaagccacttttttttttttttttgagacgggcagatcacttgaggtcaggagttcgagaccggcctgaccaatatgatgaaaccccgtctctactaaaaatacaaaaattagccaggcatggtggctcgtctctgtagtcccagctatttgggaggcagagacaggagaatcgcttgaaccccggaggcgaaggttgcagtgagacaagatcatgtcgttgcactccagcctgggcaacaagagcgcaactccgtctcaaaaaaaaaaaaaaaaaaagggcctgtgcgaagcttcctactatggcttccagcgggatctggatgagcgctgcctgcttggctaatgaaactcccgaaatactggacaatgtgggagattagcctcagggcgtctaccgctttgccactgataggagtgacttttggaggaacttgatcctcgatttgggactttttgctgcgggaatttggcttgccag

SEQ ID NO: 390 - DNA, 753 bp, Homo sapiens
tagctttctccataaaaaggcagagcctactatgcatcaaaggacacaatcaacagagttccttccacacaatgggagaaattatttgcaaatcatgtataataacaaaggatgaatatggtaaaactcatcaacaaataacccagtttttaaaatgggcaaaaagtttattgtgatggctcatgcctacaatcccagctctttgggaggccaaggtagacatagcacttgatatgagttcaagaccagactgggcaacatagcaagaatccatctttccaaaaaatgaaaaaattagccagatgtggtggtgagtgctatagtcccagctacaggctgaggcaggaagatcgcttgagcccgggagactgaagctgcaatgagccgtgagcacaccactgcaccccagcctagacgacaaagcaaggccctgtctcaaaaaaaaaaaaaaaagtgtcgggggcaggttggtggctcacgcctctaatcccagcactttgggaggctgaggtgggaggagcgcttgagctcaggagttcaagaccagcctggccaacatagtgaaagccccatctctataaaaatacaaagaaaattagctgggtgtggtggcgtgtgcctgtggtcccaactacccaagaggctgaagtggaagttgcattgagccaatatcacaccactgaactctagcctgggcaacaagagcgagaccttgactcacaaaaaatataaataaggaatggaaatgaaaaa

SEQ ID NO: 391 - DNA, 738 bp, Homo sapiens
cgcggaattctagagagctggttatacacactgtggcctcgttttttccttctttctttcctttcttctctattatcctattcctttacttttaatctttgccctgcttcagttgtctctgaatacagcaaccagattaatgttattaaaatacagatcagtcatcttactcatccgttcaaaatcccacagtgactataattttactgggagcaaaagacaaagtttttataatgacctgcaagtctggaagacctgccttggaacacctgtccattacctctctgagctcaactcttaccagccgtcccatagtctctgagctgcagccatgctagccctgctggtccccaaactctgaagctgcacccctgccccagggttgcacataccactccctctgcctggatccccagaaagcctcatggcccctcacagccttcagatctttgtttaaatgccactttttaatgaagtcttccctgacccagccttggtagaatagcaactcttctctctttctctttatcacatttcacctttctttttctttaaaataagcattgcctctgtgcatgtaatatatttacttgcttattgggattttatagttactaagagacacattccctgaaggcggaggacttctttactttgccgttcccagtgcctacaacagttgcttggcacaaggagaaaaactcaaactgtggaataaattaaataatgaaaaagatt

SEQ ID NO: 392 - DNA, 805 bp, Homo sapiens
aattaaattttgttttgattgattagaccttctggaccaattataacttgtttttattttgttttatcttgtattgacacacacacacaatttgcttattacacaaataatatataaaatacttactcaaaaataattataaaggttaggcccactcttctatttatctgttgataaacagaaaatatttaacacaaagcaatagtttttccctgtatcaaaagtaggcaggaatagtgcttggggtttctgagaagttaatagagaactttgaaaaaaaaatcagtacaaatgctatttgtggggaggttagaaagatttacacagttgcaaataattgtgtaagaagcctggcaacatagtgagatgatgaagaacaaaagtatcccagacccaaacatagcttaaggactaaattttcaaagtcaagcattttggtccaaccccggccccaccactttctaactctttgaacttggccatatcatctcaagtctttgagactcatttccattttctgtaaactgtggatgataatcataaaattgaattaattcttatatggaatattggctccaatgtgaccatatagtgcaaaagttgcaaattgtcaaggtaacccctggaaagcacttgtcatattcctctgagatcaccaagacctgaatccctaaacactcacaatagaaagaattactctttcttatttctctttgcatgggctgtctccaaattctctgttacaacacaagacaagatccaattttttagagggtgtcaggggatcagaaaagaaatctatttt

SEQ ID NO: 393 - DNA, 721 bp, Homo sapiens
ccgcggaattcacaattttaaaatccaggaggctttcctttgacatatcacctcttctccaatgccatgaatgctaggtgagttgacctcacaaatgtgaaaaagagtgaagagtaagaagaaataccaaggaaaaatcagttaatgtttcaaaacatgaattccccacagatccatttttaatgtcatgcttttatctggatcagaaatacaagtaacaggcataggtggaaaggcattgttataatcgcttcctcccagtggaaggaagaaaacctcccagcagttctcttccagtttgcagtggacatccatgtactcggggcacttagaatgagattggagtctcctctgacccatccactccttttaagctgggactcagtttttgccttgataaaatgtgatggctgaagaacatgatttttaaataacaggtgctggtgagattggagagacagaagaacacttaaacactgttggtgggagtgtaaattacctcaaccattgtggaaaccggtgtggcaattcctcaaaaacctaaaaacagaactaccattctacccagcagtcccattcctgagtttatacccaaaggaatataagttattctaatcttaaagacacacaacatgctaatgttcgttgcagcactactcacaatagcaaagacatggaatcaaccgagatgcccatcggtggtagactagataaagaaatg

SEQ ID NO: 394 - DNA, 777 bp, Homo sapiens
cgcggaattcatttaatcctcacaacggctatctgcattacatcctcttattattttcattttgcagttggggaaacaggggcacagggaagccttgtgtaacttgcaaagaccacacagatgataagcagcagactcaaggttcagtcccaggcagcatggcttcagcgtccaccatcaatcactcctcagtaacacctcactcttgtgttccactggctccctggaacatagagagaatgccagggaaagggatggtgtcctagtctatttgcattgctctaatacaataccatgaactgggtggcttataggcaacagaattctattgctcatagttctggaggctgaaagtctaagatcaaattacctgcagattgagtgtctggtaacaacccacttccttgttcatggatgtctgtcttggctttcacatagtggaagaagaaatgcagctctctggggtctcttttataagagacccactaatcccattcacgagggctataccctatgacaaattcccaaggtgtccacctccaaataccatcacattgggaattaggtttcaacatatgaattttacagggacagaagcattaagtttatagcatttggacatcttagataatttgagacttatgaactttcaacaaaaataagtggacttaaaaaaaacttcaattttttgtttcaccaaaattgagaacttgaaatatctttttctttacgtgcaaattttttggtgaacttgaggagaaaaacaacttgtactgc

SEQ ID NO: 395 - DNA, 762 bp, Homo sapiens
atccaacccctcacagccatccaagatgctgggacaaacgtcttctaaaaccctgttaatattgatatttgacttcctcccatgaatcacaaatgttcttaatggaatctagaatggtgaatcctttccagaaggttttccatttactttgcttagattcctcaggggaattactatctatggcagctacagccatacaaagtgtctttcttaaataataagactcaaaagtcaaaatgactccttgatccacgggctgtggaacagatgttgtgttagcaatggatgttgtgttagcaatggatgttacgttagcaggtatgtaaacagcattcatccccctgcacatatccatcagaactcttgggtgattaagtgcattgtcagtgagcagtcatattttgagaagaatagtttttctgagcgctgggtctcaacagtgggcctaaaatatttagtaagccgtcctataaacaaatgtgctgttacaggctttgtggttccatttatcgacacagacagagcagattgagcataattcttaagggtcctgggatttaggggttgatatatgagcaactgaaagtcaccagctgcattagctcctaaggagagagttagcctgctctttgaagctttaaagccaggcattggcttcttccttctagctactaaagtgcttaatggtcgaagcactttggggggcccaagcaagtgaatcactttgttgtcaagaggttacaaccagccttgtcaacatgg

SEQ ID NO: 396 - DNA, 708 bp, Homo sapiens
  misc_feature (1)...(708): n = A,T,C or G
cgcggaattcatgaaagaaccaattatacatgatctataagaaacccatttataataatgacatagataggctaaaagtaaaaggctagcagaaaatataccttgcaagtacagagcaaaggaaagatgagttaaattaatatcagaaagagtagactttagaacaaggaaaattatcaggattatagaaggtcagtacattaggataaaatggtcatttcaccaaggagatataacagaaataaatgtgtgcatctattagcagagctacaaaatacatgaagaaaaatgaatagaattgaaagaggaaatatacaagtccacaactacacttgaagacatcagtactcctttgtcagtaatttatggaatgagtgggctgaaaattaactaggatatataaaacctataaaacattataaatcacctaggcctaattgacattcatggaaccttaacacctgttaaatcctggttaatttaattaatttctgtgagcctcattttcttctataaaatcagaaaatttagacaacctactgcangcttttatcataaagattagggataatgcctataatgtacctgggatatgatatttattattcacccattctttcattcaactagtaattgaatgccatctgagtaccaagcacagagacagacattaacaatacaacagtacatatggtaaaaattgtgctt

SEQ ID NO: 397 - DNA, 983 bp, Homo sapiens
cgcggaattccactatgtcttgaatcccacttttttctctgaaggtacataaactacttaaaatatctgggacaaacccatgaaagaaagttgaatgagattcttagggacctgccaatcttctccctgtgcttgtgcccccacacatacgtggttccctctgcctgaaatgctctttgttcattcttaacctggttgccagtttctaattcttcacattttaatttgatattgacttgttcagtcgaagaattcctagcctgaatcaaagctaactcatctcttacatctttcttacagtaccttggatggtcctaccataccttagccccatgtgtaattatgtgtttattttgtgattatagccccatgtgtaattatgtgtaattatgtgtttagtatctgactcttgcattgggccaaaagaactaagagagggccgggggcggtggctcacacctgtaatcccagcactttgggaggccgaagcgggtggatcactaggtcaggagatcgtagaccatcctggctaacacggtgaaaccccgtctctactaaaaatacaaaaaattagcctggcgttggtggtggccgcctgatgtcccagctacttttgaagcttaggcgggaagaatgtcttaacctttgaaggcggaactttgcattaagcaaagatttcattaatttactttatccttggctacgaaacaataactccttctcatttcttgtaaattagtatttgctatttattttcttattaaaggtatggacttgtgtatgtgtacgtatttccttgggaaaaaatacagtgctttttggttggtcactttgggaaattttaacaaaattggttctttgatatatttcatctctcctagggaaaaaagtgtgtgtctatacttaaaattccttttgttaattaacaacgtaagttgatacagtatcctgtctatatgcctttttgactaatactttcttta

SEQ ID NO: 398 - DNA, 855 bp, Homo sapiens
cgcggaattccttcaccatttacccacattttcattctagcattctcgaatggagcataatcaaagtgaatgtacgcatgtccagtaaccaggcaacctgaggggtggagaaggattgggactgccagtggtctgggtaaggaagttgctgtgctgctttgtcttgtctgtgtttggggtttcccccgctatagggagcagctgtctgaatctggattttggtctggtctggcgtccatgctggacagctcacatggccaagttcagcccctttcattatttctttctgacccagtagagagacggctgaccattctttgctggcccctgctgtaagtcctgggggccctacctgggacttcccatcactggtcttttataagctggtcatctttgaatgaaaagggctccccagtgatgtgagacacacctgcctggtgggctgccctctccgtgtgcccactctcattcctagtcaaacacagcagtgggttcagccaaaatctctgtgccagctgatgctcttcaagtgcaagtttctggaaacccttcttcaacttggtttcaacaaaacagaagagttcactgatgaacagaactacaaagcccaagagtagaactgactgactaaactcaggggccggaataacgaatccagcctctttttccttctcttgggctttggtaaatgttaaaatttcattttaagatttcactaaccatcttaggtttttatatctatattcttagggatcccggagaaaaaaatgtagaatcttctttttggaaattctttaggaattccaaaaatttatacttaataatcaacttccaccttttttgaaaattcataat

SEQ ID NO: 399 - DNA, 809 bp, Homo sapiens
gctctcaaccctatagctttaaatcctagaagaggcatgggctcttctacaattcctaaaagattcttttaacatcctgcacatgaagcttttccaccatgaggtcccatgcccatctctgcctaggcagatgcaatgctctggtcggctgagtagaagccataggctctcttctgtacctggagaggggggtcagccccacccataccatgtggactgagagcagagctgtcattagaagtatgtggcaaccaacacatgcaccctgcagtaactgatgtgcctagtgccacagtttcacaatacatatatatacttcaagtgtagagtagattcactcctagtgcctggatccaggctgaaagcctttgtctctgggtgctcagggactgtttgctgaatatgaatgggtctaaccagagagactcttgagagttctgtgggaagattacaggggtgatattttatatgactctggacagatgccttggaaggaaagtatctcaatgatgctgtccattggaggttgtgcttgcaattaaaaatatggtctatggtctaaatgactcatttgcaatttttaagcaatttctaaaatgtgatctttgaaagaaaataaaaggctttagtggaaagtctgttgccaagttctctaccaacatcaatttgaattctcaaaaaccaatgtattttaattaaaccccgtggtagggagacaagccttttcgccatggcaataggaaagtgtcctggtcagattggctgggaaaaattattggaggacattaaaattaaatttaatttaaatg

SEQ ID NO: 400 - DNA, 926 bp, Homo sapiens
aattctcgttattggctttctaacaaaactcaaggtgaggagaattggcaccatgtgaaatcctgcagggtggggaggctggagagttaaagccccttcctgtgccagatcaaaggctaacgtccaggacaactgagacttggccttcgatggtcaacccgtgtcggtgccgccttcatgtgtgaaagctcatcacggactctaaagcatcaaggctttctcctagagggagcccagcctgacagccccgtctacggcttttatttgcagtaaagtccctggggacctttttcaaactgcatatttgatatttgcatgaaaagcaaagtggctgctccagaagacatgctttgccctgtgcctccaggaccctgagatgcatttggttgtcttagaggaaatagcacttggccccatcaactcaccatgtggtttcatcttttccttctaatcggtccttcccttttccctttgtagaaaaaagaaagtgcttccgtggaaaaccatgcattgtttagagcagtagtcagcacccactttccagaaagaaccagggagtaaacactccaggctttggagatggcacagtcttgtacacagctccccaactctgcttcgtgtgtgaaggcagccagagacaatgaatacacaaatgagcatggctggtgtccaataaacctttatgtgcaaaacctggagaggcttgattgtggctggtgcccttagtttgccaacttttggtttagaaagatcatcctgatatttgattctgatgcaacttgcctttgagctgttttataattttgaaattggagataactgaaaatgattcccaaatttttatttcatttttttgggaataaaaaaataaatttttttcagtgggaaattcaattaaactttttttttccctattggacaaaatc

SEQ ID NO: 401 - DNA, 716 bp, Homo sapiens
cgcggaattcaaaatatttctcctgtagacaacatagttggatcttccattttaatccagtctgttaatctgcctatttgttgaattgttaaattagttaacatgaatgttattattgctatgtttgaatttacattttctactttactctgtttcctgtatgtctcatatcacttaaattttctagtgtaacattttaatttctttaatgatatcttcactatttttgagttattttcttaatagttgttaagaggtttaccatatatcttatcagataaacttcagattttataacttaagtccagtgagatacagaagcattaattttatataacttcttcctattacccgtttgtgctatatttgttatagatattacatgtctatatgttataaagacaataatgcattattataattagactttatataatgttatgtctcagaagcatagagaagaggtagagcaagtacatatttatatagtttgtttattaacttcctcaggtaccatttctggcttgctcattttatttgattctgtgaatcaaagtttccatttgatgtcattttcttagtctcatacagttttgctcccacctacattctttttgctgttattgttaaatatattacaattattcatgttattggccccaacaatataattgtatacatacttgtttatattattggatttaaaagcagttaag

SEQ ID NO: 402 - DNA, 953 bp, Homo sapiens
  misc_feature (1)...(953): n = A,T,C or G
cgcggaattctttctcgtacaagatccaagaaccctctcttggggtctggattgggacccctttcctgtaacacaacaaagctctatatttctactatttggccctcctggtagtcttttggaagacaggacacagcagcagacaaaatattaaagtcccggccctcatgagcttgcattccagtaggggaagccaaacaacaaacaaaataaataaataagcagcgctgatgttcgctgatgacaaggactgaaaacccaggcaacaaagggaaggaacaggagctgaagctacacttttagagagggttgcaggaggtccccctgcaaaggggcacatgagcaaaatgttgatgaagttgagggagccaggcaggaactgagcaaacagggagagtgagcagagactgggtgtgcaaaggccctgtggcccgagagaaccccagcaggcagtatgggctgagagaagagcataggggaatgcggcaggagatgggctgggaggactaacaggggttcccggtggcatactgtctttaaagcttgctttaaaatgcttgggcctttcctgtatttgagacngggaagtgattggaaagcttgttggggggttgttttattttactttttgtacgtattaattgtcttattcatattgtatcattattctctatctttttgaaattagatttttactttatgctttatgtactacgttttcgtttaatatttctgtcttatgttcttttttgtatataagtttataagagtttatttttccttactctctatcacatgtttttatcttttatttcaatttttatattatcttcttaaattcgttatattgcaatctttaactgttactgtatacatttatatacggtgttattcgtctcacttattggtcgatattcctccttttctatcttatgttttcattgttgattgtt

SEQ ID NO: 403 - DNA, 672 bp, Homo sapiens
agtctccgggcaagttcagttccccaaagcctctcttcgtgcctttggtgtgccttcctctaagctgctgcaccaaccttgagaaaggactacctgacagtcagtctgccgctttgtggaatgggctggcagtgcttgtcttggatgtgagataaaaaacataaaacagttacctaaaaacagtgagcagaaaacatgctctgtatttcataccttgtggagagacaagatgctttccaaccaatggatgttcctccaaggccagaagtgaaatttcttcttcaagggcatctgggcataccttacaccttcatgcccaccctcctttgctaaatcaaggatggtcatcattgtaataacagcaaacatttccagagtgatgactatgtgtcaggaaccggagcgattaattaaccctttcactaagcccaggaggaccttcttatcatcttcgctactttaggaagggagaaacgaagacccagaaagtttaagtaggtaaagtgcccaagattgactggaccttttcggagctagactggattcaagcatgtttgtttggtcccagaggtggcagtcataaccactgcgctaccttgcttcaaatctggcttccctgacactcaaaccaaatggacgttgcttccggctgtaaagcaaaacagcggggac

SEQ ID NO: 404 - DNA, 701 bp, Homo sapiens
cgcggaattccagtcatgggctgcagagggagatgtaactagaactgagaaatcgatgacttaagaaaaagaagggaaaagaaagcttgtaaatgagaataagagagctaatgaggaataatgttaattttcagtcagtaaaagacttaacattgttccaaggccattggctgagaggccagaaaggctcaacattgctttccagatgtgacccgttcctgaggttagcatcaatcacacttaattcccctggacatgtgaagcaatggaaacaatggttctcaaactataaaatgagattcctacgccccattcccagggcctgagaaatactgatttaaaagaataacttgctctaaatgtctggcataggaaaaactgtatgaacactctgatgctctttatggataaaatctgtcttctatttaataaagatgactaaacaagttttttttttttctgtttttgagatggagtctcactttgtcacccaggctagagtgcagtggcacgatctcagctcactgcaacctacgcctcctgagttcaagtgattctcctgcctcagcctcccaagcagctgtgattacaggcgcacaccaccatgcctggctaatttttgtatttttagtagagatggggtttcaccatgttggccaggctggtcttgagctcctgatctcaagtgatccacctgcctc

SEQ ID NO: 405 - DNA, 719 bp, Homo sapiens
atcaaacaacttgtcaaaatataagaaaactgaaagaaataacaacagagcagcacatagtgtagatatttgaggtttttttcccattctccataactgagcagtttgctcaaagtgctcctatatctttttctcagttctggaagccaataaatcccaaaataacaccattacagtaaaacaagctgcatagcccaaagatggatttactggaatgatgtcaaaggattgtttccatggtattgattgcttactttagaactttcctagacctgagatgtcgaaaggttattattttggcttgaggagagtcttgaaaggatattctaggggaaaagagcatggcctgacagctgcttacttctgggaggattctggggctgccttcaggacaaaggaggggcaacttgagatatattttgagcagctagaagccaaaggtgtctccaagagaagtaacaatttagctgctatgtcaaataaataagctagtcctggggtttaaatcaaaatttgaattgaaaaattgtgtaattattcaaggttagattgttgtatattgctaagtgttgtacatgctttgggtttatttaggatggcccagttcagaaaggatgtcccaatttaccctattacctgatcatctgcttatggcacaaatttctttcattttctctgaaatctggaacctcccttcatcatcacaggtataggttttt

SEQ ID NO: 406 - DNA, 755 bp, Homo sapiens
cgcggaattcaccggacctgggctaagcagggataggaagtctccatggaggaggtggcatttgaccaggatggggcatgagagtaaagagaggagaggcatccatggagagtggatggtaggaactggaacaggatggtgaggaagtgctgctttgtcgggtgtctatacctcttattctgcctaggacagtgggatatatgccagttgtcctaagactatatcaatgggccctgtttactctgcatggtgtcctggtttggttggtagattacatgatcactctgcttacggaacttgaaagaacccaagttctttcttgatagcctaaccatgtagtcacaagcgctcgggtcctcagccctatccaggtatccaggaaaggatagacacacacacacacacacacacacacacacacacacacacacacacacacacacacacacagagagattgattcttaacttgggccaggagtgagctcattttggaaatgttgagggaaatctgccttccagagcagagtgggacatgagggacatgttttccgtagaaaggatgattcagttgtgagttgtgtgcttgccagagtgtgcctttttgagctaattactgtctgccgataaattactgggattaaaaacaagaacaaaatgaacttatttcaagacacatgttagaaacaaacaattatcattttggaaaggtcattagtgcgagcgatttaaaaaatcttttttttaaacttttag

SEQ ID NO: 407 - DNA, 689 bp, Homo sapiens
acactgcgtcctcagcatctagtatcatgcttggcatgtaggagatgctgcatatacaaatgtggaaagataaaaggaaagaacaggacatgataaagcaaatagaaaggtagaaacacaaacgtgttaatcaggagctgtatgtggaaccctgtggcagattaaatacagcctttaaaacaaagatggccatggatcttacaattgcccccaaagtcatggcagccttgtttgatgtttcctccttttacttttatctgtatctttttaaacaaatcttgtctattgaggaacagcacattgacaaagaaaggaataaacagaagattctcattagcacaagacaggtttagtctttctgcaactcttatttccctatttcatacctatcgatatattctataaaatgcaatcatcagtcccaaataatacaattcctcatgttcccagacactggacattctgcaaagtagagatagaataaactccaattttgccaaaccctagggaaggtaatccactaccatttttaacttgatctgccaaatgagatcccaacaacttacttaaaaacatgttatccccaaataatcatttatgtgggtctttgaaccaaaagagatcccaaaaacttacttaaaaatatgttatcccccaataaacatttatttggttcattttagcttaga

SEQ ID NO: 408 - DNA, 885 bp, Homo sapiens
cgcggaattctaggaaaggaatctattttatatccaaaatcaaacacttgctttattcctcaggccaaggttccatatatgaaatatgacaaaatacaactggttcaaatatcatgctaagtgaaatacaccattcacaaaagacaaatactgtagaattcttcttataccaggtacctgcaatggtcaaatccatagagacaaaaaggagaatggtgcttgctgggggcaggggaaataggaatagcgtttggttttgccaaaaggtgaaaatagttctgaagatcaattgcacaacagtgcgaatgtgctgcacacctaccaatgattaagagcgtaaatttttatgttatgtatattttaccaccatttaagagattccacaaagtttagtagcttaaaagacaaaaccaaccaaccaaatatgaaaacactaactgatttagacaataaatctgaagtcactagatgcttttagcagggattgtttcatgtagagaattaaaggttgactcagcaaaggaaggactgagcctgcaaagtcagaaaggctgctataaatcttgcaaattatgttggcacccaagtggctgatgcccaggaggaagttaggaaactggcaccgcttcgtgctcaccattcaccaaggcccacaatgcgtttctgcaccttgcacttgaagaccaatgcctttcctgctttttacctttgaaaacctcatgcacctgaattttcactttggaaacaaaaaataggacttctactagtcagggcagcctagaataatccttagaaaagagtttttagaaacccaagaggtcaacatttaaagccttaaataaaacaaatcaggtgccaaatcttcaactggaaattatttttttt

SEQ ID NO: 409 - DNA, 630 bp, Homo sapiens
taaacaccgttcttattcatccagagaaaatcttaagcagcctgagcaaaaatcttattttcttcttatacttcagtgcgcctttttaactagtgacataaattaaactgagatttccctctctggaggactgcttggatttttgttttgttttgttttgttgcaattttggtcttcaacagaagaaaattcagtctcccatggtgattaacggtgagatggttaacgctctccaaacccacagtaccttccgaccagcttttccatgtttattctgtttgggtttttcttcgggctgtgatatacccttgaggactgaggaagaaactggtacttaaacacagtcaccctagaaaggtctagaataagatgaggtggagcctctactctccattgtttcatgccaagagtcagaaatgagtagctcatagaggtcatctgatgtcatttcttttttcctttttgctgatgcttcagagatctcacaggggattggactggctgctggttctacggggaagtcaaagagaactaagaaatccctcttggtgagaaatcattgtagaaaataaagctatcaacttgaatttacaatcacattatctggccaagcgtgttggcttacatctt

SEQ ID NO: 410 - DNA, 730 bp, Homo sapiens
cgcggaattcaaacttggaagccttttaaaaaaatttcaactcatgaaatataccgatttctaaagcttaagtaagttagattttaaataaatgaactcatcaaaatgcaataaaaattaaatgagctaaattaatttaacttagaaataaatgtttttaatggagttactgaaagggatatgatccaacacatttgcacttatttatttctgttatgtaaatcaaaagtattaagtgacaagcttaatgttccgtctcagactatttttgtttcaatggaaaactgatttaatcagaaaactttctcatctaacaacacagaataagtcacaggagactgttctagataattaaagtttaaatttagcttttggatttgagaaatgtctggtttaatcattttaatttacagtaaatatgagaatattgtgagactggattttattttctcctcttctgtgtgcatgggggctccgtggctttgtgggttacttggattacatgaggaacattaaggatcaataacttgtaacacatagaacattattttgaattgggcattttgctaagggcttcatatgaccaaccattcagtcctttgtgcacccattttacagttgagtaaacagaggcgctgaaaggtgaagttactacctcatgggctcaaagctaggaagcttctttttttccatctctgagctctgttattctgtgtgccagcttcttcct

SEQ ID NO: 411 - DNA, 762 bp, Homo sapiens
agaccaaagccttgcctcaaaaagagacgggattgattaatcatgtccgctgcaggtttaggataggtaagcaaggatgtacttactatgtgtttagactagcaatgaatttataacaccattataaggcaatagtgattaaacatctttactggtgctaacaataatggaagtcatataaagctaataacgagtctttccttctatcataaaattctcatcaccccgaatctaatatgggatgcttaatactaccaatatcaccagatcccagagatgcgaccacctgtggggtaaagggtgaattttgaagaagtgaataacatatctcttattatctctgtataaataacactgaagacaatattaaaaatgcaactgcacatgtattcatatatgcaaatcatgtttccagcaaataaattgggaaattaaacttgtcagctcaaccctaagctaaaacttacatgattaattcttacttcgttttcttataagtaacatacagactatcaaagatttggatcttataggttactatgaaaattgcctaatgaaaacaatacttataaatttacatttttgaggtcacttttgcatgatagataagcaattcagttacttaatttacatgcgcttttacacagaataatttaattttctctcatctacatgaatgctttttcatcctttcaaaattatctttttaataaagcattattgccttataattgacatataataaaattgcatatatttaaa

SEQ ID NO: 412 - DNA, 677 bp, Homo sapiens
  misc_feature (1)...(677): n = A,T,C or G
cctactcactatanggagaggatccgcggaattctcaggaagtggttaaagtcctaactcatgaaataattcctagatttgggcttccccaaagcttacagagtgacaatggtccattttttaaagccacgataactcagggaaattccagggcactagggatacaatatcaccttcactacacctggaggccacaatcctcagggaaggtcaagaaagcaaatgaaatactcaagaggcacttaaggaaactaacacaagaagctcatctcccatggcttactctcttgtccatggccttgctgagaatttgaaattctcctcacaaaatggggttcagtccatatgaaatgctatatggacgactttttctcacaaattacttcttacttgatcaggaaatggccaacttggtcaaagatatcatttctttggcaaaataccaacaaaaccttaaaaacctacccgaaggatgtcaaatacaaaatggtattttctccaatgggaaaaatagaacacagggagacactcagtttgctcctaacacccctttccagccgctcaccgcagctaccttggcaagtactctaagagtatgggaaaatgaaaacaacaaattcacacacttttttttaacatacacaacaaccatttctgtctacctagccaaagtatat

SEQ ID NO: 413 - DNA, 757 bp, Homo sapiens
cagggacgaaaagaaaataatggtgatagttattttaagtctttcttgatttctgtgtgtatcagccaaatattgagctagagagaatcacaaccagtcaatggacatttttcattgtctgttgacaaattctgacctggccatcccatcttcaggcacctgtgcaaacacagaaaattaaaaactcgtgttttttattcactcatgtgcagaagcctgaaaatgttgatctcacagaagtaaaacatagaagacaggatactagaggctgggagaggttgaagaaagggagggatttgttaaaagatagcaaattacagctaggtagaggaataaacaagttctagtgttctgtgacactgtaggatgactgcagttaacaataacatattattagttccaatagctagaaggagtatattaaatgtttccaacacaaagaaacgataaatactttaggtgatgaacatgctaattactctgatccgatcattatccattctatctattgaaacaccaccatgtaccccatgaatatgtacaattattatttgtcaattaaaaaataaaattaggctgggcgtaccggctcacgcttgtaatcccagcactttgggaggctgaagcagggggatcacttgaggtcaaggcattaagaacagcctggcaacatggggaaaccccatctttactaaaaataccaaaaaaattagctgggccttgctggtaggcaccttgtattgcagcttaccttggg

SEQ ID NO: 414 - DNA, 585 bp, Homo sapiens
cgcggaattccatacctacacaaattaaagtatgacaggaaaacaaaaacattcccatatattctaggtctttaggagagccagtaatgacataaaccacatagattaggaagcgagtcaagaagaaggaagactaacacataaaagaagcaaacagaatccttgggatgttgctaaaggaagatcaaagatgggagctgctcactaggtgtagacagcaacttgcccatgctggagtaggtcaaaagactctaggagagatgaccatcaaaaaaacaaaattggtgaaatatattgataggaggtttagacaactagtggagaatatggggttgttaatgatgagttttttaaaaatataaaataaaataaagtaccaggacaattactgatatagtttggatatttgtccccacccattatgttgaaaggtaatgcccagtgctggaggtgtgtcctggtgggaagtgtttggatcttttcagcagattctttatgaatggcttgggtcatccatttggtgattaaagatctctggcttcttatttacacaagatttggtcatttaaaagtgttgaggatctg

SEQ ID NO: 415 - DNA, 339 bp, Homo sapiens
cgcggaattctttcttgtgtgagatccaagaaccttctcttggggtctgaaataggacccctttccggtaacagaaatacatatgaccctctcaatgggtggaataagaacattcagtaggattcaacactcattcttgatgatacaaaagaagtaataaaagtaagaagaaagaaaggaacaaaggaaggaaggagggatggggaggcgactactcatcaacgctaggatcaggtcgaaatactcttctgtagatgaccctcaatagcacggactcggtgttatatattgatatgaggtttagacacctcgttggagaatatggcgctgtttattctg

SEQ ID NO: 416 - DNA, 802 bp, Homo sapiens
tcccggtgtttcatcagcacaattttggagcaggtggcagaaacccaactcaactggcttaatccaaatggagaatgaattagattgaccatgtagcttcaggcacagttggttccaggtgcctgaacatttttagcctagccatttgtctctttgtctcagctctgctttttctgtctgtggattttttttctcaggcatagtttcccaaaggtagttcctggcatccaagcaatttctcatccccagtaaaaagtctgcctctttaccaagagttccagcaaaaatcccaggattcctcctaacggtattgtcatcccatttctgaagcagccaccctgactgtgactggccaggaatggtgtgtgcctgcctcccgcataacctcagatccaacaggagccaaaataattggagtggggatggggggaattgtttccttttttttcttattttttttttacattttttattcttttttatattattttacttttttttttttcaatttttttttttcttctattattcttctcgttctttttcttttttttttatactttttttcttctcacatttcatagttttctttttgcttgtttttcttttttatttttcttcgttcttttattttttctttcttctttattattctttttttatattcatttctctatttgtttttaattttgttttctttttttattatttctcttttgtcccgctttttatcttttatttattctttctttttactcttcttattctattttattttgttttttttttttctttcatagtt

SEQ ID NO: 417 - DNA, 725 bp, Homo sapiens
cgcggaattcagtgactctggccacctcctacgagtggaatcgcacagtgtttgtccttttgtggctggcttctgtcactcagcataatgtcaggagctgtgttccatgtagtctggggttgttggttcattcttagccatgaagcaaaacggatgaagacccaggaccccaaccccgtccgcatcctttagaaaccccaggtcccaccgcctctccaggtgctgtccaggagctcagccccagctcagccacccagctccctgagccccactctggcatggcctccctctctcctgccgtcacagcccaggggcacggggttaagtggtttgcccaggttacacagctggtgccagcgtctccctccccactgcccagacaccagcctcctctctgactcctcacttccctctgcagagaagattgctgttgggaaggccagatggaggagatgggtctaatggaaaacacgtccctcctggggcgcccggaacttaatgaggaagaggcggcagaaccaggcgtaatgtttgtgaagtacgcaagtggggagggccgctccccgtgcagggcttttcgggtggagccacaggaacctggagtgcatggagggttcgtcctgctgggggttatctccctctctttcttttaaaattaaatggaaaccaaaaaaaaaaggaaggggaggaggaaagtattttttactttcttttctctgctccgg

SEQ ID NO: 418 - DNA, 964 bp, Homo sapiens
cacgttcccctgggatcggtcttgcgctggagctcaggtggagtccgttgaaatcgtcagctctgcgtggcctgccagactcttcctgtcccgaaccgttcctcactcccctttcacaggcattaccctgcaaaacctcttaccctcctaactccatctcagcccgtttcctggagaacccggagaacacgcccgcctctgagagcctgcaatttgtggacctcctgcagtggctctaccacacaaatggttgtcgcctttgctgatgatgctggaggcccagcctgcctgctggtcatgcaggggcccagggaagcccaaccaggcacaaggcggaaggagagggcaagggcaaccaatctaaggcccccaagtgcacctgcttttcccttaaagcagctcgtctgtcctaggggaacccaaaagacctggagacaggcagaaagaggcatcggttctgtctgatcctagcccttggggacttccatccctgaaacagagactggctgctgtcctcaactgcccagccttcacgtgctgctggctatagcgcctttccccatctccccccagcccaggcacaccagatgtgcaagattcaatgtgccatgcaagaccccggtgatgccctcagaggggcaactgttacccaccaggccctgtggaggggaaactgacaaaggatgggcctcgtcgctggaaaaagaacaggtcacttcacttccctaagcatctgcaaaatgaagcggaaggtttctccctcccagacctaaaatcaaatttcgggagccccccttccttgcccctgtacacggggcttttttccctgcaagtccactgaaccttgacacttggtcccatctctttcttgcccgtaagggtaatgaaaaacccggggccttgcgttacaccccacacttgggcctgggcccttcttggaacctttacgggtattaaaatctga

SEQ ID NO: 419 - DNA, 709 bp, Homo sapiens
cgcggaattcagtgactctggccacctcctacgagtggaatcgcacagtgtttgtccttttgtggctggcttctgtcactcagcataatgtcaggagctgtgttccatgtagtctggggttgttggttcattcttagccatgaagcaaaacggatgaagacccaggaccccaaccccgtccgcatcctttagaaaccccaggtcccaccgcctctccaggtgctgtccaggagctcagccccagctcagccacccagctccctgagccccactctggcatggcctccctctctcctgccgtcacagcccaggggcacggggttaagtggtttgcccaggttacacagctggtgccagcgtctccctccccactgcccagacagcagcctcctctctgactcctcactttcctctgcagagaagattgctgttgggaaggccagatggaggagatgggtctaatggaaaacacgttcctcctggggcgcccggaacttaatgaggaagaggctgcagaaccaggcgtaatgtttgtgaagtacccaagtggggagggcccctccccttgcagggcttctttggtggagccacaggaaacctgagtgcaaggagggttcctactgctgcggtttttttccctttctttccttttaatttaaattgaaacaaaaaaaaaagaggggagtgagaaatttttttttctttctat

SEQ ID NO: 420 - DNA, 877 bp, Homo sapiens
agctatccccacgcttagcatgactcagacgcacttctgaaggaagaacaaaaagagcatgccctgctttgcagattatcttgcgcccatgaggggcagaggacccacctcccaccccctttgtactccgaaagcttttaggggcctgggaagctggggccaccctgggaacccacccagcaagactcagcttttgcagggcaggcgtttcctggctgccaactgtctacatgtctggtgggtcttgggtggagtgggacacagactgggggtcttcactccacagtggctccaggaatgctattggggcagagctgacctcatggctctgccaagaggaaaggttctctgacctctgctctaagatgggggcaggcctcatcggccacactcatgccagtgctgtccccatgggcttggtgacataggatggcttataggttgtgaatggggctgttcaaatggtaaccttactcataaggttttaagacacttttgtaccatctagttgaaacttcaagtaagggtggtcttcctatttcttagtaatcattgtatttcacctctatgtgccctcaatttcatcaccatgccatggcgtcctttatctttccttgtggctcactggattatatgaattcactttctactcctttttcttttcctttcccttattctggtctcttgggtattgttacttttaacttatgtacctgtgaatcccacttagatggtctctagttttatggggatagttttaatttctttttcattctttttttactaagttctttttttttcatcttatcctttctctattattacatggttttgtttttttctatcttccttttatataattatttaccttttttcc

SEQ ID NO: 421 - DNA, 707 bp, Homo sapiens
  misc_feature (1)...(707): n = A,T,C or G
cgcggaattcantgactctggccacctcctacgagtggaatcgcacagtgtttgtccttttgtggcatggcttctgtcaagcagcataatgtcaggagctgtgttccatgtagtctggggttgttggttcattcttagccatgaagcaaaacggatgaagacccaggaccccaaccccgtccgcatcctttagaaaccccaggtcccaccgcctctccaggtgctgtccaggagctcagccccagctcagccacccagctccctgagccccactctggcatggcctccctctctcctgccgtcacagcccaggggcacggggttaagtggtttgcccaggttacacagctggtgccagcgtctccctccccactgcccagacaccagcctcctctctgactcctcacttccctctgcagagaagattgctgttgggaaggccagatggaggagatgggtctaatggaaaacacgtccctcctggggcgcccggaacttaatgaggaagaggcggcagaaccaggcgtaatgtttgtgaagtacgcaagtggggagggccgctccccgtgcagggcttctcgggtggagccacatgaacctggagtgcagggagggttcgtcctgctgtggtttatctcccttttttccttttaaaattaaatggaaacaaaaaaaaaaaagaggggaaggaggaattaattttgagt

SEQ ID NO: 422 - DNA, 705 bp, Homo sapiens
acaaacatggcggttcccctgggatcggtcttgcgctggagctcaggtggagtccgttgaaatcgtcagctctgcgtggcctgccagactcttcctgtcccaagccgttcctcactcccctttcacaggcattaccctgcaaaacctcttaccctcctaactccatctcagcccgtttcctggagaacccggagaacacgcccgcctctgagagcctgcaatttgtggacctcctgcagtggctctaccacacaaatggttgtcgcctttgctgatgatgctggaggcccagcctgcctgctggtcatgcaggggcccagggaagcccagccaggcacaaggcggaaggagagggcaagggcaaccaatctaaggcccccaagtgcacctgcttttcccttaaagcagctcgtctgtcctaggggaacccaaaagacctggagacaggcagaaagaggcatcggttctggctgatcctagcccttggggacttccatccctgaaacagagactggctgctggccttaactgcccagccttcacgtgctgcttgctatagcgcctttccccattttcccccagcccaggcacaccagatgtgccagattaaatgtgccctgcaagaccccggtgatccccttagaggggcaacttgcacccaccaggccctggggagggggaaactgacaaaggatgggccttgtt

SEQ ID NO: 423 - DNA, 603 bp, Homo sapiens
  misc_feature (1)...(603): n = A,T,C or G
cgcggaattccaagattcactattaatgaaaacagagcacagtgaagaatacttttgggtatatacactgtgtgggcatagaatatctctagaaggatacattaaaaagagataacaatgattgtgtccaaagaggagagtcaggccaggtgcagtggctcccacctgtaatcacagcactttgggaggcagaggtcggaggatcatttgggctcaggagttcgagaccagcctagacaacatgatgaaactctgtctctacaaaaaatttaaaaaattacctgggtgtggtgacatgcacccgtcatcccagctgtttgggaggctgagatgggaggatcgatgagtccaggaattcaaggctgcagtgagccatgatcatgcgactacacttcagcctgggtctcaacagagcgagaccctgtctcaaaatgaaagaaagaaacagagagcaagagagagagagagacagagaaagagaaagaaagaaagagacacacgagcttttgtattgttggatagtttttaccacatgcatatattatctttttaaattgtttgaggtgtgtatgtgtgtgaatttnttttttttatttttttttt

SEQ ID NO: 424 - DNA, 639 bp, Homo sapiens
ctaatgaacagagagttgctacctgattttgccccagagtgtcagcaggagggacctggggtgcatgcaggtcctcatccagcccacagcactggcttcttcaagtcttctttgggggcagatgggccaggaaatcaacatggtgttttctggtttacaaagagcagagtaatactctcacatttgggattagaagaaaaaagagcagaggaaagtgggagagagaaagctgaaagcatgaagctatttgctgagaatggataatgaattagggtggacgattggcattgcaacccccttggcatggggtatggccggccgctccccatctcctgtcgcccatctgtcttcatcagctgacagtaattggtgtcccctagcactgacttagggggatttgtggatgtagttcatctgatttgcagacacgactcttgaaaggatagagctctaaatcatttctgggcatgtgttaatttaagtcattcaaaatttcttatctttggggaaatgcgcttgcttctcctgatgaaacactacattccagcctctctgtaatgagctaatgggtttaagttaatctcaatcatgcaacatggctgatggagatggatctgggcaaatcaacggtgttctgag

SEQ ID NO: 425 - DNA, 788 bp, Homo sapiens
  misc_feature (1)...(788): n = A,T,C or G
cgcggaattcagttcccgtagtatgaattttggaactagataaagatgattctaacctgcatatagaagaataagcatgacagccagtgtgggtgaccaggtagcagggggtgcctgcctcagtcatgcacccagaaaacatggttcctcagcaaccttcaaccctggcccaaccctcgacatgaggccccgtggtccaggcttctgcatgtcatgtactgggacaccagctgtggctcacttgtgccccagagggggacttcctgtggcccagaaactaggaccctgctggcctgagcaaaccagcagacttctctgccattccaaaaggggcaaggacagccttctccaatgaggtctgagcccagcctggggaggggccttccagcttgtccttccttattttttctatcccagtcctagagtagcctatattttatagttaatctcttatcatcatcatcatttacattaaactttccttgtttaaatcactgtgcaatttgtgtctcccgattgtacccaaactagtacaacaggtaagtgtgttttgaaaacgaacaaggaatgactntacacaacaaaatttgtgtataatctatctatatgtatagattcaaattatatttgaataaaatactttcaaaagtcaaatgtgtgtgtgtgtgtgtgtggtaattaaanatttaggtgtttgttgtattgtttgttttatgtttttattattatttgttttgtattatatgtttattattgttattgtatttatattttattattttataatt

SEQ ID NO: 426 - DNA, 619 bp, Homo sapiens
cctcgaaattctctgcagtgcacgggatggctcccaccagagaaccacccagccccaaatgctgacggcatggaggccgagacacggtgagagcgatgcagggaagggggctggcagggagggccagggtagtcacagaggccgctctgaggagctgggctttgagctgagtccaaggcgtggagaggcagcatcctttccctgaggggccagagaaggagcattccaggaggaagggcaactgcctgcctcaggtaggagagctctggaccctgtgatcagaaaggggacgacaggcagagagacaccaggttccttgctttatatgaatttagcgaagtgcttggcatataggtaaatgttcaatattgttccatccagttcagtttcagatatctcagtggccagtgcaaatctagcctcacaatctcaatgtccctggatctattcagaagcagcgcgcctaagaccgacctgaagacggctgtttgaaaaccagcagggttattctattccaggattgtcataaaccagttaacctgctacctccaaatgtcccgtatttatatgtattttctaagggaggggaatccgcttttaaattgccaatttccgaatc

SEQ ID NO: 427 - DNA, 873 bp, Homo sapiens
cgcggaattccactgctatgaattcagcctccagatattaagctcaacaataatacacatggctccagcaaggctgctaaaagtagcacagtttgagaagcaacttacttgtgcattggtgaagaccaactctttttttttggagctctgtgtgtgtgtgtgtgtgtgtgtgtgtgtactcacatagaaagactggccaaaaaaaaaacgcatattggtgaacaaaagatgcttgcacaaaaacaaaagccataaacacacatttctatatgcacagagcatctgtgatagtacacaaaataataactgttgtcacctctgggaaagagacctggaagactacagatctgggatgggccaggtgcggtggctcacacctgtaatgccagcactttggaaggccaaggagggcagatcacctgaggccgggagtttgagatcagcctgggcaacacggcaaaattctgtctctatttttgtaaaaatacgaaaattagccaggtgtggtggggcacacctgtaatccgacctactccgaaggctgaggcatgagaatcacttgaacccgggaggcagaggttggagtgagctgagatcacgccaccgcacttaagccttggtgatagaacgaaactccgtcttaaaaaaaaaaaaaatttgggttgggaggtaaactacttttcacctctgtaacattttatattgtttgaattttttactacagacctttaagaacttttccaaaaccacatagaggacttttaaactcccccccacttaatgggggttcaccaggggtttaaggttttggaagatttttaaacagaatgtaaaatttttctcattttgtaaggaaaatatattctcttgcta

SEQ ID NO: 428 - DNA, 766 bp, Homo sapiens
ccaccaaacaaccgttggacattctcattctctcctttatgtctgttcacctgcccttcacagttttatttcttgatatgcctgtggttctatttggggtaacatgggtggctttgtctcccactgcagtaattctctccttgaacatgtctcatctgctgttcgaaccacccattgagtcactgatttcagtgactgtgtttttcatttctagaaattctacgtggctctttgcaccccttcctgctctgcttccattcgcttcttcttctttttttttttttttttgagacagagtcttgctctgtcaccccagctggagtgcagtggtgtgatcttggctcactgcaacctcttcctcccaggttcaagcaattctcctgcctcagcctcctgagtagctaggactacaggcacccaccaccatgctctgctaatttttgtattttttgtagagatggggtttcctcatgttggccaggctggtcttgaactcctgacctcaggtgatccgcccacctcggcctcccaaagtgctgggattacaggcataagccaccacatctggcccccatttgctgttattgagacaatttcaactccttttaatgtctctttaattttttaattaaatttttaattcctttttaattttatttcatagactatttttgttgggttcgtttatgtttatttcataaataacatttattatgaaaatttattttattatgaaattgttttatttttaaaatgtctatttttt

SEQ ID NO: 429 - DNA, 699 bp, Homo sapiens
cgcggaattcacaaaaggcattcaccaaaaggcatggcatggagagatctggatgtgggcagaacatcaactttgttcattacaaatacaaaccaaatattcacactggatgctgtaaaagtttcagctgtggccgggcatggtggctcacgcctgtaatcccagcactttgggaggccaagacagatgaatcacctgaggttgggagttcgagaccagcctggccaacatggtgaaaccccatctctactaaaaatacaaaaattagctgggtgtgatggtgcacacctgtaatcccagctactagggaggtctgaggcatgagaatcacttgaacccaggaggcggaggttgcagtgaaccaagattgtaccactgcactccagactgggtgacagagaaagactccgtctcaaaaaaaaaagaagaaagaaaagaaagaaagaaagaaaaagaaagaaagaaagaaagaaagaaagaaaaagaaagtttcagctgtggaaaatgttaaggggaggaagacagtgctaggacaagttgtaaggagggcacctgaggtggtcaaggaagtcagcaaaggccacgcagaggaaatatggcttgaccggagacttaggatgcatcagaaaggctaggaatctagatgaaataccaggcagagaaaagcacaggtgcaaagacttagaacaaaaaaggtga

SEQ ID NO: 430 - DNA, 763 bp, Homo sapiens
ttaacgctgcagtcagccatgatcatgcgactacacttcagcctgggtctcaacagagcgagaccctgtctcaaaatgaaagaaagaaacagagagcaagagagagagagagacagagaaagagaaagaaagaaagagacacacgagcttttgtattgttggatagtttttaccacatgcatatattatctttttaaattgtttgaggtgtgtatgtgtgtgagtgtgagcgtgcgtgtgtatgtagatacacaacaaatgggaccaggtctcttttctgattaaaacctgcaaagagctcaccgtattcagctcaactgtcagtggcatgagaatggggaccatttctatcctgcttagggaatcaactaatggctgagcgtgtctctgggataaatgcctcagcccagaacacagctcaccctgcatggcagaagtgcactccactccaaccaccctcccacagcaggacctctggcacatcacgcttccttcttgagtctccacgccgctgacatgacacttcctagtgccagctccttccagagaactctcctgacagccccagttcctacacaccacagtctctcaaaattcccattttgttttgagcctatctctgttataacccctctgcactgcatttatagggaagatggagtcacatcttacttggggcactgattacaaaatcagcacatacatgaaaatcaagtacacttaaaagtccccttgaatcggccaggcgcggtggctcacgctt

SEQ ID NO: 431 - DNA, 716 bp, Homo sapiens
cgcggaattcctaacttccgagggaacacctatcaaacgtcaggaagccattaggagattattattggctgtacagaaacctaaagaggtagcagtcttacactgctggggtcatcggaaaggaaagggaaatagaagggaaccaccacgcagatattgaagccaaaagagccgcaaggcgggaccttccattagaaatgcttgtagaaggacccctagtatggggtaatcccctccgggaaaccaagccctagtactcagcaggagaaatacaatggagaacctcaggaggacataatttcctcccctcaggatggctagccaccaaagaagggaaaatacttttgcctgcagctaaccaatggaaattacttaaaacccttcaccccaccttccacttaggcattgatagcacccatcagatggccaaatcattatttactggaccaggccttttcaaaactatcaagcagatagtcagggcctgtgaattgtgccaatgaagtaatcccctacattacaggccatacattttaatccctgtatctttaacctccttgttaagtttgtctcttccagaactgaagctgtaaaactacaaatcgttcttcaaatagagcctcaaatgcagtccatgactaagatccaccacagacccctggatcggcctgctagcccatgctccaatgttgatgacattgaagacacccctcctg

SEQ ID NO: 432 - DNA, 777 bp, Homo sapiens
ctgactcattattagtgaggggggacatcttttcttttgcttaactgttttttgatattccttttctgtgaattacctgctcataatatctgctcattagatctatcgatctttctttctgtttgttattcatttatggaagccacttagaggttgcatgtaccaaactgttgactattaagcatgaggcaaacgtcgctcctcaatctgaccttctcttttcacttgtgtgtggtggtggtgtttacaggaagaggtctacagttcatcgcaaggctctagagggaatcaggaagtgccaacctgaggtatgccattttggcagcagaattcttttgagcagaaagcattggagttcctaaaattctttatctgcctaaaaccagagcctcccccaaacaactccattgttctaagtgtctccccaggaacaactgtaatcttctcttcttggaggggagaagcccccccacatcccggcagacattgtcacaaaggaccatgtctcccatctgccctcctgagggcccatttatctctcattaaagtcctttgcgtttccgtaagtgctcctttgccctccctacccccgtttggacgagatgtgacctccaaaattctcactgctccctttggtatatgcttatttctgggacaccctccttctacttaagtttaaaatttcaaatgataccttctatcctgtggatttttagcctttattgaaacagttacactcttggttccccagtctgtgagggcatcggcccattttaa

SEQ ID NO: 433 - DNA, 493 bp, Homo sapiens
  misc_feature (1)...(493): n = A,T,C or G
cgcggaattctctgtagtccatccccttcccaagctttcctattaatttctaactcatatcattttgtaccctcaaccagagtaggggctctccttgtggtccagcacatcgtttggactttagcaggtgttgtatattggtcccttggccacaaatgcagttttgtcctctgtttacacaggtaaaattgccaggagaatgtccagtatatgggggacagagttagagggagctattattcagttagcgttgagtatctggggacttgacccaggagaaactccttgtggaagagacttctgtcacaaacactcaaccctcctgtgatagtcatgatatgtttttgcaatgttatcccatgatctaattcacagaggtgggctctcattcagagttcttagtgttctgggggcttattggtttgtgattcctaagaattgagttgcatggaggaggaggagcacagaggaggaaaggggaagttttttnttt

SEQ ID NO: 434 - DNA, 824 bp, Homo sapiens
acctgagcagacatgttcaactgtactcctattgggagcagtactgacttttcattgtttctttcccccggaaaactgacacccccattaaatatgccctctgacaccaggcctgtgagagcaacatgggatatgctcagatctcgacgaagaaaacagcaaaagaaaccaccatcagagtgaacaggcaacctacaaaatgggagaaaatttttgcaacctactcacctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagacttggaaccaacccaaatgtccaacaatgatagactggattaagaaaatgtggcccatatacaccatggaatactatgcagctataaaaaaagatgagttcatgttctttgtagggaca

SEQ ID NO: 435 - DNA, 783 bp, Homo sapiens
cgcggaattctgggtatcaatcgggttgaagcaaggaaagtgaaggccagatatttcactctctagtctcttagtaagaacctcacaatagacttggcattttcatcaagaaaaaaatcttctcaaacagataaaataaaatcacgaagaatagaagagtcactggcattattaatgacaagagcaagtaagccttatttgagcataaataggaggataaccatgaataagaagagaaacacctgatgagatttatttatcacaagaaataagtagcacaattttttctaagggggataaaaattatcttatattaactttcatttgatttttaaaccatttctccccatctgctgatggaagtatttcacatttctcttagaaagttaatattttcttacctgggagcttttataatttaataattgtaattgtcagcaatgcaagtgtattatttacagtaactgggtctttttagaattgcatcaatatagtttgatattctcaactgacactattttaataaaattattttgataatttagtaccttctaattacttttctggtacataaataataataacagcagcttgaattccacgtccagtttgccccagtgacatgtccactcagttttacgtatttgcatgactcatcctgtccagtactaaattacatctaaaatcaagacaatggaagcaataggccacaagacaaataagattcccaaaacaaccttgttagtaaatccttatgaatatttcctaatctgcttccccatc

SEQ ID NO: 436 - DNA, 736 bp, Homo sapiens
  misc_feature (1)...(736): n = A,T,C or G
cttatcaaaaatagatcaggagcagataaaattaatatttatgaactcaattatatagaaatggacctttagcaagcatgccagctgctaacatttataaggtctcttttctctggctcctggaatataactttaaaaatacataaaagtaattccagcttaattggattgtccttctacgctgtgctttggcagagttcctacagttggtttagcttaaaagtcagagaggaggaggaagagcccgcagtgtggctttagcaggattcaatggccagtgtcaaaaaaagttatgttctacttcttcccttgctggatttttcaaaatctactgatgaatggcttttttttgaggggggatacctgtctctcttcattgtcatcacccatcaatgtcaaagtcagtcatcagtctacaagtcgtgtctgtgataagaagtttcccataatgaaatgtgtactttcatatactttttcccataatggaaagtgttgcttataggtgttcactgtgtatgctctccattcaccccttccataagcactgtactcccttctcaaatctggaaaagattaaaggttgagacaagttgactaatggttttgcacattatagacaagctcgtttcaagctaatgaaattaaaacaaattcaataatgatactttctgtgcagagctccttgtagtttctaatgtcctttctcttactctgtnttctattgtgttaccaaaga

SEQ ID NO: 437 - DNA, 733 bp, Homo sapiens
cgcggaattcattcctgagtgaagccaagaagcctcccaggctcagccccagtttggggctcccctgtcctgcatcactgggggagagtgaaggagaaagccgagtcaccctggggaggccgagtcagtcatccaagagagaacgggtgctgagtcacctgggacagtgggcgccgagtcacccggagacagtgggcaccgagtcacccggggacagtgggcaccgagtcaccccggggacactgggcgccgagtcacccggggacagtgggcgccgagtcaccccggggacagtgggcgccgagtcacccggggacagtgggcgccgagtcaccccggggacagtgggcgccgagtcacccgggacagtagacaccgagtcaccctggagacagtgggtgctgagtcactctgggacagtgggtgctgagtcacccagggacagccacaggctccatggattaagacccgaggtcttcagaggccgtcactggcctcccacagagacctgtactggaggtgatgctgaccagctctgactagcgcgttgcaaccggggagccgcttagctgtgcacagcctgcagtgaatcctgaactccattcttacggcgttctacacacacagacacccagacacccccacaaacccatatgcacatgtacatacacacacatatatgcacacatgcacttccaaacacacttttacccccatgctcccaccttcccca

SEQ ID NO: 438 - DNA, 820 bp, Homo sapiens
ccttttttagagatggagtctcactctgtcgcccaggctggagtgcagtggcgggatttcggctcactgcaacctttgcttcctgggttcaaaagattctcatgcctcagcctcccaagtagctgggattacaggcgcccgccaccatgcccagctaatttttgtatttttagtagagacggggtttcaccatgttggccaggctggtctagaactcctgacctcaggtgatccacctgcctcggcctctcgaagtgctgggattacaagcgtgagccaccgtgtccagctgcaattttttaaaattttaatatatatttgtttttattttattttatttgagacaaggtctcgctctgttgcccaggctggagtgcagtggcacgatctcggctcactgcaacctctgtttcccaggttcaagtgattctcctgcctcagcctcccaagtagctgggattacaggcgcccaccaccatgcccagctactttttgtatttttcgtagagatagggtttcgccattttggccatgctggactcgaacttctgacctcaaatcattttcccgcctcagcttcccaaagttgttgggattacaggcttgagccacctttgctgggcccctgaaattactttaatattgacataatcactgcaggttttaaaaatttttgtttgcatgggattaccttttcctgtcctttttacttattgggggtccattattaaagtgcacttttttattgaccatttaaccgttggtttttgcttttcctacccctcccttggaaattttttttttttaaatagggggcctt

SEQ ID NO: 439 - DNA, 602 bp, Homo sapiens
  misc_feature (1)...(602): n = A,T,C or G
cgcggaattctgcaggacaggcctcagaatccacccctgtgcctcgtcgagcccctctagggaactctgcaggacgggaatcagaatccaccccgtgcctgcaggggaaagtggtctgcacatgccctgttgaggacgttctcaggatacacccgcatgggagtgaagacagtagaaggggaagaagaggggctaagcaaggtcaggtccaggtgcagcacagccagctccttgaggagctcttaagaatgagctgtgctgtgcatgggtccctccttgaggcaaacagcctgggcttctcaccccaccaggtagtcactgggcagagaagcggggtgagcaggacataactcccgggtaactctgagggacacagctccactcacctaagggcagtcttctacggaagatgtggcaggagctgtcggcaacacacgcagcccctggggaggagtccaccaacctagccacagggaccccaggaagcctgggtactcagagagcacctttcataacagcgtctgctattattactcaaaagcaacacccaatgtctgcttcataccaagacctcctcccccatagtaagggggaggagtttn

SEQ ID NO: 440 - DNA, 576 bp, Homo sapiens
  misc_feature (1)...(576): n = A,T,C or G
taagatgcagtgaaacacagtctgagctttgtctctgaatgtgaaagaagtgtagagtttaactttccttatttgccaagatgaagttcggaatccctgatgagctnctttggaacctttgtaaggttgtcactgactgttgcaactctttcatgcagtcacaaagcctcagccctgagtttagtgattctgttgacagtgagttgtgttgttttcttttctttttttcttcagcttttaagttcagcagtacatgtgcaggatgtgcagatttgttacatatgtaaacgtgtgccatggtggtttgcttgtacagatcatcccatcacttatgtattaagaccagaatccattagctattcttcctgatgttctccctcttcccccaccccacccccaacaagttgtcaagttgtgtcattttctgtaaagtgatacttattatttttttctttttctttctttctttctttctttcttttctttctttctatcttgctttctttctttctttctttctttcttactttctttcttttttttgggggggtgggctgagtttttgtttttttgatc

SEQ ID NO: 441 - DNA, 647 bp, Homo sapiens
  misc_feature (1)...(647): n = A,T,C or G
cgcggaattcactggcagagcgtggggggaagaggaggctgtgcactttgcacagtgtctttgcagttttgataagattagagtttaccgaagtgtaataagtttcaatgcctgttggcttatttggatgattttaggtgacacataggaaagtgaattcttgtatgaagttggaagtctatgtgtgtgcaaggcaaagtctagaggtaggcaagcaagtcattagggtacaaaattacaaatggttgccacttcccatgtgtataaccctgagaatgagtagaatgagtgttcccttagatcctgagccatggccctcaccctgccttaccctgtgcatgtgtgtgtccacatatgtgtgtaagtgtatatgcatgtgtgtgcatgtgtgcacgagtgtatgtgtgtatgcatttgtgtgcatgtgcntncntgtttgtgtgcnaatgtttgtttgnttgtntgtgtttttngttgtgtgttttgtgtgtgtgtttgtttnttntttttttgtntttttgttttttttttttttttgttttttgttttttttttttttttntttttttgtttttttttgtttttgttttttttttttttttttgttttttttttttttttttttttgtttgtttgttttttttttg

SEQ ID NO: 442 - DNA, 845 bp, Homo sapiens
  misc_feature (1)...(845): n = A,T,C or G
accctttaaaagaacttgaacgcacatttctcatctttataaaactgatttgttgacaggggcaggaagatttagagtttctaggacgatgtggaaataagaaattacacggggctttctcaaggttatatcaagagtgaagagagatgccattgtggttctcagtggaacttttatagagctcctttaataaagacaagtgagcatgaaaactaaagctgcaatactgtcttttcagaaaattgaaccaaatacacaatgtccgtgctcctcagccaattttcaaaatctttgttattgtttaaataatagcaaattacttgaacataaaaaggcaagaaaattctgttattaatcctgtaattcaggggctcagcaggaaacacctggcacatgcaaatgaagataattgaaagatagattaataaagggaccatctacaaagacgttgacagattgtaaagcaaaccgcacaggatattacagttacttaaatccaactgtggtgggagttcttaccacacccaggcatcanggcaggaggcggccaggaagggtgcatggagaggctcattgctgctgtaaagttccatcagttgtaataatccagcaatgagatgtctgaagcacanatgcatggatcttgctctcctaccttctcctggtttcctgcaagtgattcctttctaatcttaaagcaaagaagaagtaagctgattatgatgcatctccccagagtagcctgctgggattcaaaaagagaataaagaaggacctgagggcaaatttgtgactgtaaggaccaaaaaaaaaaagaaaaattttggttttgtattataataaag

SEQ ID NO: 443 - DNA, 433 bp, Homo sapiens
  misc_feature (1)...(433): n = A,T,C or G
cgcggaattcactggcagagcgtggggggaagaggaggctgtgcactttgcacagtgtctttgcagttttgataagattagagtttaccaaagtgtaataagtttccaagcctgttggcttatttggatgatcttaggtgacacataggaaagtgaattcttgtatgaagttggaagtctatgtgtgtgcaaggcaaagtctagaggtaggcaagcaagtcattagggtacaaaattacaaatggttgccacttcccatgtgtataaccctgagaatgagtagaatgagtgttcccttagatcctgagccatggccctcaccctgccttaccctgtgcatgtgtgtgtccacatatgtgtgtaagtgtatatgcatgtgtgtgcatgtgtgcacatgagtgtatgtgtgtatgcatttgngtncatgttttta

SEQ ID NO: 444 - DNA, 701 bp, Homo sapiens
  misc_feature (1)...(701): n = A,T,C or G
tacacagaacctttaaaagaacttgaacgcacatttctcatctttataaaactgatttgttgacaggggcaggaagatttagagtttctaggacgatgtggaaataagaaattacacggggctttctcaaggttatatcaagagtgaagagagatgccattgtggttctcagtggaacttttatagagctcctttaataaagacaagtgagcatgaaaactaaagctgcaatactgtcttttcagaaaattgaaccaaatacacagtgtccgtgctcctcagccaattttcaaaatctttgttattgtttaaataatagcaaattacttgaacataaaaaggcaagaaaattctgttattaatcctgtaattcaggggctcagcaggaaacacctggcacatgcaaatgaagataattgaaagatagattaataaagggaccatctacaaagacgttgacagattgtaaagcaaaccgcacaggatattacagttacttaaatccaactgtggtgggagttcttaccacacccaggcatcanggcaggaggcggccaggaagggtgcatggagaggctcattgctgctgtaaagttccatcagttgtaataatccagcaatgagatgtctgaagcacaaatgcatggatcttgctctcctaccttctcctggtttcctgcaagtgatttctttctaatcta

SEQ ID NO: 445 - DNA, 502 bp, Homo sapiens
  misc_feature (1)...(502): n = A,T,C or G
aatcccactcactctanggagaggatccgcggaattccgggatgttctgtgccatgttgcctcgtggcttcagacagcgaatgctatgacggtcttccgtgggatgagtctctccaccgaatgtgcaggactgaggttctactgcccagagtgacccagaagagtctgaatctcacagcctcctctaggccccgaagagaataacgttctttagttgggccgactgagtttacatgtgaagggccgcctggctggaggaaaagctgaggaaggaaatagcatattagacagggctgcccttgaaagcgcagtgaggtatattcagcagcgtgtgttgttctgtgagcacaaatgcatagaacggtggattctgaatgttcaagaagagctggacttttctaagtttcataaaaatgtgatcttgtttaagaaaaggggatgggtggagagtttcaagcatggcacatgttttcacaaattatgaattctcccattactttgg

SEQ ID NO: 446 - DNA, 1013 bp, Homo sapiens
  misc_feature (1)...(1013): n = A,T,C or G
ccgtatgaaacaacaaaaaatatctatttttcaaataaaacaatttacaccaagtcagtactgatttcttcctgccatcactactctgaatactgtctgtgtagaaaaagaaaagtcaggaccatgcctggggtcagaaaccagacatttgagcaattaccctgcagaaacgtgttacctttgcgatttgacatactgtgttcaaaacacaagttgaagattctgaacccatggcctaaagtagaccaacattcgctggacggctaatctgtttactcaagcgtaccaagtcttcataagtgatctcagcgggcagggacaaaacagaagtagactgagggcctgatttatgtcacgcaaactgtgcattccacggccgcacgctcagaaggaactgtgctctgcttaacgctatgctgccatgctcttcacctatgaaattcttaagagttgtgtctttgaacttttgntttgtaagtgaagtctaatgagacggtcgtgcatggcacagaagcagaggagaagtgtgcaatatgcttgtctgctgtttgctccttgctgcactatttgcatatagaattcccagcgcccccatcggcattatggtcccattgaatcccttggccttggacttagcacgactctatgcccattattagttaaggtgctggattcatgaccaactaaacagggggcacttgctgtctccttagaaaccagtctgctctttttaaaccataacttgctttaaaagccgaagaatggctcagactttttatcagaccaaccataccaagggaacccttgttatggccctttattactccttttacttcctgtttttcttacatcctttttaccgttggaaaggatggcactttaggatcctgtgatattagaaaacctcttacttctttcccttttttttccccattaggttaatggaaatgttttgtttaagtactttcttaggtgtgatgaaaaattcttggttttttttttctattttcaat

SEQ ID NO: 447 - DNA, 667 bp, Homo sapiens
cgcggaattcttcccctccaacccttttaagcaatattcatgtgacatttccatcaaagtaaagccaagtccccatcagtgaacacatctctttctactttcaccaacgttacagtgtatgcattcacctataataactacgtgacccattcctgcctgcaactgtcgggccctgttctaggcactggggatccaaatgtgcatgaaacacacaaagctttgttctcctcgtcgtgcagcgtgctacctagcacatagatgcaacatgctaagtagtgataagcactgtaaacacaaagcaccatgaaggggatggaggatgaaggagacagagtggtcagcagaggctgctcagatgtggctgccctggagccgctcacatgggctcacaggaagatctcctcctaagtcgtgtctgttgaagtcatctggtaacttgaaaataatcgtggtggaaatatttacactgtgggaatgggcaaactgcacagcaaaatgttctgggctttttctttacttccccggaaagctggttaacaggacacccccggatattcgaattcagagcaaaagagaatgagggagtgagctgggtggctttttgcattgagggaggagcatggtggacagaacaaacttgcaatgtggagacatcacaatgggaact

SEQ ID NO: 448 - DNA, 711 bp, Homo sapiens
  misc_feature (1)...(711): n = A,T,C or G
tcccggaattcccgctgtttctaacagataccaagtcagtgaatttgggctctatctcaaagtcactctgtttgaattcttttgtcaatttgacacattccatttgttaatggggggatctccccgccccccactatgttctgagttatcctctatacttaatcctcattcagagtttttcttattaagtagaatttctttacttcctcaactgaattctgatcatattggaaagtgacagttgaaaaccactattgaaaaaaaagagaagatagaactggagaaaactaattcatggagacagagccctagatgttaattttaatctatttctctatttctcccagaatgaatttccttccaaatcagtcttgacgtgtacagtcaataatttatttatactttttaaagacactgtaatcctatagtatttattgcctaaatgactttttatgaatgtcttcagcaaatctacactcacatcctttcatgagtttaaaaagtggattaaaccgaggtggaattcaaactggaaaggttgcatgtccactagagtagcagaaaaacctggaaaaactgntggcctcgtggcgagttccacttagcccccgcaaggggtagggctgggtcccccaaaccgtggccagtgcgcagaccccttctnccgcccctgcccgcgcttcctgactcctgcgctttgctaaaatcaaa

SEQ ID NO: 449 - DNA, 783 bp, Homo sapiens
cgcggaattccactatgtatgaattctttgaaaattatatgactcttatttctactgatttgattctagatactaaggatgtgccaaatgagtcagatactaagattcatcctttgaaatcatctagtgtgttttacgcagctatcctcaaaaacatcagtgatgtctgaacttttaaaacatctgttggagcaaaattaaaagagcatttggtagtaatctaagtttttgttcagttaataagtggttgataaagcttccgtattttcccggaaaagttaaaaaaaagttacatgtcattgggggaaaatatgtgatcagaaatgtttgcacagatcgatgccacaaaagacatctccagcgttgtggaacatggggagacactatataaaataccagaaagaaagcaagtgggtttacagatttgttgtaagacacaaatcctctgctactaagaaatgtgtatgctaaccatatatgctgtatttattttgttgttaagcatactttcagtttactcagaattttcaatttgctacaacaatgtatccattcgcatatagaaaaatattactttaagatgactctgttcctttgaaaatacatatgtacttagggttatgatttatgtcaaaaattaacattataagttcttggacaagcacccaaattgaatgaattttcaacaaaatgttaattaaaatctatttgtttttcagatgtgactcaaggttgaaaaaatgtgttttaagaatctactttgccggttccttctttttgaat

SEQ ID NO: 450 - DNA, 743 bp, Homo sapiens
  misc_feature (1)...(743): n = A,T,C or G
atccgcggaattccatcaaataagataatgctcactatgactgggggaagcaatctgccatggtcctggggcatctttgtgtgtccttgctgcaaggatagcgtaccctgatactgagcactgtctgcagatggtatggaggcaaccaaggaggctgaggtgcccacagagtgactgccacgcacctgcgaactccacagggacgaggactggttcgttggccgcgcgctaccacaggcctgcagccctgggcttcccagctgcggggcatcctgctttgtgggtagccactgcaccgtggcatttgggagagagaagcgggctctgtgatgctgaggctctntncatttcctgtaccctgtgagtgacaaacgccttgctctgattccagcttgttgtctatttttggcaacttgctggccagcctccacattgacattggggcctagttcccgctcctctcctctgtgaggctggggcccttccccgacggccagtgtctcatcaacagcacagggtgggggagtctggacatgtgggctctgacccctaaagtgggaaagtgagattcatnatgtgaggcttccctcgtgcaggctgaacaaacatgttcatgtccctgcaccctgaaatttgtgaaaatgtcacctttcatggncaaaagaactttggtagctgtgattgagttcaggattgtgagattcttcttgggtttcccaagtgggcgtgggtgtaattcaaaa

SEQ ID NO: 451 - DNA, 468 bp, Homo sapiens
gaattcttatcatcagttctaggagctttcaggaggagtacttacggtttttaaggtaaatggtcatattgtcagcaagacaatgacaatatgacttcctttttaccagttggatgccctttatttctttctcttgtctgattgctctggccaggatttgcagaactatgttgaagaggagtggtgagagtgggcatccttgtcttgttccacttctcagagggaatgctttcaacttttccccattcagtattatgttggctgtgagtttgtcatagatggcttttattactttaaggtatgtcccttgtatgctgattttgctgagagttttaatcataaagggatgctgaattgtgttgaatactttctctgcatctattgagatgattatgtgatttttgtttttaattctgtctatgtggtgcatcacatttattgaataacatgtgttaaaccataacagta

SEQ ID NO: 452 - DNA, 720 bp, Homo sapiens
  misc_feature (1)...(720): n = A,T,C or G
tcacgggagaatgggaggaggaggtcatagtggcattcttgctgctgcttctgcttctgcagtattcccaatcgccaaagttccatattaggggggattatgttctgggccctacgatcatgaccacattcagtaatagaagtcactctaagattttataaggccagaagggtttgaaatgtcaactttcaatcacattggtagtgccctaccaatttgttcattcatttgttcattcatttatctattcatattcattttatttgtaactaatatgtggggaaaggtatgtgtacaaaacgtcttttctgaaattagttcaaaaaaccgtgcagagctgaaaaccagtgtaccgacagcaacaagacacagngtttcgatttctggggaacgttaagtctgtggttgcctggtttcttctgggaaagtcagtgggcatctagattaagaaataagtaaaataaaatggctagtcctgtacacacagtgcttactgagcaaatattgattggaaatatgcttaactggggctctggggagatgcaagagttaatgttttttcataacggcctcctgctgtaaaanagcactttatgctagcacgctttgactaaatgaatctttttgaatgactaaagagcaattttattataggcagtcctttgttttcatcaccaggcattctgtgacattactaatcatggagtattttgtcttacg

SEQ ID NO: 453 - DNA, 663 bp, Homo sapiens
  misc_feature (1)...(663): n = A,T,C or G
cgcggaattcaactccaaagaacccaggcttctttctctcctgcccccagccggcagagaatgggcattgagagtccataagtgccctgaatgggaagatggaaagccacacagctggtggagcaggaaagcgatgaccagctcctctgagctcctctgcttcatttctctccccatggcacttgacattgaagttcagatttctttgtccactgcttcactgttgtcttgctctgcaagaatgacagagtgtgggatttgtctcttttgttccctgctgtgtcccaagtgcttagccccgatttatacctctgttcaatgaatgaatgaatgagctggttgccatttcttgagcacttgctgtgtgccaggcactctgcaaagaaccgtgcaaggattcacatgccttctgcctggaacccccttctctcagttggctctttctggtcattaaggtctcaaattagaaaactgccacctcctctaagaagtcttcctggatcgcacagtcactcttcatcatatcgccttgcattgaccatgaaaaacacacatcaatgtntgggattttcctgtgggtgtatttatgagcttnttatttgtctcctcatcatcacccaacctgccctagaacacaaaccctggagatcacaggcacccagg

SEQ ID NO: 454 - DNA, 581 bp, Homo sapiens
  misc_feature (1)...(581): n = A,T,C or G
tccgcgaaattctttttcctgacatatttacgatacacacgtgctttttatctgaaatctgttgtgtcctccttttaggcagtctctgtgggcagagagtgggacttgcgaggtggacagctgtggggatcctgggcaagggagtttcagaaggtgtggctcaggggctggtagaaacccccttttgttaggacttgttttttaaaaaagaaagccctaggccaggcgcagtggctgatgcctgtaatcccagcgctttgggaggccgaggagtatggatcacctgaggtcaggagttcaagaccagcctggccaacatggtgaaacccccgtctctactaaaaatacaaaaattagtcaggcatggtggtgggtgcctgtagtccagctactcaggaggctgaggcaggagaattgcttgaacctgngaggtggaggttgcggtgagccgagatcacgccactgcacttcagcctaggcaacagagcaagacttcatcttaaaaaaaaaaaaaaaagcccatcattttgcagctttgaagctgctggggatcacgactgtctctgtggcccttanctggc

SEQ ID NO: 455 - DNA, 738 bp, Homo sapiens
cgactcactctatggagaggatccgcggaattcttttttaagctttattgaggtataattgatatacaagcaattgcacatatttaatgtatacgtcttgaagaggtggacgatatgcatacaccttgatatcatcaccacaactgaggcactagacatatgcatcacccccaagaacttccttgtgttcttttgtgtgctttcttccttcattttgttttaagaccacttaacatgagctctgtcctcttaatatattttaaagtgcatgacaccatatcactaacttcaggtactacaggtacagcaaatctctagatcttatttatcttgcataaatgaaatgttatactcattgactcacctgtccccattttctcttcccccagtctctgaaaaccattgttctattctcttcttctatgcagttgacttttaaaaattctgtatataagtgaaatcatgcagtatttgtcattctgtaactggcttgttcacttagcataatgtcctctaggttcatccatgttgtcacaaatggcaagattttattcctttttcaccttgaataatattccataccacgcatatgtagatacatatccgccttatcaatccatccatcactggataattacgttgtttccatatcttggctttggcaaataacactgcaatgaacatgggagtatagaaatctttttgacatactgatttcatttcccttttaatatatac

SEQ ID NO: 456 - DNA, 702 bp, Homo sapiens
cgcggaattctcagcacaatgaggaatcactggtgagctggaaacacagtgcataaggtgcctactagggagctcaaaaagaagtgtgttttctcagaaatcacaaatgtccgcagggacttgggggacatgataagtgagtaaagtggctcaggcctattggaaagtttcaaccctaataaaggggacagtgttctgccccagctggttattaccacatgggaatgtggaatagtgttgcctaaccttctccagagaaggcagaattactattttggggggtatagattctccatatttaaaaatatcgccagctgattcgaattttgtaaaacatgatagtgggaatgattaagcaaagtatggctctggctgtgagcagctcagttatatgaagctgcaacctctgggatttcgatttaattttccccatcagccagaaatgctgtaaaggaacccaatttcttagagtatgcccagttggcacagtcctagattttttttaaagttctgtgtagcaatttgatgatgggaagtcagaaaatctaacgagtcatgagagaatgttttgagtcctaaaagataagtccctgatttagactagtggaccttaagtatttgtagcctgtagacctttgactgccaaccgctgcctgcctggtcttttcagagcatactcagagaaagccgaactgccctttg

SEQ ID NO: 457 - DNA, 570 bp, Homo sapiens
ccagactcctgcttccaaaaatcatacaacttctgagaagcaatgaatcttatttcaggacaatattctgtttcaatgatttattatacatatcctaatatccaatactaaattatatttaattactgtagcttttaatatgtctagaaattgggtaatctaagtctacaaagattgttagttttcaagatcgttgtggctattctaagtactttgcattaccaattaaaaatttagaatcagcttgtcaatttccatgacaaggaacgctgggatttttattgggattgttttcaatcaatagatcacattgggaaaatcaacatcttaacaatgttgagtttttcaatccagaaacatctctccatttattgagtcttcaacttctttcagcaatattttgtatttttactacagaagacttgcaaacacttgttatatttattcttaagtattttatattccaggatattataaatggtattattctttaatattatagtataaattttaattactaggatatagaaataacagtgaattattatgtccaggacttgtttcccatca

SEQ ID NO: 458 - DNA, 732 bp, Homo sapiens
cgcggaattcaaagtccaataaaggagtgtattctgttgaatcatcctattatatttaagggattactcctgcaccaagcttgcctccatgaaccatgtgagcctggcttgatgatcaattgcttggctcctctttggaggtattcactagagtgtaagttttaaaattcaacttctctttgctgtgggcagcattagcatgcttctgccaagtgttttcaacatagttctttaaataaatattcttcaacaaaaatttggaaaatgtgaatcctatagaccttttctttctctttttcctttgaagaatttcctgtgcaaaccctgaacacttaagcttgttgtttcagtgtttgtgccaatggcacataattaaaaatgcttctatgagcagcaggctctgcattagcagtgatccaaaggatgcaagaagcacattggtaccatatgtcaggctttaccaaggcaaacaggtcttgatcccttttgtggcaatcacttaatgaattaggagtgcctggatcattttctaagctagcatgtgctgatgatgtcttttaatctccaaaagtcagggataaaatgataaaaataaaggagctcatgagatgtgtcagtaactggtaaagatagaataacagggactaaatgtaaccatttacttgaaataactaaagaaaaggttaaaattaaataaaataaaacacctgctttcagtcattgggcattata

SEQ ID NO: 459 - DNA, 704 bp, Homo sapiens
gaattctcaaaataccatttgtaagtactttaaaaagttggttttaaagattcagagacgtgtgaatatctctgtaacacagtaattaaaacccaggccataaaggtaaatactggcatatcacattgtgtccgtctgactgtgggtctccttgcagtgaggataataatagcacgcacttcttagggaagttgtgaagaataaatagattcaaacatgtaaattaatcagaatagcatttgccacactgcaaatgattggtaccattattactttctgtcagataattgtgcctagttataaatttgctaagaggtttgcaagagataaatgaatggtataaatcaccaaaaggtaggattgcttattataactaataatcagcatagatactccttgtctaatgtaaaaataaagggaaataaaatggtctccctgaccctggtgtaatcacttccaagaagtgataattctggaagtaactaagagttcatgaggctaactaccggtcagtgaagtgtactttcccatcaggaaacatgataagcatgtagtcacttttattccatagttctggctcctccaaaggcaaaagagatggcatttctccagcttaagtttcactatgtagttttaggaagctaacattagctgatattactactattcttatcaaaaaaatgctcttttggaattaagaaaat

SEQ ID NO: 460 - DNA, 832 bp, Homo sapiens
  misc_feature (1)...(832): n = A,T,C or G
cgcggaattcttagttgcagacaaagagtccctttagctaagtagcccctctgagcagaagagatgtcattaaaggataagaggcaattcacataatctctaggagaaccactgaattgaatgtatttactacacagccagggacagggcagccagtgataacacagacgacaaaggtccaacctctgcagaggactgttgtggtggaaacaccactgtcacccctcggcatgatgatgtgagggcctggatgccaggggcaccccacagctgccccaggagaaccagggccactgtgctcaccagaaaaccccaactgccttcctggctgctgctctagaacccacttcttcctctacgtcccaaatgagtgggtccgactggagcaaactgcttcaatcctgcatctagcagcaaggggttctgagaatgtagtttaggcctctcagcccctatagcagaggaggacaagcagagggggttgaaggtgctattgagtgagtggcctacagcagtggtccctgacctttttggcaccagggaccagttttatggaacacaatttctccacaaatggcggtcgtgggggaaggattcccctccctnnntcccgactttccccccctctccccgtaaaatattgatttaatatttgtgctatttgtatgtagtactcttagtatttatactatgatcgtttattatcactatatatttgttgtagctcttcttttattcagtattgtttacaatctttttacttctatgtcatatttacgtataaccaagaattattttcgttgaaattactatttttttttctgattcctct

SEQ ID NO: 461 - DNA, 532 bp, Homo sapiens
  misc_feature (1)...(532): n = A,T,C or G
ttctgctgtttgtatgaactggctctgtaaccttgggcaggttactgatcttgcgaagcccagctttcctttttttacagcggagatggattcatctaagggctcacggtggggcctgagcacagtgatgtgtgcaaggccctcagcaggatgccaggtacatgataagggccctgtcagtggtgaccactgtgacgagggtgccttaaaaaaggtgggccttcaggctgggcgcggtggctcaagcccgtaatcccagcactttgggaggccgaggcgggcggatcacgaggtcaggagatcgagaccatcctggcgaatacgtgaaaccccgtntactaaaaatacaaaaaattagcctggcgtggtggcgggtgcctgtactgccagtcacatggggggctgaggcaggagaatggcgtgaacccgggaggcggagcttgcagtgagccctgatcacacgattgcactccagcctggaatgtagcgagacttcgttttaaaaacgaaaaaataaaattaaaataaaaag

SEQ ID NO: 462 - DNA, 774 bp, Homo sapiens
  misc_feature (1)...(774): n = A,T,C or G
cgcggaattcctctcatttttatttcttccctgaacttttccttgaagtctaacatgcagattataaatagggctgtaatgtaatgaattttcacagctatgagttgagcacacctgtgtgccccagtgcccagataaagacagcacatgacaacgatccctagaaattccctcgtgcatctttctagtcattagcccctctgtctgctctgttgtgtaacagcatcagttgatttgcttgtttttcaactttatgtaagtggaatcattcagtatgtgctcttctacttggcttctttcaaactcagtcattaaatgttggtctcctgtagcttagtcccagggccctcttcccttttcaccctttgttggtaggcagtcttattccctccccctgtttaagttaccatctaaatgttaacggctcacacatgtataccttataaagtcctgatctcttatctcagtgccagttccatccatctagctgctgtccttgacatcgacttttggatatcatgagcatgtctaaaatggaaatcacaatctttgtcttcaaaccttggtctttctaaagttttctgtcttactgaatggctccatctccatccagttattcaaataaaagacctgngggtcatccttggcatttccttgtccttcacccattgtattgaatctgtcaccaagtctgatacatttttctttcatctccaccattgctttagtccagattatgatcattggttccaacccaaatgactaagatgatcc

SEQ ID NO: 463 - DNA, 784 bp, Homo sapiens
  misc_feature (1)...(784): n = A,T,C or G
gcaccgcggaattcacaagtgaaagaagcttcagaacaggcttgcagagcacctacttgaatccagtttggggtcagaaaagagataaagcagtccttgctattcgcaggagttatgttatatgaggtccctgcgaacactgaattcacaaatgctgaacccttgctctcagggaaaatacagggttaggttcctgcaggcctctaggcacaatatttcatccactgatcaatgcataaccttgctttatgtgtgtgttgtttgaagacaccttgtttaatgtccaatgttgcttcatccacatgcacatcccatagccaaagcctctctgactcaggctgaacgaagtgtccgtaacacccgcatcttctctatcaggcaccccacagctcagaaacaccagacccgcccttcaccgctccacaaggatgccgtcgcaaacagcaaaaccaacaagaagcacacaagtgcaaaaagcatgacaccaaacagactgtgaaaagggcacttgtcaggggtgtgtgagctgacgccaggaggcagagcactgccctgtgcaacctcagctgagagcatgtgtgtcgggagacacgttgctcgctactcggaacgcatcaagtgacggccaatgtgtcctgagtactggatttggagttatagatgcatttnggtgagcaggcaaattcgcaaacacagcaaccacgaatagtgaggacccgctgtacttgaaactacttcaaaataagggtgaaggctggaactccacccatgcccacgttcagct

SEQ ID NO: 464 - DNA, 678 bp, Homo sapiens
  misc_feature (1)...(678): n = A,T,C or G
cgcggaattcatcattattgtttctctgtggctgaaatgactgttggtttgacttctggacttaagttgagcctctaaaattgggaaagagatgatataatgagtttctgcatgaaagcctgttcagtgttagagaaagatacaacgtagagaaccaaaggttaaccgcacaagtgggaataccacatccatcacttatgatgcattctccatttcagtgaggcttaatgacaaccacccttcctgctgccaagtccatcaatagattaaaagtcacttcagaattccccaaagttcaacaccaatcacagaaggaatgctggaaattattacctgcctgcaaaattctagtgctggaatgactatacgatttatctagggtagtgttctccaaagagtttttattgtgcacctttatccctatgtgtttagacacacgtccacaaaataacaattattacagtagctgttatcctgnntnccaaatatttncaggttactgtttgacccaaaacatgataggattatcactctcaaccgcttctctttnggtggnnnaaatgacccgccctnnnattccaatgggctataaaccaaagaagtgagtgtggtttgggaaaggaaattcatgggggacaagggaaaaccccatgttttaatgtcacctgtacttttttc

SEQ ID NO: 465 - DNA, 701 bp, Homo sapiens
  misc_feature (1)...(701): n = A,T,C or G
cgcggaattctggggcgagccctctttggaaagccagaaccctgacttccttctcagtcttatctccctccaccccttctctcttctgcacattcattccctcccaaggatgctcgcccaggtaggggaacatgggcaggaagacccacggagctcactgtgggtccttatctttcatctcctaatgggcacagtgcatgtacccattagattagtgtatggtagaggacaacaatcctgcaccatttaacttaattttttttgctttaatttagctgatttcatatagttaagtttataaaaattaaatgtataatatgtttctactacattagcttagcgcttctaattattttacagaattgaaaagcagttaacctacttggctcttccagaatgtttataaacacacatccatttaaccctttccacatcttttgctaaactattaagaaagacctttaaaaaaatctgactccgtttttctttaaaggattgtgttaggccatttttgcattgctatagagaagtacctagacgataatttataaagaaaagaggtttaattggctcacggttctgtaggctgtacaggaagcatggtgctggcatctgctcagcttccggtggagtctagggagctacagtcatggcaggaggggaatgggaagccagtacatcacatggcaagagtgcaatcn

SEQ ID NO: 466 - DNA, 734 bp, Homo sapiens
taccgcattgtaacaaaggtctcatgtaagttgatggagccgctcctctatccactgtctcctggatctgctccatcctcatgcaaacagagaatgacagacactcagcgtctcaacagggcgtcttccccatttgctgtgattggggaagataagactggagaaggcacacccattctgtcgtgcccaggcccagcagcaatatgtcatttttgttcacatcgctgcttgacagaactcagtcacatgaccccagtttaaactatgcaggaggctgcaaatgtcaggaagtatacggatgtggctagtgggtgtgccatcgcagcaacttctagggaattgaaaagtcagcatcagaaccgagaggactgtctccagcacccagaagactggctcgagaacccaggcaactgtctccagaacccaggggactgtctccagaaccaaggtgactgtctccagaaccaaggtgactgtctccagaacccagaggactgtctgcagaacccaggggactgtctgcagaacccatgggatcggctccagaacccaaccagctccagaacccaggggactgtttgcagaacccaggagactggctccagaacccagagtactgtctgcagaatccaggcaactgtctccagaacgcatgggactgactccagaacccgggggactggctgtagaacccaggcgactgactccagaacccaggtgactgtctccatcac

SEQ ID NO: 467 - DNA, 703 bp, Homo sapiens
cgcggaattcttagtactctaggttagcagtccccacctttttggtaccagggaccagtttcatgaaagacaatttttcacgtggacagggaatggtttggaaatgattcaagtgcatttacatttattgtgctctttatttctactatgattacatactcagcataatgtaggatcagtgtgagccctgagctcattttcctgcagctaaatagtcccatctgggggtgatgggagacagtgacagatcatcaggcatttgattctcataagaagctcacaatctggatctttcgtatgcaagcacagttcacagtagggttcacactcctgtgagaatctattgccactgctgatctgacaggaggcagagctcagatggtaatgagagcaatgggaagtggctgtaaatacagctaaagctttgcgtcatgcttgcctgtcactaacctcctgctgtgaggcccagctcctaacaggccacaaactggtactggtccatggcctaggggttggggacccctgctctaggtttttcaataattcttggtttacacactgagcatggtttcacagacatagaaaaacagaaatcacgcaaccattgaagtttctctgatccacagaaaaagaaataagcatcaactataggctggtagaattcaacttctgtttatcttgattgaggaattcaggtcttcag

SEQ ID NO: 468 - DNA, 604 bp, Homo sapiens
atcccggaattcacagtccaataaaggagtgtattctgttgaatcatcctattatatttaagggattactcctgcaccaagcttgcctccatgaaccatgtgagcctggcttgatgatcaattgcttggctcctctttggaggtattcactagagtgtaagttttaaaattcaacttctctttgctgtgggcagcattagcatgcttctgccaagtgttttcaacatagttctttaaataaatattcttcaacaaaaatttggaaaatgtgaatcctatagaccttttctttctctttttcctttgaagaatttcctgtgcaaaccctgaacacttaagcttgttgtttcagtgtttgtgccaatggcacataattaaaaatgcttctatgagcagcaggctctgcattagcagtgatccaaaggatgcaagaagcacattggtaccatatgtcaggctttaccaaggcaaacaggtcttgatcccttttgtggcaatcacttaatgaattaggagtgcctggatcattttctaagctagcatgtgctgatgatgtcttttaatctccaaaagtcagggataaaatcatcaaaataaacgagct

SEQ ID NO: 469 - DNA, 789 bp, Homo sapiens
cgcggaattcataaaatagaacacagatgtgataaaattatctagaatcaagtaaaactgatgacgtaataggataacaattctaaacctatatatgcacatactaacatagtctcaaaatacataaaatgaaaactgacagaaacttaaggagaaataggtactcattatcataatggaacattttaacatacttctctcagtaattgatagagcaagaagacaaaaatcagtaaggataagaactggataatgcaatcaacaagttctacctggtggactgagagagagaattgtaccataacctgatgaatgcatgttgttttaaagcatgtatggaatgtttataaactggtccattcaaaacctacctcaacaaaatccaggtcagtgagaatcccatacatcttctgtctgatcaaaatgcaattaatgtagaataataataaaaatatatattgaaaaccctgtattgtttggaaattaagaaacatccttctaaataactcatgggtcaataaaatatatatacaggggaaatcagaaaatatttaaaactgaataataaatatgatattcagctaaagcagtattacggaaaaattcagacccttaaatgtttatattaatgagctgatgaaaattaggaagctagtcatccaagttaaaaactcagaaaaagatgtttttaaaaaagaaatactaccagcggaaacaaaacagaaaaacaatatccaggcgccagattaaaaaaaaaaaaaagattttgacaaacttttgacaagaata

SEQ ID NO: 470 - DNA, 543 bp, Homo sapiens
  misc_feature (1)...(543): n = A,T,C or G
tccgcggaattctcaaagaagatgccaggtagggcacctcagggcctggagggcctcacaggaagggctcaggcctgtctgcctttaccaagtacatgttcactctcttaggtgttagtaggggagtggccaagacagccacgtggctcaggtgtggaatgaagctagaccaggtggaagccgaagggtcggcctctccaggcaggagagaaggatgatctaagggcaggtgcaggccagaatgtctggaaagcatttctggtgcgggattgccagtttggtgacgtggactctgggaagcaaggggacaggggacagcagtcagagctgagctgctgcccacaaagcaggctccactgcccagaggctaagcggtatcaccaagcggnggacaactggcaggtcaggaagaagtgccactccagcctggacaacagagtgagaccccatctcttaagaaaaaggaagaagcagtaccagaagctgcgccccctagtcttaactgtctgggaggctgaggcaggaggttgcttgaggtcagga

SEQ ID NO: 471 - DNA, 710 bp, Homo sapiens
cgcggaattcaccctgcaaggggtctatcaggaataattaacacaccccctcccggaagaggagaagaacatatttctcatttatagagatgaggttttcagttgcagcactggtcagtgaagcaatacaatttccacttgtcaatctcgtaattttaaaaccaaaattggcaccatatttcatattcaaaatatatcaagaaacagtactaataaaaagacaagcaaaagataaactcaagtggcaaatgagcacatgaaaacatggccatcactagccatccaggatatgcaaatgtaaacaatgggttcccatcagatgtgcacattttaccaatctgactataccaagtgttgacaaggcagggaagcatgcccacctgtacagaactggcaggatcatcagtcagttggcccagctgctagaagcactgggaagtctctgttgaaatagaagtgagcacatcctataaccctactaacttcaacggactcaacacatgtgctcggaaggcaggtgtaagcacctgcatcatggaagagtggaaacaacccaatagagaaatggataaggaaaatttgtcaggcccagtgcatctcaaaacacaatgcagatcaaaaatagaagatgcagaatcatgtgccccgtatgatatttatgaagaaaatttacataaaaccatgtttttatggagactgacagatgggta

SEQ ID NO: 472 - DNA, 518 bp, Homo sapiens
atctccgtgccggtctgcagcaatctcaattcttgcctcctcagaagaaagaattcgactgaggggcatgaggcagaaagagagatcggagccagtttcagaacaggagtgaaagtttattaaaaggctttagaacatgaatgaaaggaaggaaaggatacttggagaaggaccaagcaggcatcttgaaaggcaagtgcttttttttttttttttcattttttaaccccttcctaatgtcactggaataagaggcctgtcccagaccccaagagcgggttcttggatgttggatgaggaacaattccaggtgagtggcagagtatagtaaagttaaaatcgtttatcagagaccactcggttacagagtaggatgtcctccaaaagcaagagaaggaacgcgcacaccttaaatacgattcttatttatataggttaacagagctaaaaagagaggtctttggtgctttattacaaaggctggtgatcagctttttacaggctattagaattatttt

SEQ ID NO: 473 - DNA, 717 bp, Homo sapiens
cgcggaattccaaatatataaattcctgatgcaattctcaaatacaacctagagacttgaagacaagacttaaaactgagtcttatttatctgagttttcgtagcacagaacacacaggcttcatagtgttgttggctaaatgaatgtggcccatgtgagaaagcattgaggtggatgaggcttggagccacaggttctaaacccaggtgtgtgactaactcaccacttaccttagataatgtccctttactcatctaagtttcagttacagtctttacagattaggaatggaattctgcaccctgcagagccctggcttcctgtcactgtgttgatgctaatacacaaggatgaacacgtggacctgtggtgaaggtttgagctgagctgtgtgtgttttcctatctctgttcctcttgccattcctaaaaccagagctcatttccctttctgttgattccgctttttactgaccaattaagaaagcactgattgagtactgactgtatgcaatgggccagtggaaatgtactctaagattcaggggtgataatggcaccagatttttattatggaagcgacccccatgaagacagcagtttctggcgtcatggagatcacagcccaatgatgtgatagagacatgtccacccgtccaaccacccatccagtgagcattggttgaacaaaattgtgttgaatgcaacaatggaata

SEQ ID NO: 474 - DNA, 549 bp, Homo sapiens
cggaattccctatacaacgtaagaaacacagttcataaaattgtattctatgttggaaatttgctaagagagtttaagtactcttaaccacgcacacagaaaagaaaaatataaaaggaagtaaagttactgtaaatatatttgaggtagatgaaccaattttctatttctgggaagccaacaagcactatgtttgcatcatgatggcaatgaggcctagatttgtaccagttaatttattagagttaaacaagcaaacaaacccatatctttttctttccactggcatctggagtcatattttcagaagtttctttaggttctaagcagcagcttatgagaatggcttattttggtcagtaaagcatttacatacacatcaataattcattcataattgctggctgaaattgaaaagtttgcagatgtcaatgaaaggctctatttccaacttgtcttgaaaaatcaggagctctataatgctaaatgaaataagccagtcatacaacaagagttactgcacagattccacttatatttaaggaattt

SEQ ID NO: 475 - DNA, 373 bp, Homo sapiens
cgcggaattccatacctacacaaattaaagtatgacaggaaaacaaaaacattcccatatattctaggtcttttggagaggcagtaatgacataaaccacatagattaggaagcgagtcaagaagaaggaagactaacacataaaagaagcaaacagaatccttgggatgttgctaaaggaagatcaaagatgggagctgctcactaggtgtagacagcaacttgcccatgctggagtaggtcaaaagactctaggagagatgaccatcaaaaaaacaaaattggtgaaatatattgataggaggtttaaacaactagtggagaatatggggttgttaatgatgagtctcctcaaactctcaaatatattcaa

SEQ ID NO: 476 - DNA, 682 bp, Homo sapiens
  misc_feature (1)...(682): n = A,T,C or G
cgcggaattccattttgtgcataaaaattcatgcttgtaactagtgtgtttatccaaaatgagaccaacagaagattattgtcctccaatagtgcaagctaataaataagacacattttaaagctgtttctaattaataaaagcattatatccattaaagagtcataacttaaatctatcttcttaaaagaagtagtttacattgctcataattgtgttaaatgttaacacttgcatcatgagttacttcagagaaagggtaataagccccacgtggctctctgcctctctttgttaaaaagcgatcacagaaacaggcacacatgcgtttaaaaagaggcctcagaaaaacatctttcctgtagaattaacattgatcttcaatagcttgtcccacttttgcattctttttcacagatgaaatagttgttctccattgtaaggcaaaaccgctttaagaactcagggttcaatcctgttgctattctcaggatttacttctggtgttatggtgttttttctttgtaatttcattacaaaaaatgtttataggctacttctgagccataagctntgattactttaatgatcacacaacacatattttgtaagcatgctttcgatgtgcatcctggggtgtgagtatttaattatattacttgaaacaaattatagctgagaa

SEQ ID NO: 477 - DNA, 783 bp, Homo sapiens
cacgggaattcactatacaacgtaagaaacacagttcataaaattgtattctatgttggaaatttgctaagagagtttaagtactcttaaccacgcacacagaaaagaaaaatataaaaggaagtaaagtaactgtaaatatatttgaggtagatgaaccaattttctatttctgggaagccaacaagcactatgtttgcatcatgatggcaatgaggcctagatttgtaccagttaatttattagagttaaacaagcaaacaaacccatatctttttctttccactggcatctggagtcatattttcagaagtttctttaggttctaagcagcagcttatgagaatggcttattttggtcagtaaagcatttacatacacatcaataattcattcataattgctggctgaaattgaaaagtttgcagatgtcaatgaaaggctctatttccaacttgtcttgaaaaatcaggagctctataatgctaagtgaaataagccagtcatacaacaagagttactgcacagattccacttatattcaaggaatatcgaaaatagtcaaattcacagaagcggagagcataatggtggttgccaggaactggggagaggagaaaatgtggagctgctattcagtgggtgcaaagttttagttttaccagatgaaggagctctagagatctgctatacaacattgtgcctgcaggtatattgtatacctttaaaaattaagaagatacattttatgtcaaatgtttgtaccgcaatttaaaatacaca

SEQ ID NO: 478 - DNA, 430 bp, Homo sapiens
cgcggaattctccaggctccagaatgagtttgaggaaaggaattgcctgtactgacctacccctattaaaaacagaaataggggtctgttataccaaagtccctaaggagacaagctccagaagctataatactcatgactggcatggctcatgtggaaaggacttaggagttccgaggagagagagtgtgagaggatggaagaagccacccggagacactgggtgtaaaaggtataatcatgggttcctttttagtcaattcttagtgcgaaccatgaaataggcggcaagggttcctgagattataaaatgagctgcttgacccctagatagtgaaacccacccacctgtccatagaactggtgtttaatggtttctttgtttttttggtttggggttttattctaattctccttttctccttattcc

SEQ ID NO: 479 - DNA, 608 bp, Homo sapiens
  misc_feature (1)...(608): n = A,T,C or G
tcatttctgaaactgatgaacctccgctgaaacggggaggaaatctcttacacacatacagcagggtcctgcccactggtaaagtgagacgttgggtaaggggtgtaactggggaggaggtgaaggaaattatccctgccatggggagtgttattcaggaacataaaaattagagcattccctctgatggcagtgcttgacggggtgcagggaacaaactggggagcgttcaaacatgccagtggtttctcagcagggctggaaactggccacagtcctgaagatgcttcttgtgacaacttagagtcactgggagtcacacagctcctgtgtagccgnctttgctcctctgtgttaaaacccagtcagttcaaaataacaatcaaatggaaggccatgggggaagggttccttccaccatataacccacacccagatgtatataaacgcatatacatacatatacctgtgtgtgtgtgtgtgtgtgtgtgtnnnntannnaaaatttatttattataaaattatttttagtatttgaaaattcttctatattgttgcaagttgagcccccccatttacccccccccccccccccgaaatatccccct

SEQ ID NO: 480 - DNA, 559 bp, Homo sapiens
  misc_feature (1)...(559): n = A,T,C or G
cgcggaattcaggtcaagctccacagacatccctcccccaagaatccgatccataaataccctcaatggagatgaatcatgtaataagctttgaaatgtctcatagtggtctccctcacacctcgcactggtatttggtttcgatgcctttttcactcttccatcttcacttccaattcatcattctgaggtgcatatttacaagtctgcctctctccccggacagtgaatatttgaagacagagacaatgttgtattcctggttagaacgctagggtccagcacagagaagaaggcagagcagnttntcagtaaccatttttttgggcctgggggaagacaattcaactgagggataagatgagcctctaaatcaaaggcttgggattggggttttagtgggctaccagtacagtttcacaagttgcacactgctcaaatcagtaaaattcattaacataaactacggtataaaaagtgtcttatagaatggagcagtgtaggcatgacctgcatgacctgcagaccccctgggcaaggccttgctatcacacacact

SEQ ID NO: 481 - DNA, 695 bp, Homo sapiens
  misc_feature (1)...(695): n = A,T,C or G
cgcggaattccaaggaagggctcaccacgggtcctttgtacaaaaaggaaggacttgtcccagggtgctttctgttgcttatccaattaaggctcactttacaagtttttaaaaaaatgggctccttagtaaaaccaacacatcctcccatcaccgtggttttgcttgtgatcttaaaggaatcgcaaaggtctcaaacctagacagccagaggaaacctcttcccaagacaactttttcaacactgtggcagacgggtccagcgagttttcccagtcaggactcattttggcctcccagataggcttctgaattatatgcctctgaatttggctgcaagactggaggcttctttcaagtcccatgtagagtggccccagcctctgtgcatggaacaaagagatacgtgctgtatccaggagtaggtggcaaaccacagacgattccttttcaccctgcagcagagttatcaggtcacagaaactacaagactgcagaaaatcgtggaagggactggttaccagatactcgtacacacatgttcacagctgcgctgctctcaacagccaaagggtagaaatgacacaagtgcccatcaatggatgaatggggaaacanaatgtggcatatccatacaatggaatattattcagccaggaaaaaggaatggagtatgtgattcctgctaccacatg

SEQ ID NO: 482 - DNA, 768 bp, Homo sapiens
  misc_feature (1)...(768): n = A,T,C or G
caagcacacgaacaattgctcaacgtcactggtcattaggaaaacaaaatcacaatgattttccactggacacatcacacacactctgagcaaagctaacataaagaccgaggaccccaaacgtcgatgagggtatggaggagtcagaactctctctcggttgctgggagccctgaacgtttctgctccggagtgctcaccggaagagaagacagttggctctggaagccaaaaagtcatcagtatctgctctaggggcaccgcacacgtgtggggatcttgggaatatagtcccttctgccaggcagaaatgaggactcagtttggtaagatcatctgatttctgtggggttttttggagaagctgaaaattcagaattttgtgtaaaatcttatgatgtttcaacactgaccattcaagtgccctgaaaagatgtactggggccgggcacagagggtcatacctgtaatcccagcacttcatgaggccgaggtgggcggatcacctgacaccgggagtttgagaccatcctgaccaacatggtgaaaccccgtctctactaaaactacaaaaattagccggctgtggtggcggccacctgtagtcacggctattttcngagtctgaggcaggagaataacttaaacccangaggcagaggttacagtgagccgaaatcacgccattgcattccaccttggcaacaaaacaagaatttgttttaaaaaataacaaaaaccaaaaccaaccaaccaaacaaaaggatg

SEQ ID NO: 483 - DNA, 657 bp, Homo sapiens
  misc_feature (1)...(657): n = A,T,C or G
cgcggaattcgcccccaggcttctaacaccgttcatttccatgtacgttgtgtgctgcacacccctcctagcacactgctaacgaactgctgctccgccttgcttatctacacaggagtaaacgtgatggacacacaactcttgctgcctctcacaaatatgccggcgtatgggagggtctgagctggagggaggcgcaccttggattggtgtgaatcaagcatcaggaactcctgtgctcacagcttgaccagctctccctcagcatatgggccactccacagaattctttgttcaggcccgatctgtcctnctgggacatctgagctgctcagcaccaggaaacatgctctgttgtgcgcagggcatcagctttgcaaataatccagttacgttcccattggtagctggcgtcacactttatgtccttgtaaaattttgagtggagcctaatcacaatgtaaggtctcatttttaatgttgaattagcatcctcccagtaaagtctgaaatattttaccaaagcgtaacaatgtttttcattctttaagtaaagtacacatgcatgtgggcccaaaactatgactcgaatgttgaatgtgaggctgcctgcacggcactcaccacccaagcatagaaagaaaagaaaatcgggcc

SEQ ID NO: 484 - DNA, 582 bp, Homo sapiens
acttctctatctgttccaatggcctacttttctaggataattttatccaattaaaagaaaaacttgccttctctgggttcttactggatctggggttgctaatttcaaaagggcagaaatcaggcctggggagtggagcagttggggtggtgaagggtgggtctggatgcagatctactggacagcccaggggttcgttcccctgcttgaactgcactcagcaggagaagttagaagcacccagagatgacgccatgtttctgtgactcacatgtaaagcaaagctacccattcttgaccctggctggaggagcaataaattggtacacggttcccagagtgcaatgcggcaatgtctttcaaaatcaaaatgcctgtgccctttgcccacagattcacctgccaggaatttattctaaagaagcatgtgcagggtcatgcactccggaaccactggaagtcgccagacgctggaagccatcgcagtgtccatcagcagatgccttgacatggctcctcagggcctgggccctaatcaccatgttgacagcaacatgcaaagacagagtgtcgttttggagt

SEQ ID NO: 485 - DNA, 764 bp, Homo sapiens
  misc_feature (1)...(764): n = A,T,C or G
cgcggaattccagcaatgcaagtttcaaaagaccctgtgtgccctaaggaggcactgctgatcacttagtgtctgtgaaggcatcagaaggtgacctggacctggaatgatgaaacagccatgggtttaggagctggcagatggtgtggctggagcacatgtctggaatgtggttggccaggcccaggcagcactgggctatggagggacttaaatgtgaggctaagagggctgaccctggtgagggaatgctgtggactagatttttttattgaggtaaaatttacacaatataaaattaacttttaaaaatgtacatttctgtgacatttagtccatgcacaacattgtgcagccaccacctcttagttccaaaatagtttcatcaccccaaaggaaatcctccatccattaagcagctgtcacacatttcatcctccctccgacccttgacaaccaccaatatgctctctttggatttacccattctgggtatttcatataagtggtatcatacagtatgtgacctttttgtggccagcctctttctgcacattgcttttatttttatctttgtagacatggagtcttgctatgctgcccagactggacttgaactcccaggctcaagcgaccctcccacctcagcctnccgagtagctgggaatacaggtgtgtggccttgtgctgggttctcagcacaatgtttctgaggttcctccacgttgtaacaagggtcagtcataacagctttaccattttac

SEQ ID NO: 486 - DNA, 727 bp, Homo sapiens
ataccactcactatcgggagaggatccgcggaattctagacttccacatctgagagctggagtagatgtacttttccctattcctcctgctaagtagagctaacatccatgcatacattatctgtaaagcaaacaggacccaaggaacaataggacggtgaaatctctggttttatttttgcctcatgtaatctaaattgagtgctagagatgctgatgcttcagaaacaccaatggatgcagatgaaaaaggccctaagcctgctctttttatctcaaacataaggaaagaaacagactagccagacagaaaagttttagataattatgctgcttcagccacataccacagaaaaaatgatgacccattctaccactgccagtcaagattgagacatgaccttctccactagtcacggtgaaggagaccaaccatcctgtgtgtcagtgggggacagatgaggagcagcaacaaggcccactatccccttccattgagcgtggtgctgtcagtggagccctgagagttcagagagactgaactcccacccttacccagcagcaatgaggagcccttcttccctagggttaaacgagacaggttgaggaacctggatagaaatgatgtcacattgtttctcttcatcctttccaccagaatgacatttgatatagttgtttaatacaatattaaaataatattctaagtgctgtattattatgcttt

SEQ ID NO: 487 - DNA, 865 bp, Homo sapiens
taacacgcgcaaaacttttaattctgcctaaaaacactggctgtgagatgtggaggtttgggggaaggtgagaaatgaaccctgaagcacccccatcctaaagtggatgagtagagtgtacagtgtggctccagcacaatttatgcagctattttaaggccacttcccttgaaatgtggtttgaaatattaccaaaggttccacggggtgcactagtgtgaattgcaaatcagagcattgatttaatcctctttcaaggccgggctttggatcgctggcgtcgactggctccccactgctcctggctcaggagggaccattcaagggggcagcttcccgcctctattcccacactccaaaaaacaacaccgcagacagacaccctccaactaaattagattaaactccttctcttccacagcgtattagcctttctgctgcccaagcctccttacgcagcccctcctcatttaaagacacagatttctttttcatctttgcaactgcaacaacaacaaacacaatcatatatatatatatagtgtgtgtatattatgtgtgtttgatttgctattgtattttatatttaattttttttattttttcttttttattatcacttctttttaattttttcttcttgtctttctttttacatttttatatctaatatatttacaattacctttattatatttatttttattattatgttattctttttttttctattttattattctttgttttattatatatcattttttttttatataatgtcttctattcttcttcttaacattgttctttatttaatttctttttttttttgattatgcttttatgtttatttacttttttttaa

SEQ ID NO: 488 - DNA, 843 bp, Homo sapiens
cgcggaattcctagacatctacagttttctcaaccagtgttcccaagagaattacactctcttgccctgagccatccattgtatgtaaggaatgaacttttctcccaggggtctagaaaggtgttagttatgtaaccaccctcgagagaattgataaaatagtctctcaagccactttctatgttccgtgattcacgtgagcacccctggttgggaagactacatgtgttcaaataccatttcatattgttagagtagaattgcgagctgaggttttcctttgacatttggggctatttctaaattgccctccaaactggtcacatccattcacaggaccacagtgtccagcatatgcctggaatattatcatgttttacattttaattttttatatttatataagtggagatggtgtctcactatgttgcccaggctggacttgaactcctcgtctcaagacatcttcctgcttcaacctcctaatgtgctgggattacaggcttgaaccaccacgcctggccaagttttaatctttgttaaccctagaagccccaaattatttgtcataatttttttcctcccatccttatcgcaattgaaaatttgttaaatgttaacaatcactaaaattttgttttaaaaattttgttaaattgaacatatttctctttgggaaacatcttttccattacttggttttctttaatcattattcaaaaattatttcctaattgttgtggtactattttttacacctgttaaaattttgtgcctaatatttttcttgatatagagtcagttttaatagtactttatttactatctttataattattctac

SEQ ID NO: 489 - DNA, 617 bp, Homo sapiens
ccctgctatggctagaaggattattaactacagggggaaatgggatttgggcttgtatttttccactattacataagcaaataaaactgccaagctgctgcctttatataaatattccttaatgatgtgtgagacttttcctctgcatcttccttgttttgttctctctctctctgtctctcaaaacaactgtgccttttgtggaaagaaaattgtggcaaatattaaacaggaagctaagccagcacgggaaggaagatgtttgtcttacataaagccgatttaaactactctcatccttgcctcatccctgaagccacgtctggctcatgctgtggggagcactgtgctcagactcagcataagccctccctgctgcctgggacaattcctgcctccctgagagccttcctgggcagcacctgctctcctctggcggtgcataggtcacaggacatgggaaaaaacagagcctaggacctggataccctgcttttcagtgactgctcttccgttttcacttacagccatattcacagatacgttgggccataaaggcggaaggagaatggaaagggaattgcccaatgtggggatgcatcatgtacagcttcttt

SEQ ID NO: 490 - DNA, 657 bp, Homo sapiens
cgcggaattcatcttaggggccaaaagtgggtcacgtggtggcccctcacttcaagagcagcagagaaaatgagtgcacagcattatatgcctctgtagtagtggccagtgaagcaagaagtggttgggaatagtgtttatcagccacccatggagtccgccacagtggggttttgtcctgtggtcagaaggcagcgtagggacagatgcatatgttctttggactggttggttcttttccccttttctccagagataaatgtgttgatctttagtagtacataaaaaataattttatatttatttatatatttatatttataatttcttttctatctgttatcctacaaataaaatgcaatattgaccatgacccacagtaagaagtacaatttggtacacacccaaacaagacaataaaacaaaggtttttatgaaactgcaccctgctaagtgggatgtttcctattctgttctactccaactgtaaatttttttaaaatgctggccgagacccactaaattgatttcaaaaattacaagttctgtgggttgtgagggttattgtgtgaaacaccactttattacatactatgtgaactaaggtggaaaagagcggtcacagcacatgtggagggacttaattagacaaaattt

SEQ ID NO: 491 - DNA, 1033 bp, Homo sapiens
attcctccctagagtcataaggtgagaaaaagaaacaaaatatttaaaaattaaaatgaaactgtcaatattcacagtttataaaatggtgtgcctagaaaatccaaaataatctagaggataaatgattaaaattcataattactgatcataaaaaagtagaatgcaaatatcaattgtctttctatataacaataaaaaataaaataattaaaataaaaattaaagataccaattacaagagcatctaaaaataccaagtacctaggaataaatctggcaaaaaataggtaaggcctctatggggaaaattataaatctttacggggagacattaaagacctaaataaagagagagagaacatgttcatggataggaaaactcaatactacaggatgtccatttgtgcagattaatctaaaggatcaatgcaatcacaatcaaaatctcaactgttgttgttttgttgttgttgttgttggaatttgacattctgattcattttttgtgtgtgacccattgcacacttagtgcaaaatccttcgttacagtgattcttctattatttctgtgacgtaaaccaaggaagcaaagtctgacaaaaatctacctggctaggccaggcgcggtggctaatgcctgtaatcccaacacttctggaagcctaaagttggttggttcacaggataggagatcgttacccttctgtgctaatttatcatacccttgtttttcttataatccaaaaaatatttaccctgtttttgttagtgtgatccataaattcttagaactcctgtaactttatggatagttattgtcttaacttgtatatgtcgtgtcattttatgatcttataaactgtcatttttctttagtctgatttaatgaattataatcttattgatagaagtttaaaatatattggtttacttgcttatttaatattcatacttataatatacaccaaatttatttatatatcagtccattacatatactatctttaaatatatttatatttatcttttc

SEQ ID NO: 492 - DNA, 774 bp, Homo sapiens
  misc_feature (1)...(774): n = A,T,C or G
cgcggaattcacccctggggtcatcacccccagcgtttgtcccttgaccctgaaggtggaagcatcttcctctcgttgataatctcaggttacctaacttgtctgctccttctacacctttataaccagaattaaatctctgctgcagaactgcctaggatgggcttggttttcctgcctgatgagcaaagaataagaagtacccagtgaccgagcccttccaggtactgggggacaggaccttcctgtggcactgggaaacctggggcagcgatgatggccagggcacctgggcctctgacatgttgctccggaggagacggttgccttgctgctgctactttcatacagaaataggatctccatatttgaaactattcccttaaaaaatcctttttaactgtggctgcacatagggataccccaggaagctttaccaaaatgaaaagtgatacccatgctcgccatagataagctgaatctgcaaaggagaaagagaaaaggaaggttttttaaaaagcaagagtgttcttctgaagttcaccaagtgattctatcatgcagccaaggttgaggaccttgaacaagaggacagagattgttagtgtaaattattccagaatgagtataatacagaccctgatatggtttggctgtgtcatcacccaaatctcatcttgaattctagttcccataatacccacgtgtcatangaaggacctggtgggaggtaattgaatcatgggagccgtttcccccatgctgcttttcttc

SEQ ID NO: 493 - DNA, 597 bp, Homo sapiens
gacccgcggaattctctcacagaccctcgtcagagtagtacggctctgcagctcagacccatttacccaagcagccgcaggggagtcctccgcagagggcgcgtgaggagggcggggagagaacgggtgcttccttccttgctttctgtcccggagttagacatccttacattagaagcccaggaggaaactcgggaagaaggagaaaattgtctgtcttgcaaaagccgaactgtttgtattcgacaaattgaaaagaaatattagaaaaacaaacgaagagaggcatttctttcttttcacttcacgaatttattcttcctgggactccccatggcctggtctttctttcagtgatctggatgcatcctggacacacggctttgcttcagccctctctgtggctaagcaattttacaaccagtttacagctatccatcttagtttcttccaaagaaagctggtttgcaagcacagctgttagtggcagattccccatcttgagaagacaaccagagaaaagtagtggtttgatttagttgaggcagcgcggggcggtggggagagtctggggtgagggtgttttttttttttatt

SEQ ID NO: 494 - DNA, 629 bp, Homo sapiens
aataccactcactatcaggagaggatccgcggcattccagctgaggtgatggagtgagacccggtctcaaaataataataatgataataataatatcctgttagtgagaacgaggacgagtgctgcctttttggggatattttcataacacatatcaaagttcttcaaaatctgcaaatctctgacgtaggaattctacagtgaagaacttcgctttaggaaatggtaaaaaataagctctaagaagtatagacagagacattctttacagcactacttataatattgaaaaatggctaacaaagttaattcccaataataggcaattggcttattaaagataaaaggcatggagtgaaaattttgtgcagtaattatcaataaagtcacaaattaatccttaatgtcacatgaaaatggttatggcatattttaaatggaaaaatattttaggtttgatctagctgcttatgtacaaatgacacactattgttggataaaattattcaattttttaaggggactgcgaagccagtttcaatttgtctgtttttgtagctcaggacttctttctaaggtttcttgtcttgggcttgagactttttcttaatgactttttctttataagg

SEQ ID NO: 495 - DNA, 688 bp, Homo sapiens
  misc_feature (1)...(688): n = A,T,C or G
ttcttcattttctgtatacgtttatgtcgtgtatatggattttnnnncacannnctaatnntnnattgtgttttnttggggggattgagaggcgcgctgaatctactcggacatacanatcttttaaaaatttgcctctaggcaaaaataattcaagtcaaaggaaccatttggatgcattcatctgttctcttcctccctacctacagtaaggagggtctcaaaccacacattcttaaaaacaccttcccaaatcattttcaactgcctccatctatccccaccggcctttatgatctttagacatgctaccaattgctgctcccatggctacagcctgaagaaagtaaacttttaattatgccacatgaaaatggtgagctccgtgagtcctctctgcctttttcttttagtgcaaatactgattcggattccatgggcggtctagctttcttaaatctccagactttcataggaggttgatcatcattctttttttctatgtggtttcattgaatgtttgcatttagtgtgtttctaaattctccaggtagaatctgtcgtattcaagatcaaagtttctgatgtttgaacttttatttattatgtgataggctttcgttactttgctgaaattggataaatttgtggttatatcatttggagtactttgtctttatcattgagc

SEQ ID NO: 496 - DNA, 683 bp, Homo sapiens
cgcggaattccactgggcacattcaagagtgaagggaatttgaaaggcaggggaaaatcactgagctgggagtaactcacagagcaaataataaaatctaagcagaaatctctgacagcgtagcttggtatgacggacggctggctgtggacagcttttgactttactgatctcatctatctttctaactgaggactaaaccagaagctaaaaatgcattcacgctgcataaaatgtatctgctaaaacactgttatcctgagtttggttctaaatctcagagggcttttcaaaaagcatcttaaaatcttaagtgcaagtgacacacaaggacccaccctgtcaatttcatattcccatcgccccttagaccactctacatttttcttccacaaataaatgaattaccagacacttgaaacgcgttcttacgccctgccaagcctcttcctcaacaagacacctggtggcatctccagctggaagtccagtgattaacctgagcatgagaaggctaaattggttcaaataccaaatggaagaatagatcaaaggattgcctgaaagtcaatggggttgaatttctagattcaaagttaatatcaaaaggtttaggattttattactaatattaacctgctcaaaggaatggcccagttagacttcattaggtattaaagatg

SEQ ID NO: 497 - DNA, 492 bp, Homo sapiens
ccggaatttacaccagaaaccacatacgcaagaagagagaggagtgaaacatttaaagtgtcagggacacacacacacacacacaccccaacctagaattctatatacaaggaaattatccttcaaaaatgaaggagaaacaaagactttctcggacaaaaacaaaaacagagggaaccagggaaatgaaaattaaaaccacagtgagatatcacctgatggccattattaaaaagccaaaaaacaatagatgttggcttagatgcgttgaaaaaggaggatgtgtacactgctggtggacatgtgccttagttccacctctggaaaacagcatgcatattccttaaagaactaaaaggctgtcccatcactggatccagcaatcccactactgagtgcacaaaggaagtcattgtaagaaaaacacacacacacacagcggtgtgtttattgcagcccagtttacaattgcaaagatatggagcccacacc

SEQ ID NO: 498 - DNA, 822 bp, Homo sapiens
  misc_feature (1)...(822): n = A,T,C or G
cgcagtcgctaataccactcactatcgggagaggatccgcggaattccagctgaggtgatggagtgagacccggtctcaaaataataataatgataataataatatcctgttagtgagaacacacacgagtgcagcctttttggggatatttccataacacatatcaaagttcttcaaaatctgcaaatctctgacgtaggaattctacagtgaagaacttcgctttaggaaatggtaaaaaataagctctaagaagtatagacagagacattctttacagcactacttataatattgaaaaatggctaacaaagttaattcccaataataggcaattggctaagtaaagataaaaggcatggagtgaaaatttgtgcagtaattatcaataaagtcacaaaataatccttaatgacacatgaaaatggttatggtatattttaaatggaaaaaaatagcaggtaagagcaagctgcatatgtacaaattacacgcaattgttggataaaaatatccaattttttaaaggggactgcagagccagtatcaaattgtcagctcatgaagcacangacttctttctagaggtccttgttttgggctgagtctttccgcaaagacttttctggaaaaggcaggcatccccctgcccgttgacagccctgaagttatccttttgcctaactttcattgggggttataaatagaagaccctctttcttcaaaaggacaaactctttcacagatgggtgtgcttctatctctggcagccagaccttacaactgggatcacaggattctttttcttttgccattttaat

SEQ ID NO: 499 - DNA, 430 bp, Homo sapiens
atcagcccggctgggctgggtgactcttcttttctccttggcctggacagggcccatgtggaggtatctggttctgagaagaggctgttccggagggtccatgtgacttcactaacacacactggcagggagggctggaaggctgggctcagctaggactatgggctatccacatggcctcgccagcatgctggcctcaggtagaagtatttcttctgtggtggctgaaagctctggaagcacgtgttccaggagaccaggcagagccgcagggcctatatggtatagccttggaggacatgcatcctcacctcctgaccctgtgtgggagaggacagcctggatggtgtagccttggaggacattcatcctcacctcctgactctgtgtgggagagaaggatctggatggtgtacccttgcaaggcgtg

SEQ ID NO: 500 - DNA, 636 bp, Homo sapiens
cgcggaattccagtttgggaagatgaaactgttttggaaatagtgtaatggacacacagcattgtgtatgtatttagtgccactgaactgtatgcttaatagtggttaaaatgataatatcatgtcatgtctattttatcacaattttttaaattctgaggttttttttgagacagggtctcgctatgttgcccaggctggagtgtagtggcgcaatcttggctcactgcaacctccatctcccaggctcaagcaatccttccacctcagcctcctgagtagctggaactacaggtgcacaccaccatacccagctaatttttgtattttttggagagacagggttttaccatgttggccaggctggtttccaactcctgagctcaagcgatctgcccacctcagcctcccaaagtgctgggattacaggcatgagccactgctcctggccaaatgctgaacatttttaaaagggaaattaaatcatatgaaatctctttgacagagctgactgcaaagtgcagcacacccagcataccttgaaataacgcttcacggtggagagaaagcgcacattgtttgaggcctccttgttgaacttgaataactcggtgaacactttctgcaaattaccca

SEQ ID NO: 501 - DNA, 580 bp, Homo sapiens
tgaattccttcactgtttggcagtaatctggaaaaccttgaaatgtgataaaaattcatcttgtttatattttaaaaaaccacaaacgtttattacctcatggtttctgtggccaggaataatggagaggcttagctgggtggttctggcttggagtatctcatgaggttgcaatcaagatgtcaaccagggatgcagaaattctttattttaaagagatttcttttttcttgagttttgctatcagtcacagttccatgtttgttggtgatattaggccagttagagaccacatttaaggtgagctttctgtttctgaggggtttaataaggataaataagacataaatgtcaggacctaaaggtgttttagaaagccatgaagtcaactcttattttataaagtgggagaattgcagcccaaaatggttattatcacttaccgaagtgaagctaagtgaaagttacatattcttggtgaatttctttttttttttttttgttggaccaagtctcgctctggcgcccaagctggattgcattggcacgatctcgactaactgcaacctatgcctcccgg

SEQ ID NO: 502 - DNA, 694 bp, Homo sapiens
tcgctaataccactcactatcgggagaggatccgcggaattctaatgaggatgagggaggaaggaaaagggccaaggcaagcctttcaaacgccactgcccacagggagagacagagtgagacactcagtggacagggccagaggtgctagaggttcggggaacatggcaaccggccagcccaggccccagtcttagagggcagctgcgaccctgtccctcctgcgggtgccacgtggggacgggaactggccctgacagctgtctgtgtctttaggagctgggacactgggtttccatccaaaacatccctgtttggatatggtggctactaactcaaaacacacataccatgggctcctttccaaaatagacacatctacaggcggaattcgacttcaaggcggggcgctgcgtaaaagcagctggacttgtgcagagtccaagtgcatgtggggtgaggggaggtgctagttgtaaaattttgtcatgcattatctatatcacataaataaatttaaaaatcaatttgttattacatattggtgaactttagtttatatattttctaagtcttttgtattatttatactgttattaaatattaatctaacttcaatataatttcattagtcttatctattacaacacattataattttaggtagcatggtcggtacatatcagttttttat

SEQ ID NO: 503 - DNA, 422 bp, Homo sapiens
ctatgttgcataggagtagtgagagagggtatccttgtgctggtttgtcttgtgctggttttcaaggggaatgcttccagattttgcccattcagtttgatagaaagatgtgagcttgtcatagatggctcttactattttgaggtatgtttcttcaatacctactttattgagagtttttaacatgaatgaatattgaattttattgaaagccttttctgtgtctattgagataatcacatggtttttgtctttagttctgtttatgtgatgaatcatatttactgatttgtgtgtgttgaaacaaccttgcatcccagtgatgaagcctacttgatcatggtggattagctttttgatgtgctgctggatttggttttgcaagtattttgttgaggatttatgcattaatgttcattaag

SEQ ID NO: 504 - DNA, 908 bp, Homo sapiens
aataccactcactatcgggagaggatccgcggaattcacttacgtgctgctctacacatttgataaacattaatttgttcaaagttcaaaataactatgcagtgggtgtcatcagaatccacattttagagagaggaaacagagacaaaagaagttgtcagtgaaggcactgttgaacagcattcctaaatatctaacaaatatttgaattcacttatgtgccgttctacacattttataaacattaatttgttcaaagttctaaagaactatgaagcaggtgccatcattatttccattttatggagagaaaagagagacaagagaagttgtcaggaaaggcaacgttgaacagcattcctaaatatttagcaaagatttgaattcacttatgtgctgttctaaacattttataaacactaatttattcaaagctcataataactctgtgaagtaggtgccatcattatccccatctttatagagaaaaaacagagccaagacaagttaaaagactcactgaggtcacacagaaaagacttgaaccctgcgatctgacttcagtgtttgggtgcctaactactattctgtatcatttccttgttgttgaatctttgcctctgttgagatgaatcagaaacacagtttttgtttaacaatcagattttatgatatagcccttctcagtaataaatggtaattttcaaaaaattattattatttaaattgctttttttcaatgacgcatgtttgtgttccttggtattggtattccgttcgccttaaattatgtagtatgttaggtttgtttatataatgcaacctcttcccgtcttggaatttataactgtccttttatttaatactttagctttttatcttttttttctcttttttgtacctctgtc

SEQ ID NO: 505 - DNA, 506 bp, Homo sapiens
ccttaaaccacatacgcaagaagagagaggagtgaaacatttaaagtgtcagggacacacacacacacacacaccccaacctagaattctatatacgcatgaaagatacttcacaaatgaaggagaaacaaagactttctcggacaaaaacaaaaacagagggaaccagggaaatgaaaattaaaaccacagtgagatatcacctgatggccattattaaaaagccaaaaaacaatagatgtgggcttagatgcgttgaaaaaggaggatgtgtacactgctggtggacatgtgccttagttccacctctggaaaacagcatgcatattccttaaagaacttataggctgtcccattactggatccagcaattccactactgagtgcacaaaggaagtctttgtaagaaaaacacacacacacacagtggtgtgtttattgcattccatttcacaattgctaagatattggatccaacccaagtgccctgtcacttattagtggat

SEQ ID NO: 506 - DNA, 637 bp, Homo sapiens
cgcggaattcattacagactaattctctcatagattcgctgctgacatatttgccacttttgctttcacatcagaacagatacgcaatgagactgaagtaacagtacagaatgtcagctgcctggtacccacgccctgcttttcacaaagcccctgaattccctgcgagggacagcctccccagctttcagccctgtggtttgggggtgctaactgaacagtcacacggtcatatgagtgaatccccctctacagggtctggctcagggagggcacaggtccagcctgagtccccatcgtcctccaggcgcaggcctccgtctcagcaggtgggacagggactcccccgtgggcctgaacccctgccgcagccattcggccaccagggggcagagtcgacctcggcctgaagccaacactaaggatgcgaaggcgagctgggcccggtgctgcaactgccaaagaattcctgcaacgccagtgcttctgagctccggacttcacagtcagctgcgtcagtgagtcccccttctgcttaagccaatgcaatgctggatttctgtcacctgcaatcggctgggccgtaagagatgcaagtcaggacacccccgatggcagtgagttgtgtggctggaaa

SEQ ID NO: 507 - DNA, 746 bp, Homo sapiens
  misc_feature (1)...(746): n = A,T,C or G
ccgctgaattcacccctttatccttatgtaatgaccctctttatccctaatggcctctcttgttctgaagtctactttttccactccagacagccactccagttttcttctatttggtgttacatggtatgtcttttcactctgcttgtacttttaacctcactaagtatttatatttaaaatgtgtttcttgtagatagaaaatagttgggtctttttgttttatccagggaatctctatcttctctttggtgtattcagatcattaaaggtcagtgcaatgattgatatgattggaataaaattggacatctttgccagttattttctatttgttccatctgtcctttgttctctccttccttctttctccatcttcttttggattaattcagaatgtatgattccttttcatgtatattattggcttattatttatccctctataacattttctcccaggggttgtcctaaggcttaccaaatgcttttttcccaccccctgtggttgtcataaaatctatctcttcaaattaccttccaataatattatgccactccatgtatcgtgtgagcaccttangacagggtactcctacttcctccctcccacattttattacatttagtcgtaaattttacttttacaaatgctatcaacccacagcaccttctactcttatgtcattagacattcaatgttttctttccatggcaactgaaaaataagaaaaacttcttttatt

SEQ ID NO: 508 - DNA, 717 bp, Homo sapiens
cgcggaattctatttttgttaaataacaatgggaacagcaagaggggaaaagattccgtggtaaaagcatgtttggggagtaacagaacctgaagctcgacccactcgctgcccccacaggtcgtgcttccagagtctgaaggctcagtcacatggttcgggggtcggggtggaaaacaggaactggccaagtatgccatcgtttttagcgcccgtaacaaatgcttggttctgctgggaggcatcatgacagatatttaaaatcaaaatcatcatctttatgataaacatctttcacacataagcagtcccaaatggttcatgaataacaggctcctggacttcaaggaagcacgttacagcgtgagaagagatgaggttactgtagtaacttacagtgaagagtggtacagagcttttcactgtaagaaactggaatcaccctaattttagttttcagcacatccgtgtgttttctgtaattccaggtatgacttttttatcgtgagccaggctgtgagaagtggtagtgtttctcccacacattacaatgtcatctatgacaacagctgcctgaagccagaccacatacagcgcttgacctacaagctgtgccacatctattacaactggccagtaagtgcttctacttgttgatagttagcaaataaaggacattcacttttcaaaatgaaatagctgtagtttaaaaggcct

SEQ ID NO: 509 - DNA, 649 bp, Homo sapiens
ccgttgaattcagcgcaagctagcggggttagctgcttttactgaagtgtctgtgcatagcagcagcagaggtcctgctccttgcagagcaaggctacctcacaggctgtgcgcatagagaagtggctcaaaggcagctccgaagtcatatttaaaccaggttttaattacatgcaaattaaggggcaggttatgcagaaaattattggaaaatggtggtaacttctggatggctgggtcactgacatggaaaggggcgataacttctggacgttgccatggcaatggtaaactgacatggcactgcggtgcgtctcatgggaaggtgcttctacctgggacctaatttagctagtgctgtgtggtccagagtccaacccccatctcttaccctcctacctcagatgcagggagtgactgtggcatagttttcaatcattttatgtcagatgccactggaattgagagaggaggtgcatctggctttggtttgtagagggttactccagtggccacacataaaaaaaacaggagtggaagcagggaccccactgtgagccatgttctgatgcgagatgatgggggcttccagcaaggctaggtggggagaagtgcacaagcttagggtgtgtcttcaaggtggaatcaa

SEQ ID NO: 510 - DNA, 788 bp, Homo sapiens
cgcggaattcagttttaagtgtagtgaaacacagtctgagctttgtctctgaatgtgaaagaagtgtagagtttaactttccttataggccaagatgaagttcggaatccctgatagctcagtaggaacctttgtaaggttgtcactgactgttgcaactctttcatgcagtcacaaagcctcagccctgagtttagtgattctgttgacagtgagttgtgttgttttcttttctttttttcttcagcttttaagttcagcagtacatgtgcaggatgtgcagatttgttacataggtaaacgtgtgccatggtggtttgctgtacagatcatcccatcacttaggtattaagaccagaatccattagctattcttcctgatgttctccctcttcccccaccccacccccaacaagttgtcaagttgtgtcattttctgtaaagtgatacttattatttttttctttttctttctttctttctttctttcttttttttgggggggtgggcagaacactactctgaggcccaggctggagtgcatcggcatgatcttttctctttgtagtctattcctttctagtttaatttttattgtgctttcaccctttaaaattatctggaattaataagttgttcacttatatgcctcgttatcttttttttgatttcagttaaaattatcttttcatttttgttgcccattttgtttactttttaatttcttatattaatttcgtactctcttgttctttccatattattgtttttttatatttataatacat

SEQ ID NO: 511 - DNA, 759 bp, Homo sapiens
ctccctctcctagtctaagaaagggatgacagatggcacctggaaaatcaggtcactcccaccctactactgcactttcccaatgggcttaacaaatggcacaccaggagattatatcctgcacctgcctcggagggtcctatgcccacggagtcttgctcattgctagcacagaagtctgagatcaaactgcaaggaggcaacaaggctgggggaggggcgcctgccattgctgagactagattaggtaaacaaagcagccaagaagctcgaactgggtggagcccaccacagctcaaggaggcctgcctgcctgcctctgtaggctccacctctgggagcagggcacagacaaacaaaaggacaacagtaacctctgcagacttaaatgtccctgtctgatagctttgaagagagtagtgcttctcccagcatgcagcttgagatctgagaatgggcagactgcctcctcaagtgggtccctgacccccgagtagcctaactgggaggcacaccccagtaggggcagactgacacctcacacagccaggtactcctctgagacaaaacttccagaggaacgatcaggcagcaacctttgcggttcaccaatatccactgttctgcagccaccactgctgatatccaggcaaacaaggtctggagtggacctctagcaaactccaagagaactgcagctgagggtcctgttagaaggaaaacttacaaacatgaagaacattaacccccaaaacccca

SEQ ID NO: 512 - DNA, 726 bp, Homo sapiens
cgcggaattcaccaacaacacatagcaatcctcggtaggtatcgctctaacaaaagaaccacaaatacatgtcaaaagccactacagatgaaaggagaaacggacaaatccagttatatttagagactcctctctcagtaatcaataaaataagtagacagaaaatcagtaaggatacagaagactgactaacattatcaacttacttggcttaatgacatttgtagaacgctccgtcccacaacagagaaattacatcctttttcagtgcacataaaatatacaccgattagaccatactctgggccataaaataaacctcagcaaatatgaaattttgaaattctataaagtatgtcctcttaatggtaatggaattgaactagaagtcaaaatgaaagaacgataactatttgggtgataaaatgttctaaaattagattatgatggtttttacatgactgtcaacacactaagaaacattgaactgtgcactttaaaggagtgaactttataataaataaattactagaactaataagtgagtttagcaaggtcacagaaacaggttcaacataaaaaaattaatttgctttgatacaatagcaatggatgattgggaatttaaattttaaatgctattttaaatatcattttacatatgatattaaatatctaaaacattaccatgtataataacaccaccaaaaaataaatatttccctt

SEQ ID NO: 513 - DNA, 654 bp, Homo sapiens
tcgcccgactgcgtcccctgagctacgcctgcattcaccgcactgattcaagacagccgcatccattcaccaggctctgtgtcatcaacatcaccctgtgacgtgccaacatcagggatcccccactctgagctcaggaagaccgtcctaggatatttttttaaagcacagtgagagagaaataagaaggccagtggtagtgacagacctaagagtgttctgtccctcttaggccccacgacgcgcaccgctgcgtgctgcctgggagctcattcttaggtttttaggtctttaaagaggctgagaagaggagggtattccggatgctttgtaaactgacagactttttaattaacataacaccgtgatattatcacatccaacaaaactaacaccaatcccttactatcttctaatacccagtccataataaatgtatctgcttatctcaaaaaaaaaaaaaattcagttggttatgttcaaatcggaatctcaacacggtttagacaacctttggtatttctcttaagtctctcttctcttttattttttttaacagatgcattaaccttaatgaatcaggaatatatcaaaagagctagcaagccgggttcagtggctcacgcctgtgatcccagcgctttgggaagccaa

SEQ ID NO: 514 - DNA, 578 bp, Homo sapiens
cgcggaattcaccgttctggtgggaacagtttggttttgctagtttaagcatcacagaactggcattagaaacagcatacattcagggttgtgaaatctcaagtggaaattcctactctgtattcaatttttgtgcaacattttcaattctttgagctcaaatgatgagacaaagttgaacaccctttagataatgaatatactcagacaatagatataattgtagcattttaatttcatgtaggtccgctgttagttgaaatatacagcaaaacgtgagggtgctgactctggcttaagacctggggggttctttttttattctatgtagcgaggaccttgtagtaaacagatgaaatgaactgcgtctatgcctaacattaaatagcaagaactggctcctccctcctggcagaaggcatgatcctgtgctccgtgaggaagatgtttatggggcagagcatgtggccggtgttttatgtgtcctggtgttccacggcagcagtaaaacgtacatcaatgaatcattgtttttgttttcctctctgcctaaatggctttgttaattaaaactttgt

SEQ ID NO: 515 - DNA, 662 bp, Homo sapiens
attctccttgcatgattgattccaatatagaagtatccccctccatggattgattaggatgactaaaacgatagctttcagcatggctggctgaattccaaaaagtcaagaagagaatggaaacggaatgccagatgacgactcatgagcaagggaggtgcccagatggatgtggggagcacacatttcaggggcacactcagctgcacggtgtcccccaggatttagctctgctgccagcgtgtcttctgcagacaggcagcattccctcgggtggggctcacagacccctgaggcacgctgacatccagcttctgcacctgccatggactgtgaccctgagtgtcccagggagcccatgccaggatgagggaggtgacacaaagtggtccccccttcagtgcttaccctgtgaagctctccaggaaaaaatcagctgggagaacatggatgtagaaggccaatttgatatttcaagaatacttacaaatagctttcatttatcttgtgctgttcctgccttctttttgccatgaataacagtgttctttgcttagcggaaaatgctactcctaaagttttgttcatgcttagatggagtaagcagccacatgctccgcggctgaaagacacaacagcgatgatggggccactaaccgatg

SEQ ID NO: 516 - DNA, 1100 bp, Homo sapiens
cgcggaattccacttagcagagataattagagtggtcaagttcatagagacggaaaatacaagggcgggtgccaggggctgggatgagggggaagtggggagttcgtgtgtaatggggacagaggtttagttttacaagatgaaagttgttctggagatggatggtggtgacggctgcacaacaacatgaatgtgcttcatgctgaggactgtacccctaaaaacggtgcagatcgcaaattttatgttatgtgcaccttaccacaatgcaaaagaacaaataaaacgggaatatatgtatcaatgcatagcggatctctgggaagctctacagtgggaggggatttgaggaattaagggtcagggatgctactaaatctctaatcaattaatacctaatatttgttttccttactatttctataaaattaattttttaatctacactattgtaattattttaatttctttattatatataagacgttgtaaataaatatttctacataattctaatatttatttcattaagtctttaataaatgcatttatttatatttttttattatttatatatttttttattttttatagtctttatttatatttttattttttattctatagatttatagatatatatttattaattatttctttatatttattaatattttatatttatttattcgttttaatcatatttgattatttaatttttatattcattttcttgtaatttatcaatatttatatattattatgtcttattctattcgtaatttatatactttcttttactgtttttctatattaatatcatatttgtcttccttatttatctctttattacattttacacttatgtatatttattgtatttattctcattattatgtatttatttgtatttatatttatatattattatttacatttgtataatatatatatatgagtatattaattctatatgtcacttctttctgttatgtttgtatattactcatatgtttcttatctctctcattatattttttctctatgtatgataatatttatcttatcttatattacctgttattttatattacgattct

SEQ ID NO: 517 - DNA, 763 bp, Homo sapiens
  misc_feature (1)...(763): n = A,T,C or G
aattctgacccgagggacatgtctacaggtttgtaaacagattattgctgtggtgaagacagctttgatgatttcaatctggagacagaggtccacactcaaataagattgtacaccttggagcaggttaatcttttagtctgagacccacccgcaaactctaggctccctcctgagccctgctcagaatttcatgaaagaccttgcctctaacacaaagcaactcattctcttccctttccttcctccctccctcccccctgcctgcctctctccctcctttctcctttcctttcctttccctttctttccttttctttctgttctctttctcttttatccctctctcttcattccttctccctctcttcttccttctttccttccttcccctatttctttatctttcttttctttatttccttctctctatccattccctctctcttttctcttgctctctcttccctttgtttttctttccttcatcttttccctttttcttttgttctttcctttcccttcatccctcccacccccagctttctttctaattaactgtcatctccgtgctccaccccaccccactggaccttctggagcagtgcttgtctctgctcaccgcttctttcctctcccctcgtgccgngcacacagtaggagctcaccacatagttgttaaaacaagatgttcaggcaggagcccttcagaaggttggggcaccttgagcacagtgtcccccttttttggcttaaagctttg

SEQ ID NO: 518 - DNA, 719 bp, Homo sapiens
cgcggaattcactgctgaattctaccaacatacaaagaagagctggtaccaattctactgaaactattccaaaaaattgaggagaaaggactccaccctaactcattctatgaagccaacatcaccctgatacccaaatctgacagacacaacaaaaagagaaaactacaggctaatatccctgatgaacacagatgcaaaaatcctcaataaaatactagcaaactgaatccagcagcacatcaaaaagacaattcaccatgatcaagtaggctttatccctcagatgcaagattggttcaacatatgcaaatcaataaatatgattcaccacagaaacagaactaaaacaaaaaccatatgattatctcaatagtgcagaaaaagcttgcaataaaatccaacatcccttcatgattaaaaaaaccctcaacaatctaagcattgaaagatgtacctcaaaaatagtaagaggcatctgtgacaaacccacagccaatatcatattgaacaggcaaaggctggaagccttcaccttaaaaactggaacaaggcaaggatgcctgctctcaccattcctgttcaacactggagtgctatagccagaacagtcaagccagagaaagaaataaaaggcattcttataggaaataagaagtcaaattatctctcttcactgatgaaacggcatccatttaggaaacaagaagtcaaattct

SEQ ID NO: 519 - DNA, 778 bp, Homo sapiens
  misc_feature (1)...(778): n = A,T,C or G
ctttcataatgaatgacatcnattgatttttcacatgttaaactaaacttgcaatcccaggataaactctatttggttaagatgggttaccttggccaggcatggtggatcaggcatgtaatcccagcactttgggagactgaggcaggcggatcatggttcaggagtttgagaccagcctgaccaacatggtgaaatcccgtctctactaaaaatacaaaaattagctgggtgtggtggcatgtgcctgtaattccagctactcatgaggctgaggcaggagaatcacttgaacccaggaggcagaggttgcagtgagcagagatcgcaccactgcactccagcctgtgagacagagcgagactccgtctcaaaaataaataaataaataaaaataaaaacgatgggctttcttttaaatatattgttggatttaattttccaaatggtgtttataattttttttgtttatgattcatagtgacctacaattttgttataatgctttagactttggtattagggtaacctaatgcctaccctaaatgaatgaattgggtagaggtcactcccttcatttttttggtaataattttgtcaaaaattgtgttttattttgctccacaataatatttcaagaatatcttcataaaaatttattttggaatttatcttttgttttaaacccattcaacttaaaataaacttttctatttaaaaacatttgacccactctaattttttttattttgttttataatgttttttagttttttat

SEQ ID NO: 520 - DNA, 485 bp, Homo sapiens
ctttcactaataccactcactatcgggagaggatccgcggcaattcactgccgcactcacaaagaacaaagcaaagactccgtgaaatcccaatttctcctttcacgtgggatgtgcgtatcatagtgggatgtccaaaagctttagtgttaaacacactgacctcaggctctcccttcccaaagcttcgtctgaccagtctacctggtggttcctgaaggaaccccagggatttggtgggtggttccccaaaagtgcatgcctgtaggaagtctgtccactcttttctgggtacatttttcttcataattcaaaaatgtgacactcattgaagcattctatttagcaattttacacgcattccttaagtcctacaggagttttttggagtaatctcctgaacctgctgcttacacacagtgacggttctggctctttcctcatagtcaaatagaaagtatttttagcagcagtttcattctgtt

SEQ ID NO: 521 - DNA, 635 bp, Homo sapiens
ctcttccttgacgctcgctctgggtctttgcagcattggagggacccactgcaacattacagatggagtcccttctctttccttgggttcctatctcaccttgctatatctgagggttttcttttgacaagaatgcacaattctataaattggacacagggaactaattataggcatgacatcacccctgtaattcactgttggactagcagcccttgccaaagcaataagataagaaaaaaaagaaatctaagaacaggctaagaagaaaattatcatgatttgcattctatatttataaaaatagcaaactatgggacattttttttagattaacatttcttttttatgcaacatctgagtgcctatggccgtgtacccatgaacacagataagacagatgaagtgagaaatatctcacaaattaaatcatgggaaactagttttgggtttttagggtgatagcacaaattatattgaattgttttcctgccattttagcccctctgatgctagcttcttttcacctttttttaccatcatgactggccaggctagctggcatagatctctgtttctcagtgtggctttgactttcacattttgtgctctttcttgagtttacccccctattg

SEQ ID NO: 522 - DNA, 818 bp, Homo sapiens
gtcgctaataccactcactatcgggagaggatccgcggaattccacttagaggtaattcttttccacaaaggggccttccagtcatcccacagaagtggattcctacattaaatccccaagtcaccatgtagtcttgcagtttcacattatgttagtggcaaatcatgaattatgagcttaaaataggtgtaaactgacaaaactgcatccagtgatttcagatcccatgttaactacatgaattgttaaaccaatgttaaagtcgtttccacagcattggattaaattagataatgggttgcttgggctcataactgctttaacatctataagatgcattcgctagtatgatgctaaggcatggcagacataaaatcaataagagagcttctaataaatgaaagaatatcaactgcttcatgtgttttagtggagaaatcatgaaattcacattctgtggaataattttggtcagccagagtagggggtagagggccgtgggcagtgtatacaggctcagtcaaaagaagccaaatatttttcatgtgataaccacataagcaaagttaccttaagacaaatcatgttttctttccaaaagtcacttgaaaagtaaataaatgtataaaagaaaattagtgcattaatatctttttcaagacaattatataacttgcaataagttaggacaagatttgtttaaaacataacaggaaaatataattgacagattatggctaaaatgaatatgagagtgttcttctccttaatagtacttcacttaaaatatgacatctttaaaactgctggtgaacca

SEQ ID NO: 523 - DNA, 573 bp, Homo sapiens
aatttacaccagaaaccacatacgcaagaagagagaggagtgaaacatttaaagtgtcagggacacacacacacacacaccccaacctagaattctatatccaccaaaattatccttcaaaaatgaaggagaaacaaagactttctcggacaaaaacaaaaacagagggaaccagggaaatgaaaattaaaaccacagtgagatatcacctgatggccattattaaaaagccaaaaaacaatagatgttggcttagatgcgttgaaaaaggaggatgtgtacactgctggtggacatgtgccttagttccacctctggaaaacagcatgcagattccttaaagaactaaaaggcggtcccatcactggatccagcaatcccactactgagtgcacaaaggaagtcattgtaagaaaaacacacacacacacagcggtgtgtttattgcagcccagttcacaattgcaaagatatggagccaacccaagtgcccgtcagctgatgagtggatggagagaatgtggtatgtctacaccacggaatactttgaaaactctactgtagaaaagaatg

SEQ ID NO: 524 - DNA, 717 bp, Homo sapiens
gtcgctaataccactcactatcgggagaggatccgcggaattcaaaggctgaagttcagacaataattgactcagaccccagctccgtcagtccagtactgacccagattcctgaataagagatagaggggtcgggtgaaggcccaacaccaccacagtacagatgctgaaattcacggtatttccatcatgcagaaacttaggacctctgcagtgactagctcatccccctatttgaaagtggactcaggccgggcgcagtggctcatgcctgtaatcccagcactttgggaggccgaggcgggtggatcacgaggtcaggagatcgagaccatcctggctaacacagtgaaactccgtctctactaaaaatacgaaaaattagctgggcatggtggtgggtgcctgtagtcccagctactcaagaggctgaggcatgagaatggcgtgaactctggaggcggagcttgcagtgagcaaagatcacgccactgctcttcagcctgggcaatttagcaagacttccgtctcaaataaaaaaagaaaaaaagaaaatggacttaagactggatgaaaattttaatttgcccttgggcaggaactttttagcgaattattaaacagcccattttatgtgttgctggtgataaactaggcactaggaattcgatcaataagtttaataggaaaatatttttttttaaatttttgcttaat

SEQ ID NO: 525 - DNA, 574 bp, Homo sapiens
  misc_feature (1)...(574): n = A,T,C or G
aaggtgactgcacccatctttaaacatggggcttgtaactcagctcacacccgaccaatcaagtagtaaagggagctcactaaaataccaaaaaggataaaagcaggaggtaaagaaatagtcaatcatctaacgcctgagagcacagcgggagggacaatgatcaggatataaacccaggcattggagccaacagtagcaacccccttttggtcccctcccattgtatgagagctctgatttcactctattaaatcttgcaactgcacactcttctggcccgagtctttnccggctggagctgagctttggcttgccatccaccactgctgatcaccaccgtcacagacccgtcactgacttccaccccttcggatctggcagggtgtctgctgctcttctgatccagcgagacacccatggccactcctgactgggctagaggctggccatttgttcctgcatggctaagtgcccgtgtacatcctaatcgagctgaacactaggcgctgggttccacggttatctttcataacctatggtttctaatatgagtattaacacttaccacatg

SEQ ID NO: 526 - DNA, 643 bp, Homo sapiens
cgcggaattcagttcccgtagtatgaattttggaactagataaagatgattctaacctgcatatagaagaataagcatgacagacaatgtgggtgaccaggtagcagggggtgcctgcctcagtcatgcacccagaaaacatggttcctcagcaaccttcaaccctggcccaaccctcgacatgaggccccgtggtccaggcttctgcatgtcatgtactgggacaccagctgtggctcacttgtgccccagagggggacttcctgtggcccagaaactaggaccctgctggcctgagcaaaccagcagacttctctgccattccaaaaggggcaaggacagccttctccaatgaggtctgagcccagcctggggaggggccttccagcttgtccttccttattttttctatcccagtcctagagtagcctatattttatagttaatctcttatcatcatcatcatttacattaaactttccttgtttaaatcactgtgcaatttgtgtctcccgattgtacccaaactagtacaacaggtaagtgtgttttgaaaactaacaatgaattactttacacaacaaaatttgtgtataatctatttattatgattgattccaaatatattttgaaataaaaactt

SEQ ID NO: 527 - DNA, 444 bp, Homo sapiens
tcagccggctgggctgggtgactcttcttttctccttggcctggacagggcccatgtggaggtatctggttctgagaagaggctgttccggagggtccatgtgacatacactaagaccctggcagggagggctggaaggctgggctcagctaggactatgggctatccacatggcctcgccagcatgctggcctcaggtagaagtatttcttctgtggtggctgaaagctctggaagcacgtgttccaggagaccaggcagagccgcagggcctatatggtatagccttggaggacatgcatcctcacctcctgaccctgtgtgggagaggacagcctggatggtgtagccttggaggacattcatcctcacctcctgactctgtgtgggagagaaggatctggatggtgtagccttggagggcgcttatttttagctattggc

SEQ ID NO: 528 - DNA, 637 bp, Homo sapiens
taataccactcactatcgggagaggatccgcggaattcgaggcttcagtgagctattatggcagtactgcacccagcatggccgacagggcatgacctcgtcaataaaaaattgagaaataaattatttttcaaaggatgaaaagagctatgaagatgatgtaacagtacggtcctagttacaatagtacattgtgactaggattgaggaggagctgttttagataggggcctaggaaaagtgcaggatattgaaaccgacttgaatgattatgtgaagttctgggggaagtgcactttaagtgcatgggccctgtggcagattgagccaccaagttacactgagaagggagaaatggagagcttgcgggtagaggatggtggggagacttattcatacattaaactacctctattcagttagagatatcttaacaaattattattgaggtctaagggataagattagtgatctcattttgttttaagttattgatgattttatttatcttcattattaaattaggcccaaacctattggttgccatacatattacattctgtgaagatttaatttctataattagatattgattcttatttactatttttaataactatatattgtgttgtagtat

SEQ ID NO: 529 - DNA, 909 bp, Homo sapiens
cctacctagcagtacaaggtgagaaaaagaaacaaaatatttaaaaattaaaatgaaactgtcaatattcacagtttataaaatggtgtgcctagaaaatccaaaataatctgagaataaatgattaaaattcataattactgatcataaaaaagtagaatgcaaatatcaattgtctttctatataacaataaaaaataaaataattaaaataaaaattaaagataccaattacaagagcatctaaaaataccaagtacctaggaataaatctggcaaaaaataggtaaggcctctatggggaaaattataaatctttacggggagacattaaagacctaaataaagagagagagaacatgttcatggataggaaaactcaatactacaggatgtccatttgtgcagattaatctaaaggatcaatgcaatcacaatcaaaatctcaactgttgttgttttgttgctgttgttgttggaatttgacattcagattcattacttttgtgttacccatttgaacacttattccaaaatccatagttacagcgattcttcaatattttaatgtacgtatactagggaaattaattcttacaaatatttaccttgttatttacgtctcttgttcttaattcttataatttctgtacttttgaaggtcatatcttgttgatataatatttataataccatatcttctcttattaccttataaaattcccttgtcttctcttaatattttatattcaaaattgatcttaagcagttactcactttattcattttcttttatttaataatcattatttttctttattttctaattattattttttctttttttctactatctattcctctttccttcgttaatatctaatcttgctcttttctttcttttattta

SEQ ID NO: 530 - DNA, 619 bp, Homo sapiens
ccactcactatcgggagaggatccgcggaattctaacctggggctgtctggagtgaaagtcctgtgatttctccagataggtcaaattagctttgacatatatgaataaatgctgctggtctgattgagtaagaaagggctgtcatcttaagtactaaatatgttcacaccttttaaacaacctcgttgatagtgtgtatcttttaggtgtctatttttctgtctttgggaatttcactgaaaacgactctcccactgttttacttagcctcctttagtagcagtttttattgggggaatatcccagatatggtttggctgtgtccccatccaaatctcttcttgaattatagctcccacaattcccgtgtgttgtgggaaggacctggtgggaagtaattgaatcatggaggtgggcctttcctgtgctgttctcatgacagtgaataagtctctcatgatctgatggttttattaaggggagtttccctgcacacactgtcttctcttgactgctaccatgtgatatgtgccttttcaccttttgtcatgattgtgaggttttcccattcccatttaactttttttccatctatcctctttcttttgttaaattcct

SEQ ID NO: 531 - DNA, 825 bp, Homo sapiens
gcggatatacattcccttgctttactagaaagaaaacagggccacttgggatgggtctttcactgttcatggcagatctcctgtccaaagatgtggcctagaggaatgagagacaaatcggggtgcctgtgtggaacgtgcagggcgtgtggagttgggggggttctgggtgtgaaagtggttgatccatcttgatgtccagtctcactcacactgtacagcacatttaacctttttcatcttggtggtgctaatggattaagggctttcatcgcatgtggtgaagaagcatggttgcaagcacttaagtcctgttgttcagcctttaatttatcagcattttttattatctttcattattcttgatattctttaatcccttcacttttgaatgccttttaagatgtggttatttattcattatataattctttgcttatttatcgcttattttattgattctttattttttttttgtttttttgtctatttattttttatcttgttatattttttttttttcttcttattctttttttctttattactttattttttattattctttttttattttttttatttttgttttgttcttttttattcttgtttttatcatttttctttttctttattttgtgttttctagattttttttttttgtttttcaatacctgttcattttttttttgtttctttttgtattatttacttttcgtttttatattatttttatcagttattattctttttaatttttgttttttatttctttttcttcatcattctatttttttgttacttttctttcttctttcttttttc

SEQ ID NO: 532 - DNA, 831 bp, Homo sapiens
cgcggaattcttggactcaagacatcctctggtctcagtctcccaccgtgttggaattacaggtttgagacactgttcccagcctagattctttttattgttgaggagtactccttggtgtgaacgtaccggtttgtctgttgcccgctgatggaccatttggattgtttccagttctttgttttccatctttttttttaataagggtaacacatgaacagttcacattgaaagatatccaaacaacacagaaatacatagagctcgttaagagttcctttgccctttctccccattcatcagctccccacagctaccaaatttggaattcatttttctgggtttctttccatacatcagaacatgcattctcagtgagggcgatatctccaacaagggagtgaaaattagttattggaagaagggtgaaaaaacttaggcattacagtgatttgtggcctcccgaagatcccagttcctgaacagatgtacagtgtggtatatctgtgtacagctgtagtattaaaattccatggggaggcaattaggagagaaacttatacagatgttccttagcggggccgtggaaaaataaagatcaagaaacaacagttgaatgatggattggggaattataaccttattattttgtgtctgatgaagctactctttacatttttttgcacttttttctcaatgcttaaaatttatctccactcctttctttattatgatttttctatctataaggtttattgacacattactatcttgtatttatcatatagtattttaattgttctcttgtataatgcatagttctttatttta

SEQ ID NO: 533 - DNA, 545 bp, Homo sapiens
cgcggaattcattggaaaactacagttagaaatcgccattgatttctttttttttctttctttattattattattctttaagttatagggtacatgtacagaatttgcaggttagttacatatgtatacatgtgccatcctggtgtgctgcacccattaactcgtcatctagcattaggtatatctcccaatgctatccctcccccctccccctaccccacaacagtccccagagtgtgatgttccccttcctgtgtccatgtgttctcattgttcaattcccacctatgagtgagaatatgcggtgtttggttttttttcttgcgatagtttactgataatgatgatttccaatttcatccatgtccctacaaaggacatgaactcattattttttctggctgcatagtattccatggagtcgttgatttctttcaatatatcatacttaacatttgtgattccagacattgcaactttactgagagacaagcattgtgctaagtgctttaaaatacttactttcttcttacgaccacccacga

SEQ ID NO: 534 - DNA, 678 bp, Homo sapiens
cgcggaattcagtggataaaaactcagagaaggcaccagaggccattgttttcttcctgtggggtccagattttaggcagaaaagggaacctcagagaactttatcctgtgctttaagggagacagaggattaagagagggtaggagggtgatggttggaaggtcagagagaccttgaggctgcttattcagttcagcatgtcaagggaacatattttgagatgttggtttctgaacctcaacacaagcaactcactaaggccagcccagattcaaggcaagggcattagactccacctctccagtggagatgtaataaggtcactttggcgaggacgtgagcaggcaggagagactgttgtggccatctttggaaaatgcagtctaccacatacgttcacctcccagagtctcaaggttctttatctagaagaaatggagatgtaataacaccaacctcacagggctgttgtgaaggacagtggagttagtggaattaaaatactgccttatcttactgtaagactcatttcttggtagagaccctataaaaaaaggcatcttgtcccgagtaggtaggcatgaggacatttgtcactgcatggtttgaaaaagcaaaatacatgaaaatgcaagctctgtgatcatctcattatcattcatcactatcattcttac

SEQ ID NO: 535 - DNA, 878 bp, Homo sapiens
actaattgtctctattatttttgttcatttactagatttgctgtcgctttcacagagtcaatgaatgaaatggcacaagcgcagtgggtatgagtttatctggtgagggtattttggctgtgctgatgaaattgcagaattcgagaaccgaaaggcagccttactgagctgacagtgttcccatggacggtgcctgttgcggccacaatagtgtattatgtttcccatagattgattttgtatgtgtagatgcacctaaaacgtccctgatattttttgatgttgttattgaatgacaaaagtagcccagttatggttgtatgttgttgttgtagttttgatgctagagtttttttctattaatttaaagaccttatagtttatttgctacttgcttttaattatttatctattatattatcttttttaaatatgtaacttttttgttaaatcagacttttcctctttttatctatcaaattttttttttatcttatgtcgttttataacatttctttattatatttttattttcttttttttattattgtttttattttatttatttcagttttttttttaactcttttttataattttatctattgtgacttgttatttattatttttatgattttttccattatactgtctagattatattttttttatgtaatttggttttcttgattttatgattttatcaattgttttattgtttatcactattatttttatgatacttttttattaatcttatttattttattataatttttttttataattgtattccattatttttattaattatttttattaatattaatttttatttatttttatgatttttttatgattattctttgtttattatt

SEQ ID NO: 536 - DNA, 946 bp, Homo sapiens
atccgcagaattccactgctatgaatgcaggctccagatattaagctcaacaataatacacatggctccagcaaggctgctaaaagtagcacagtttgagaaagaacttacttgtgcattggtgaagaccaactctttttttttggagctctgtgtgtgtgtgtgtgtgtgtgtgtgtgtactcacatagaaagactggccaataaaaaaactcatattggtgaacaaaaaatgcttgcacaaaaacaaaagccataaacacacatttctatatgcacagagcatctgtgatagtacacaaaataataactgctgtcacctctgggaaagagacctggaagactacagatctcggatgggccaggtgctgtggctcacacctatatatgccagcactttggaaagccaaggacggcagatcacctgaggctcgggagtttgagatcagcctgtgcaacacgggaaaattctgcctctatttttgtaaaaatacgaaaaatacccaggtttggtggggcacacatgttattcgacctactacaaaggcttgagcatgaaaaatactttaaccctaaaggcataagtttgaatgagcttaaatcactccacctaacttgattcctggtgataaaacgagacttcctcttaaaaaaaaaaaaaaattttggtttgggagagagaaattactcttcacttttttaacattttatatttgtttgaattttttactaccaaactatgtaaaaattttttccataatcactgtttttcctgtaaaattcctccacctcatattgtgtgtgttaacaataggttatagttctttcgaaatattttaaactaaagtgaaaaaattttctttattttgtaacgagttctctattttccttaagtgattcctcattttctttttaattttatattttgttttttagatatttttaaa

SEQ ID NO: 537 - DNA, 764 bp, Homo sapiens
cgcggaattcacaaaaggcattcaccaaaaggcatggcatggagagatctggatgtgggcagaacatcaactttgttcattacaaagtacaaaccaaatattcacactggatgctgtaaaagtttcagctgtggccgggcatggtggctcacgcctgtaatcccagcactttgggaggccaagacagatgaatcacctgaggttgggagttcgagaccagcctggccaacatggtgaaaccccatctctactaaaaatacaaaaattagctgggtgtgatggtgcacacctgtaatcccagctactagggaggtctgaggcatgagaatcacttgaacccaggaggcggaggttgcagtgaaccaagattgtaccactgcactccagactgggtgacagagaaagactccgtctcaaaaaaaaaagaagaaagaaaagaaagaaagaaagaaaaagaaagaaagaaagaaagaaagaaagaaaaagaaagtttcagctgtggaaaatgttaaggggaggaagacagtgctaggacaagttgttaggagggcacctgatgtggtcagggaagttagcaaaggccacgcagaggaaatatggcttgaccggagacttaagatgcatcagaaaggcttggaatttttatgaaataccctgcagagaaaagcacaggtgccaagacttataacaaaaaggtgagagccttccaaaaactgtgcttttaaaaccaaaagtgaaaaccaaaaacacaattttttttgaga

SEQ ID NO: 538 - DNA, 730 bp, Homo sapiens
ctgcagagagccatgatcatgcgactacacttcagcctgggtctcaacagagcgagaccctgtctcaaaatgaaagatagaaacagagagcaagagagagagagagagagagaatgagaaagaaagaaagagacacacgagcttttgtattgttggatagtttttaccacatgcatatattatctttttaaattgtttgaggtgtgtatgtgtgtgagtgtgagcgtgcgtgtgtatgtagatacacaacaaatgggaccaggtctcttttctgattaaaacctgcaaagagctcaccgtattcagctcaactgtcagtggcatgagaatggggaccatttctatcctgcttagggaatcaactaatggctgagcgtgtctctgggataaatgcctcagcccagaacacagcttaccctgcatggcagaagtgcactccacttcaaccaccctcccacagcatgacctctggcacatcacgcttccttcttgagtctccacgccgctgacatgacacttcctagtgccagcttcttccagagaacttttctgacagccccagtttctacacaccacagtctttcaaaatttccattttgttttgagcctatttttgttataacccctctgcactgcatttatagggaagatggggtcacattttacttggggcactgattacaaaatcagtacatacatgaaaatcaaatcacttaaaagtacccttgaa

SEQ ID NO: 539 - DNA, 784 bp, Homo sapiens
cgcgcaattcaaagatgagatgtgtattaacagatatcaaaacatattaaaaatataacaattaaaacagagttggcagtgaaaaaagagatagatagatcaaaaccaaatacaaggccagaaacagacccaaatacatttaagaatttgacatagcataggccaggcctggtggctcacacctgtaatcccagcactttgggagtccaaggcgggcggatcacaaggtcaggagatcgagaccacctggctaacaccgtgaaaccccgtctctactaaaaatacaaaaaattagccgggcatggtggcgggcgcctgtagtcccagctactctggaggctgatgcaggaggatggtgtgaacccgggaggcggatcttgcagtgagccgagatcgatccactgcactccagcctgggcaacagagcgagactctgtctcaaaaaaataataaaaaagaatttgacattgcataaaggttagagaagtggttaaatacattgaaaaagctagtttcctaccttatattcatatatttcaaaagatggttcatgagctaaataaaataatgtaagactacaagaaaattctgtaatgaattatgaaaacaagcaactgggctcattctatgaaaggttttttgagtattaaaaacttatgacattttttggaaacccttaggccactgtttgtaaaaggagataataaaataaaactttttaaattaatttttaagattatagaagttttttttatttttaaaattttataaaacttctgataat

SEQ ID NO: 540 - DNA, 780 bp, Homo sapiens
  misc_feature (1)...(780): n = A,T,C or G
actcactatacggagaggatccgcggaattcaggatcgtctcggaagggaagggctgacgggcttcttcctgggtgccgggtgtcagctgcaggggtgctgtggcatatgtcatggcccccaccccaggcttttaagaaaggcccctccaggcaaagtttggcacccgatggacacggccccgctcgcctggggagtgcgccccaggcttctcagacagcagcggctcagggcctggacttgtcttcttgggggcggggtggagggggggaatnnnantnnnttttttttttttttttttntttttttttttttttttttttttttttttttttatttttttaatttatatatataatttatttttattatttttattaattttttttattatttattttttatttgtttattaaaatttttatattaaaaataattaatatttttatataaataattaatattatattatgtttaaaatattatttttttgtttatttattgattgttaagtttaattttttatttttttattttatgattatgtaaattatttgattatttatttttttattattatgttttaagtttatagattaatttaatatatttttttgtaatatatttatttattaattattttgttaatatttaatataattgtgttattttttatgctattgatttattttatcttttctctagttttcatattaaagcttaaatattttatttttgttttaatttatttactattttgttaatatatatttctataatt

SEQ ID NO: 541 - DNA, 611 bp, Homo sapiens
attacctgaaaccccatcacagtgttctacattttcgttgaagtgtcatttatgtacatgaaagagtctaccaggagaaaaacagcctggtatagcctgtttcattgagccggatatccgccctttctgtttctctcctctgtccagtgtttcctgagcaccaactacgtccaggtggcccgacaggcactggagacacagtggacacaaagctgagaggccctggcttgtgtggggctgacatcccagtgggaaagacaagcgttgatcgggtgaggatataaaaatgcaagcttgtgatgcatgggtaaactgaggctcacggagatgactcagccccttgtgagtacatcccacactctgggacagagcgctcattctgtatcactgcgctggggacagggacagagcggttcagaaggacagaccccgccctggccctcctggagcccactccacaccccagcaagcatcatgcctagaagttggcacctgcccggcaccacggttctccctgcactgctctgcccccgcctccacagtcttactgttagatggtggatgcaaacgttctttgaaagatgcaaagcacagtggctcatgcctgtaat

SEQ ID NO: 542 - DNA, 622 bp, Homo sapiens
tctcccaaaatgtcttgatcacgtggcctggtgtgtgtctattctcattcattgtgctgatcacattgtgggctcttccaatctgaaaacactatctttcttttgaagacattttcttaaattatttcattaatgattcatcctctttcttttctctgtgtcttttttctgctattgacatattgaacctcaaagccatcctcttaatttttttctcctatcttccacttcgtcttttctctgcttcttaggaaatttcctcaacttcatccatcaaccattccaccgactttccattttgctatatttttaatttccaagggctcattttgtccctgctgcgtgttctttttttaagatatagcagtcatttttgtatcatgattgcaatatcttctcttatctcttagtgaatgcgaatgattctctgtttttggttttgttttgttttgagacataattttcgttctgtcaccatgctgcactgctatggcacgatcttggctcacttgaacctctggcttctgggttcaagttattcttctgcctcatcctccctagtagttgttactacttgcattctccaccatgcccagctttttttttgtttttctagtacaga

SEQ ID NO: 543 - DNA, 541 bp, Homo sapiens
cgatccgcgcaattccagcttagacacttactagccgtgcaggaacttgggcaatttacataatcctttgtgtctatttctcattctgagaggtgggattaatagtaccaccccctgcctttgtgttaaatgtgtattaaatgtgtcaatatatttacagaacttagaagggtatttggtgtggagagagtggactctaaggattttatattattatgtataatttacatgttatacttaaagtgataaatgtttagtatttgtgtgggggtgttaaacttagaagatacattttttcacattactttgcattacttaattttcccctcatcatttacatcctggagaacttttcacattattacagatacctattctgactcattcttatttactgttgcatataattccagacaaactatggataaggtagccattccctgttgagaaggtgaccccattttatttttcattactgggattttttcacagtgaaataatgtgttttttataattattccaaaacagcttgtgttaacta

SEQ ID NO: 544 - DNA, 602 bp, Homo sapiens
  misc_feature (1)...(602): n = A,T,C or G
ataccactcactatccgtagaggatccgcgcaattctcaaggattcatgaaatcatgggttattcgtaaaacatttttaatgtttttcatattatagacgcacttttattcagatgtttcttatcanaaatattcactcaagttgcatttacaaatatctgtagcctatagtgaacaggctaacactgttaaacaccagcacgcattcaaacacagtaaaacatcagtttctagaaaacatccttttaggattccatattaagattagcagtgatgcatagaagcatagaactgggtgtcaaaattgccaatttagggacttacttgcttccaaggtgtgttatttttgatacatccttcctggagtgtgcataaagtatactctgactgcaagtgtattatctttcttttttttaactacattgacttacttttggcatcttacagagccaccagcagacatcataattctgctcacaactacaatcaagactgacccatgaaataattcgggttctacttttacttgctcctattccagtatccctaaatgttaacttttgtgctggatacccttctttgtgttccctgtacttacggat

SEQ ID NO: 545 - DNA, 760 bp, Homo sapiens
cacccactataaggagacgatccgcgcaattcttcctttgaaaatgggcttttcttttctaacacacggctaggctacaaattttccaaacgtgtgctctgcttttggggtaaatataagaagacagcttttggtgatttctttgctccaacatctgagcataggttgttagaagcagacaggccgcatcttgaatgctttgctacttagatatttttttctgccagatacccccaagtcatcattttgaagctcaaacttccacagattgctagagtataaacacaatacagtcaagttttttgctaaggcatagcaagggtgacctttgcttcaattcccagtatattttcattttcatctgagacctcatcagcctgtacttcactatccatattactatcagaatttttttcaagatcatttatctaatctctaaagaattccaaactttccctcatgttcctgtcttctgagcccttcaaattcttccaacctttgcctgttaccaactttcaaaattgcttccatattttcaggtatctttatagaaacagaaccagttggagggtccttagaaaaagtaaaattgagcttccaaatgatcaataatcccactgctgggtgtgtaccccaaaaaaaaaacatcagtttatttaagaaaaatctgcacttcctacctttgtgcagaaatgtttacaatagccaagatttttgaaccacctaagtgtccatcaaaagaaaaagggttaataaaaag

SEQ ID NO: 546 - DNA, 689 bp, Homo sapiens
cgcggaattctgattttactctgatcagccaaaaactacattttccagcgtcccttgtagctaggaacaattgtgatatcattttggtcaataagatacaagtggggagaccacactggatggattttaggaacagctctttgaatatggatgactcaactgacatgtgtaatttactcttcagtcttcccctttcttcctgtctgaagtgcagctgtgagggtcggagccacggcagctatcttgagggcacgtggatgagaatctcagcctaaatctggcagaggaaaaagccactatcttctcagaatctggtatcctgatgatttaatgaagaccataaaacagtcctggaatcccttgaaagtttgtatccagactactttcctacgagagaatagtattccatcactccattttctaaaaaattgttatttgggttttctgatacatggtgtcaaaactaatcatagctaccgcatgcatcatcgaaaggtatgacattctcatatatatataattatattttattttatactcaggagtttttaaaacaggataatatggtcttatttgtatttcaaaaaaccaagcgtagcagtggtgtgaagcaacttggtgaggatgagcactgatatgcaagacttttaatttcagcattatttgtgataatgaccattcaacaacac

SEQ ID NO: 547 - DNA, 580 bp, Homo sapiens
tagccttacagctgctgctgtggttaggcggggcgtgtgtgtgtgggtcttcgttttccacagtcctcgcccagcctggtttcactcattaaatagatgtttatatagagtctgtttcatctgagtttgtaactagtggatcagattttgcttcttccttgaagaattttggactgccgttcgctatggcaaagatacttcagagatattagtgattgggatttaaactccagacagaactgtttgaactaagagggattatagcagagtgattgcatctgaccctcttggttattaagcattccattatctttctcctttgcaaatgaactcagggtgacccaggccattcatgactaatagttcacccaccttcccgtcctctttgcagcagggcatcattccctctggccttgagctcactgagctatgggaactatctcagaaacagcttacttctggacatccaatgatgtgagaaaaatcagtccctctttggttaagccactttacttaggttttctgctgtttgcaacaagtgcagtcctcactgatagagggttcaagagcatgggttctt

SEQ ID NO: 548 - DNA, 789 bp, Homo sapiens
caataataccactcactatacggagaggatccgcggaattcaccaaccaactatctgctgccttcaagagacttacctaacacataaggactcacataaactgaaggtagaggggaggaaaaagacattccatgcaaatggacaccaaaagcaagcgggagtagttattcttgtatcagatgaaacaaactttaaagcaacagcagtttaaaaagacaaagagggacattatataatgataagaagccttgtccaacaggaaaatatcacaatcctgaatatatatgcacctaacactggagttcccaaatttataaaacagttactactagacctaataaatgagatagacagcaacacaataatagtgggggacttcaatactccactgacagcactagacaggtcaagacagaaagtcaacaaaaaaacaatggacttaaactataccttggaacaggccaggcgtggtggctcatgcctgtaatcccagcaccgtgggaggccgaggtgggcggatcacaatgtcaggagaacaagaccatcctggctaacatggcgaaaccccatctttactaaaaatacaaaaaaattaaccgggcatggtggcaggcgccctgaattcccaactacttgggaagctgaggcatgataatggcatgaaccccggaagctgaactttgcatgagccaaaaattgtccacttcacttcaactctggctaatgaaatgaaaattcctctttaaaaaaaaaaaaaaattatacccttggaacaaattggactttaac

SEQ ID NO: 549 - DNA, 746 bp, Homo sapiens
gtttcatattcctgcctttcatttctagaggcagcttgtaggttaaaagtaattatggtgcaacttctctttactaggctaagttaaagaggagagtatcttttctataatctttccattcggatcctctttacaatgatctcaaataattgcaactctcctgttttcttcttgttctagatgtcttttcgcctgaaactgagctattaaactgagaccgagtcctccatctcttccctctccacctggatgggtcaactttcaaggaacttaattacttttgtaacagaacaaaggctacggaaaatgtctgtaaaatttggaacacaggctatgaaattagaatccaagctctctgcaaagaaatattgatttagttattctgacagcacgtggtcaacaggtttctccttaagatccccctgcttccctctagaattgtgtatggtgtgtgggtggaggagtttatttatgcttttatcttttttttcttatttgtttaatttacttttcatctttttacgttcatcttctacatgtattattttatcacaatatcctttgtaacatctatcttcttattttctatttcttatctttattcttttttatttttattcatttttttcttttttttttttttactctacttaatattattttattcattatttttctttcgtttttttttttctattctcttcctttttacttttttatacaactttttccttacttttctttat

SEQ ID NO: 550 - DNA, 619 bp, Homo sapiens
gacgatccgcggcaattcctagaatgtctccttgttctttcttagtcttcctgaacttatccgtatttggtaacagtgttcatgcatgtgaggaggcatatggctaaggctctatctatgtacctgctgattatctatctactaattagctatcccatccatccatcagtccgcccgtccatccatccatctatccacccacccacccacccacctttctacctaccttcccgcctagtcatatctttcaatcacctatcacttggttcctcttttctactctttccttggtctcttagctgagctcactcatatgttcagcttatctagtctttcagtttgatgtgaagacctgtaagaagatgaataagttaaaacaattatgagatcctaaatcagtctattcatgtgatacaaggaaaaataaatctgtcttgttttactgggctctctttgacttatttaagtttttataccaagtcatcttcatctttgtacaaactaaacccttatcttctacccttttaagtggctgggctaacaaaaattttttctattggttctcaatctacatttgtacttcctgtactttgacatttgatttccctttaaaatttta

SEQ ID NO: 551 - DNA, 527 bp, Homo sapiens
ttcctggttattttagaggcagcttgtagttaaagtatatggtgcaacttctttttactaggctttttaagaggagagtactttttatagtttttctccgatcctctttccatgatctcaataattgcaactctcctgttttcttcttgttctagatgtcttttcgcctgaaactgagctattaaactgagaccgagtcctccatctcttccctctccacctggatgggtcaactttcaaggaacttaattacttttgttacagaacaaaggcttcggaaaatgtctgtataatttggaacacaggctatgaaatttgaatccaagctctctgcaaagaaatattgatttagttattctgacagcacgtggtcaacaggtttctcctcaagatccccctgcttccctctagaattgtgtatggtgtgtgggtggaggtttcttctatgtcatttcttattcttttattcctgatttttttcttttattttgtctttttatatatctttattatattttgtttctttc

SEQ ID NO: 552 - DNA, 730 bp, Homo sapiens
cgcgcaattccagtgctggggttcgatttgggaaagccgtgggaatttcacaccgatgtgacgggggcttagaagcaggcccaggaaggggtgtttccagctaggggaagagtgacaggcagtcggcatttcgacttgtaccagaggcacagccacgagccagtggctcccttggcccaacccggataggttctgacaacagattgtgtgtctgcagcagcctgcgcttcaggagcccacagtttctcattggaaaggaggagttaggaaactaatggcttattgatatgggagaagggaaaattgataagattagtgacaagaaaagcagctttggacctaagtacgttttctgtcatatggtctcttgggcacttcatcttctacacacccaccatttatctggtcacatcaatgaggcatggaactgcattgtgacttaaattaatattacttcatgctgcaggatttaaatttctatgggcaattaaattgtggttttaaacaatttatgaatattgggtttacccggacttactttttaatattgatctttataccttctgtataagatgtttgttcaactgctctgttgattgatataagtagacctctcttttcattttgtttgtttttttttatctctttatattaaaattagtttattacttgagttaccggttttttttgtatattatttttcattggtttgattttcctcctatatctt

SEQ ID NO: 553 - DNA, 726 bp, Homo sapiens
gggcaatgccaagaaccctcctgggttaagccccaattttggggcttatctgccctgtgtcattaaagatatgaattttactagagactgtttataatagtgattttgctttgagaatcactttaatttgggttaaatctaatatgaacttgtaatgaaattttgagacagaccttaccagtggggcagctgaggggcttttgtaggataatatttaaacacagtcagtatctctagaatttccatgtagtaagagaaagagcaagtatagtattgcaagcgtggccctttccgtctcagacgtgtttcattttccaaaaaggttgtgaatggttttgttgttatttatttctgactaatgtaaaacatgttgctcttgatacctctaaaacatctgtacaaagaaagacattcaggttttatctgcctttagaagttcctcttaggctataacatttctcaggaacataaatctgcatttaaacattcttatagggaagtgtttgtttgattattaattatccttgtgatattatccacaaaacaaattttacttggtatgcttattttaaaatattgtattccatcctattaatttcatggtatttttccttaaatatctatatttttacatttatatattagaaaaaaaattaccgtttcttttaatctcataaatgtaaatttatttttattaaaacacatttttatgtatgtactataatt

SEQ ID NO: 554 - DNA, 658 bp, Homo sapiens
cgcggaattcttaacctgtgttattacttggaggaggaatttcaccactacgtatgctggagagatttcagagactttgattttagatttatttgtttatttgtagccctgggacaaaattcttattttccttagctgagaaatatattagcaagcatcagctctcaattttacatattcatggtagctgatataaaacggtatttggcttccagaggcattatgtgttttatgtaaatgtgtgtcttgggcattttctcaagggaaaagctgtttcatcacttagtccttactccctaagaaagcacttgatgagaaccatgaattaatatcacgactgagcgagaggggaccagggaaaattgcttcagcaattgcttggaaggctcccagaatttggcctgggcatagctgcagaaatctttggaaacagaagactccgtgaaagtaaatgaggaagtgtgaattttgccacttagttgcactaagcagtttatactcactgtagtccacaatccttcaagttactcacagtagtccaaagtccttcaagttactcactgtagtccaaagtccttcaagttactcactgtagtccaaaatccttcaagttactcactgtagtccaaagtccttcaagttactcactgtaatccaa

SEQ ID NO: 555 - DNA, 475 bp, Homo sapiens
gtgccatcctgacaaatttcatttttttttgtttttttttgagacaaggtttcactctttcacacaggcttgagtacattggcacaatcacaggtcactgcagaagagacattctgggttcaagcaatcctcctgcctcagcctcccgagcagctgggaccacaggtgcaggccaccataccccgctaattttttttttttaacgtatagacagacactggccatgttgtccaggctggtctcaaactcctgacctcaagccatccttctgtctcggcctccaaaagtggtgagattacagatgtgagccaccgtgtcctgcctggacaatttcttaagtacccagtgtgtgtgccggggactgaactgagtgcaggggacaccactgctgtggaggccttcccacacgtgacaacgccagggaggatgggatgcgggtgtttggagtggtaaaaaaaatacgccgggcgacatg

SEQ ID NO: 556 - DNA, 684 bp, Homo sapiens
cgcggaattcacccctggggtcatcacccccagcgtttgtcccttgaccctgaaggtggaagcatcttcctagcgttgataatctagaggttacctaacttgtctgctccttctacacctttataaccagaattaaatctctgctgcagaactgcctaggatgggcttggttttcctgcctgatgagcaaagaataagaagtacccagtgaccgagcccttccaggtactgggggacaggaccttcctgtggcactgggaaacctggggcagcgatgatggccagggcacctgggcctctgacatgttgctccggaggagacggttgccttgctgctgctactttcatacagaaataggatctccatatttgaaactattcccttaaaaaatcctttttaactgtggctgcacatatggataccccaggaagctttaccaaaatgaaaagtgatacccatgctctccataaataaactgaatcttctaaggaaaaagagaaaatgaaggttttttaaaaaacaagagtgttcttttgaagttcaccaaatgattctattcatcatccaatgttgaagaccttgaacaagaagacaaaagatttgtagtgttaaattatttcccaaatgagttcttatttcagaccccttaattttggtttgggcctgtgtcattcaccccaaaa

SEQ ID NO: 557 - DNA, 858 bp, Homo sapiens
ctattagcacctgtctttctaaatcagtagacacaggaaatgatcttctttaattggtgtgaatgagcactctttaaaaatgtgtgagatctgaccatacagatgagtgggtttttttttttttttttttttctattttagagatggagtttcacgtttgttgcccgggctggagtgcaatggtcccatcttggctcactgcagccttttacctcccgggttcaagtgacaattttctggcctcagcctcccaagcagttgatattacaggcgccagccaccacacctggctaattatttgtatttttagtagagaccgggtttcatcgtgttggccaagctgattctgaattcctgacctcagttgatcacccaccttggtcttccaaagtgctgggattacatttataaaccactgcccctggcccagacgtgtattatattgagtttatttgataaatgcactgttgaacatgcattttttgttcacatagaaaaaggaagtgccttaattacccagctttaaaaatgtctttaaaaaataggaagtctcactttttaaaataaacaaattagaaagtgttttttaacaagaactttaaaatggaccaacttgatttcaaaagcacttatttctctcttgattttgccggccacacgctccttctaccttatgcaaaaaccttccacttttttttttaatttgttggcaggtgtatttacatggattggttaacagatgtaccccattgtttgtatttacatacccttttggattagctaaagtgttatactttgcttttatctttaattaccattcttttaataagtctttaattctttttctttttttttttt

SEQ ID NO: 558 - DNA, 789 bp, Homo sapiens
  misc_feature (1)...(789): n = A,T,C or G
tactcgtgttacatatgtttngtgaatatataataataagtattctatgcgtgatttgtataattatggtcannaaancangnggnnnnnnnatgatgggatgggtgagggggnggnaaataaggagggagtgaatggcgctgtcgattaaccacccactatcagtagacgatccgcgcaattcaccaaccaactatctgctgccttcaagagactcacctaacacataaggactcacataaacttaaggttgaggggagggaaaagacattagaggcaaatggacaccaaaagcaagcgggagtagttattcttgtatcagatgaaacaaactttaaagcaacagcagttgaaaaagacaaagagggacattatataatgataagaagccttgtccaacaggaaaatatcacaatcctgaatatatatgcacctaacactggagttcccaaatttataaaacagttactactagacctaataaatgagatagacagcaacacaataatagtgggggacttcaatactccactgacagcactagacaggtcaagacagaaagtcaacaaaaaaacaatggacttaaactataccttggaacaagccaggcgtggtggctcatgcctgaaatcccaacaccgtgggaggccgaggtgggcggatcacaaagtcaggagatcaataccatcctggctaacatggcgaaaccccaactctactaaaaatacaaaaaaattatcccggcattggtggcaagcgcctgtaatcccagctacttggggaggctga

SEQ ID NO: 559 - DNA, 563 bp, Homo sapiens
taataccactcactatcgggagaggatccgcggaattcagaaaatcttcatgttcatgtaaaatcctctcattttctttttcatttggcaattactagatggatttatttataaggtcatttatttatttagatagggtcttgctctgttgcccaggctgaagtgcagtggtgcagtcttggctcactgcaacccccacctcccaggcttgaatgatcctcctgcttcagcctcccaagtagctgggactacaggtgtgtgccaccaggcctggctagttttatttatttgtttatttttgttgagttggggtctcactatattgcccaggctggtctcaaacgcctgggctcaagcaatgcacccaccttggccttccaaagtgctgggatctcaggcctgaaccaccgtgcctggcctggtaaatactttattttattattttttatttttatttttttcttttattattatgcatttaagtttagggtacatgtgcacattgtgcaggttagtatcatatgtatacatgtgccatgctggtgtgctttacccactaactc

SEQ ID NO: 560 - DNA, 687 bp, Homo sapiens
  misc_feature (1)...(687): n = A,T,C or G
gagacgatccgcgcaattcctttatgaccgtggctcangggagaatgggaggaggaggtcatagtggcattcttgctgctgcttctgcttctagaagaattcccaatcggcaaagttccatattttgggggattatgttctgggccctaggatcatgaccacattcagtaatagaagtcactctaagattttataaggccagaagggtttgaaatgtcaactttcaatcacattggtagtgccctaccaatttgttcattcatttgttcattcatttatctattcatattcattttatttgtaactaatatgtggggaaaggtatgtgttcaaaacgtcttttctgaaattagttcaaaaaaccgtgcagagctgaaaaccagtgtaccgacagcaacaagacacagcgtttctatttctggggaacgttaagtctgtggttgcctggcttcttctgggaaagttagcgggcatctagattaagaaataagtaaatttaaatggctagtcctttacacactttgcttactgagcaaatatttgattggaatttttcttaacctggggcttcttggagtatcattagctaattttttccagaagggcctcatgcttttaagcatcagtttatgcttttatgcttttatttaatgaatcttttttaataacttaaaacttatttttttt

SEQ ID NO: 561 - DNA, 928 bp, Homo sapiens
gcccaaagaacacatgcttaataggaaataaacatgtcatctaagaagggcaaattaaaacaacattgagatataagttttgctaaataaatagtatttcatgtaggaggaagctgcacgaaaatgggtatcactatgcatagcaagtggaattttaaactggttaagctttctggaaggcagtttggcaaacattatgaaaaaggaatacaatattgcatatcctttgatttgaatttatttctaaaagttgacctgaatgagttcattaaaaatgtgtgcaaagatttttgtacgaaaatataaaccataggttattttataacaaaaaagctctttaaattttaatcttgtgtggttgtgtcatggagatatacggggaactttttgtttggtactaaagctatgatgcatcttttattcctgtgatttcttcacacctatatccaatgctttgggaagtcttgtcttataaggctgacgctgctgcttcactgtttttatctcgacctggacagttcagtactgtcacctaacattttccatgtgcactctcttatcccactgttgcatgcttgcagctggtcatttggattctggaattgctcactttttccatccttccttgtagttagatttaatcacttggcagagctacttgactgtttgtctttgataatatgtggtgttttcttgtacataatgtttagtattcgatgatttttctatcttttattaatgtatatttctatgcttatcatttttattttgatgcttttacttatttattttgttctttacttatttctttcgttgatcatctgatgtagtatgtcttaatttctatattcgatcgtttgatcgattatcaatcgttcttgctatcgtctacgatttgtattataaatctctttatgtatcaatgatt

SEQ ID NO: 562 - DNA, 448 bp, Homo sapiens
ccaaaggttccaaagcttacaattgattctggagcagtttattccaagaaggcaccactacttagctgggccgtgaggtctggaagagagaagaaagactatgaaggcgtgttaacgagcataccacctctgcgacaaatggaactcagtcctgcgaggactctgagggagatggggtcagtggtgtcctggtgaacggctctgaaggaaactctgatttgtagtttacatgcattgaatggtgtcctctcctaaattcatgtccacccagaacctcacaatgtgactgtatttggacatagggtctttgtacatgtgattattaatgttaagtcatgctgaattagtgtgggccctatatgcagtgactggtgttcttgtaagatgcagcaacatgcaaaactggatggaaggcactgttaagattggggtagagactggagcatcg

SEQ ID NO: 563 - DNA, 448 bp, Homo sapiens
agcttagacacttactagccgtgcaggaacttgggcaatttacataatcctttgtgtctatttctcattctgtcagatgggaataatagagaccaccccctgcctttgtgttaaatgtgtattaaatgtgtcaatatatttacagaacttagaagggtatttggtgtggagagagtggactctaaggattttatattattatgtataatttacatgttatacttaaagagataaatgtttagtatttgtgtgggggtgtataacatatattatacagtatttcacatcttttttaattactttatttttttttcttttatatacatcttgtaaaactttccacatataatacagatacctcttctgtcttatttttattttctgtaccaatataatttataacatactatttttaatgtttccattctcttttgagaaagtgatcatt

SEQ ID NO: 564 - DNA, 804 bp, Homo sapiens
  misc_feature (1)...(804): n = A,T,C or G
ataataccactcactatacggagaggatccgcgcaattcctggaatggcccaccaaagatgttctgcgccagttcccagaacatgggcatgggatgagagactgctgtcatgaagatgttatattgtnacatggcacaggtgatagagtgatcttcctggattatctgggtgagtccagtgaaatcacatgagtccttaaaagctgagcgatttctctagctggtgacagaaggggaaggtggagagactggaagcatgagaaagactccatgcattgttcctagtgttgaagccgatgaaggtagggtggggactgagaaggaatgcaggtggacttgtggaactaatataggattccatccctttacctgtccagaatttgctacctacagtcctataactgcaaatatttggattcttgtcttcacccaaataattcttgaagctatttctttctcataacatcctggtatgaacttaagcattctacactgtgattttagtcttttgatacttttgtcatgaaccctacttgatcctatctttcttactgtgttcccttaaatgctttccttttttcaacttctaaatgtatagttcttctctactttatctttaataattttcttcattttttattctttagcttaatacatcttgcttttttttagatctcattctcttactaaacttttctcattgtatttttcattatcgtatacttttttttattaatatccatcctatttcttttattatttttttgtttttttattttcttatactgcattttaatttctatc

SEQ ID NO: 565 - DNA, 655 bp, Homo sapiens
tccctacaccctcgcaaagactaggcattcaccttgaccttgaccacacatggcacagatttgccactcatttgacacgtatttactgagctgaaagaggcactggaaagaggaggtgtactagtgaacacagcacacaacattcccagctctacattctagtgaggaaactcagacaactaacaaataaatgaaacctgtaaatacagtgagcagactattggctgttgatcctgagtccccgaacaataaaacacagtaaataacttccttgaggcaaaactacttatggtgtctacaatgctaagagtctggacacggataaagcaaagttgtataaggcttaccatggagataactcgatccctagcatattggacaagttcctggttaaaatcgaataatctttcatagtggacttcatcggtcagctaaccagcagccatcatgaatcacgttctcccctacatgctggaggtagccgtgtaacctgtctctagccattcaaatacactggggacttctgatagatgcataaagagagaggtacacacagatagctctcctgcattgacaggtctgcacccgtgtgacctgcatttacccgtaataatgggaggatgtgataacatgagctgcagcagcctttctgtga

SEQ ID NO: 566 - DNA, 872 bp, Homo sapiens
catgtgcaccctctacacattttataaacattaatttgttcaaagttctaaagaactatgaagcatgtgccatcattatttccattttatgggagaaaaagagagacagaagattttgtcacgaaaggcaaccctcaacagcattcctaaatatttagcaaagatttgaattcacttatgtgctgttctaaacattttataaacactaatttattcaaagctcagaataactctgtgaagtaggtgccatcattatccccatcttagagagaaaaaacagagcctagacaagttaaaagactcactgaggtcacacagaaaagacttgaaccctgcgatctgactccagtgtttgggtgcttaactactatcctgtatcaactccctgtggtgaacttttgcctctgttgagatgaatctggaaaacagcttatgttgaacaatcagattcacgagaaagccctctcaggaaaaaaaggcaaatttaaaataatataataataaaaagccttttccaatatcccatgttgtctcctgactattgtatccgtctagtcaaaatgagaaagcaacgtgcgtctcacattatgcacccctcacccgtcctgaacacagactgccttaatatttaatactttagcctcttaaactttatttcacttaatgaactcaagcaccttaaatgcatgcctgaacacaccatatgtgttcatttgaaaaaccataaatttaatttttttttttcctaataaacactcttgatgctgttatttaactataattgtagattacatatttgttttccaaaataacacatctttaagtgtcttaaatatctaatataaaatatctatatctggtgtttctatgta

SEQ ID NO: 567 - DNA, 862 bp, Homo sapiens
acgatccgcggcattcaccaaggtgcagaggctcctctttggaagttatgcggtaagctctttataaatgcaggcacaggctgaatcagatagaaaagctctcatgatttgggcatgcttgcaagatttgaacccttgtgcagggattggggtcagagcaaatagaccacgacagcagatacagattaaccccctgtgctgtggagattcttctgctggaggagtttcctgcatctcccataacacggtaccacaaactgggtggtactttgcttaaaacaacagcaatttattctctcatggttctggagaccagaagctgaaatcaaggtgtcagctggccacgttccctcaaaagcctctaggggagaattccttcttgcttctggggattgctggccattctgggcttgtggctgcctcactccagtctctgactctatctttacaatccgtctttcctctgcatatttcattggcttcagatggtgatgatagaaggatgccattcattgaatttagggctcttttgactccaaaatgactttatcttaattaattcacttgcaaacagttgttttgtaaataaggtcatattctgagggttgggtgactttaattttatgggaactacattcaactcattatatgtgccaaggattacttttttttctaccaccaaaaattcaaagcaatacttcccctttttttgttcttcttattggtgcgaaattccccattttttggttgattgtattttttctaaaaagggttgcaacttactacatttttcctatcttacctgtttttatagctttggccatggttgggcttttggaatttttttttttcttctttcgtc

SEQ ID NO: 568 - DNA, 601 bp, Homo sapiens
cataatgtcttgatctcttggcctggtgtgtgtctattctcattcattgtgctgatcacattttgggctcttcctatcttaaaacacaatctttcttttagagacattttcttacattctttcattcctgattcatcctctttcttttctctgtttcttttttctgtcttttgacatattgaacctcaaagccatcctcttaatttttttctcctatcttccacttcgtcttttctctgcttcttaggaaatttcctcaacttcatccatcaaccattccaccgactttccattttgctatatttttaatttccaatggctcattttgtccctgctgcgtgttctttttttaagatatatcacccatttttgtttcatgattgcaatatcttctcttatctcttagtgaatgcgaatgattctctgtttttggttctgttttgttttgagacagagtttccctctgtcaccaggctgcactgcagtggcactatcttggctcactgcaacctctggctcctgagttcaagtgattcttctgcctcaacctccctagtagctgggactacacgcatgccccaccatgccccgctaatttttg

SEQ ID NO: 569 - DNA, 620 bp, Homo sapiens
  misc_feature (1)...(620): n = A,T,C or G
attataccactcactatcacggagaggatccgcgcaattcctggaatggcccaccaaagatgttctgcgccagttcccagaacatgggcatgggatgagtgagtgctgtcatgatagtgttatattgntacatggcacaggtgatagagtgatcttcctggattatctgggtgagtccagtgaaatcacatgagtccttaaaagctgagcgatttctctagctggtgacagaaggggaaggtggagagactggaagcatgagaaagactccatgcattgttcctagtgttgaagccgatgaatgtagggtggggactgagaaggaatgcatgtggacttgtggaactaagagaggattccagccaataacctgtcaataattggcttcctcagtcctataactgcaaagatctggattctgccaccacccaaattattttagaagcaaattctttccttacagccttctttttagaactcatgcatccaacactgtttttttacacttctgatacttctgtgcattgaacttcattttgtgcccatccctccattctttttatccatataatgttgtgccttttttatttactaaaatgtgtagcccgtttttactttgc

SEQ ID NO: 570 - DNA, 778 bp, Homo sapiens
atccctacaccatcgcaaagactaggcattcaccttgaccttgaccacagatggcacagatttgccactcatttgacacgtatttactgagctgaaggaggcactggaaagtggaggtgtactagtgaacacagcacacaacattcccagctctacattctagtgaggaaactcagacaactaacaaataaatgaaacctgtaaatacagtgagcagactattggctgttgatcctgagtccccgaacaataaaacacagtaaataacttccttgaggcaaaactacttatggtgtctacaatgctaagagtctggacacggataaagcaaagttgtataaggcttaccatggagataactcgatccctagcatattggacaagttcctggttaaaatcgaataatctttcatagtggacttcatcggtcagctaaccagcagccatcatgaatcacgttctcccctacatgctggaggtagccgtgtaacctgtttctagccattcaaatacactggggacttctgatagatgcataaagagagaggtacacacagatagctctcctgcattgacaggtctgcacccgtgtgacctgcatttacccgtaataatgggaggatgtgatagcaggaactgcggcagcctttctgtgagcatgagtacttctaccgaggtgcaaaagccaatgaggttggccaaatacaataacttggacgcacctcttgtcttgaaatgcttaacagctgaactaactgtgggatcacctactttttgg

SEQ ID NO: 571 - DNA, 753 bp, Homo sapiens
ccgctaataccactcactatacggagaggatccgcggaattcaaacctgggaggtctgcctcggaggacaagctgtcgcttgtgcttattcttgtcctgaaaggaaatacacccaatggatcaccccagctggcagacactgctccaccctggttcccgttaaatctctttcactgctctatatccctcggtaggtgtgttagccagctagggctgcctgaacaaaattccacagactggttggcttaaaacacagaaatttattttctcaccatctgaattctggaaagtccgaggtcagggtgctgtcaagggtggtttctggtgagggatctcttcctggcttgcagttcgccaccctctcggcatcttgtgtcctcagagggcctttcctctgtgcatggagagagagaagctcctggtgtcttgtctttttttttttttcgagacagggtctcgctttgtcacccaacctggggtgcagtggtgtaaacaggactcactgtagccttgacttcctgggctcaaacgatcctcctctcaagcgatccgccaagtaactgatactacaggcatgcaccaccaagcccagctaatgttttcatttttttgtaaagatagggttttattaattttgcccaagattggttcaaaattcctgacttcaagtgattccacctaaccttgggccttccaaaagtgctgtaaatttacaaggtgtgagcccactgaacttgggctttttttatcttt

SEQ ID NO: 572 - DNA, 993 bp, Homo sapiens
  misc_feature (1)...(993): n = A,T,C or G
tccagaagtagcacctggaacaaaggttcgaaagcaaacaattgattttggagcagtttattccaagaaggcaccactacttagctgggccgtgaggtcgggaagggaaggaagacattgcangcgtgtgaacgagcataccacctctgcgacaaatggaactcagtcctgcgaggactctgagggagatggggtcagtggtgtcctggtgaacggctctgaaggaaactctgatttgtagtttaatgcattgaatggtgtcctctcctaaattcatgtccacccagaacctcaaaatgtgactgtatttggacatagggtctttgtacatgtgattattaatgttaagtcatgctgaattattgtgggccctatatgcattgactggtgttcttgtaagatgcagcaacatgcaaaactggagggaaggcactgtaaagatgggggcagaaactggagcaacgctatcacaagccattgaatgccggaagccaccatgagctggaagaggggaggcaggatccttctctagagcctttggagggagcatggtccactgacaccatgattccatacttctagctttcttaactgtaaaaaattacttttctggtgttataagttgttgctatttttttaccacagctttttgaagcttttgcatgttgtgcgatatttgttggattcttattccctacctaaaattaatgttccaattgtaatacccatctttttgtgtttgtccctcatcttaagtttaattgatatcttattgtaatgtttgtttttattttacattaattttcatccttctctttttctctctactttttttttgttataatatatttctgtatgatatttttttaaataatatcttttttctatttttttttttattttcatcacttgtttgctttttaattacatatttgtttgttttatgtatatttcattattatatatatttattaaatattatctatctcattt

SEQ ID NO: 573 - DNA, 789 bp, Homo sapiens
  misc_feature (1)...(789): n = A,T,C or G
tatacggagaggatccgcggaattcgctgcgacttgcatggcctttctggtggtacaaactgtgttttctttgctaagtatcacttcagatcacgagaggtattttacctggagaaaaagatgggggcacgccacggggagcatatgttcaccgagctgcatggaggaggaaagtgagagaagcatccggcaatttttttttatttctcctctttaganttttatncctccntntccccccccccttcttctcttttacatttggttgtatttattttggttgtttcttttcacctcttttttccttccggatccgggtnaaagagtcgatgtgctttaaattttcttttttttcccctcctttttctttttttttctctttcctttctttgtctgtgttcgtccacccccgcccccgagtcttttaatccctcgcacaagttgcttttttccacccttattcccctaccttnccctttattcctgtgttgtgtcgcgcgtgttttgtgaccacctcgcaccccctcttcccttnttanccccctacaccctatctaccatctctctcctcttccaattatcgtggttgtttatactttttatttgttgttgttttctcttgttcttttttcctcatcgataagaagaaggattctcttgttgacctattttttttctctctttctcttcactcctctccctcttcccccacggganntnntattatttatttggttgagagatggtgtttccctcccttctaaaaaactcaacaccgtccgctctact

SEQ ID NO: 574 - DNA, 166 bp, Homo sapiens
cgcggaattcctggatatttctttttttctaatcagaaagacagtagcaacacctggtgccgaagaagtgtagagatgctagtttgtgtttagagcatgctcagagttgaccttctcaaatcaagaggaaaataaagagaataagagaggtttgtggggggggggt

SEQ ID NO: 575 - DNA, 429 bp, Homo sapiens
  misc_feature (1)...(429): n = A,T,C or G
tccctttcttaacacggtgtatttgggattcacctgtgttttggagtgaagcagtcgttcattcctttttaacttctgagctctgttcccttgtatacgcataccacgagttatgtccattcagcagctgctggacattgnnnnnnnccccantttgggactattgtaaataaaactgctttgaacattcatgtataagttctttggtgatatgtttcatttctcttgggatcaataccatgagtgggaaccgattaggtggatgggtaagctttccttctccctagggagatgattgattctcttctctttntaatagaacaaaagaactgtgacactaaaaagagtaaggtctatttttttttgtattccctcaccccccttcccccccccccccccccacccccccccccatctcctctcatcttc

SEQ ID NO: 576 - DNA, 731 bp, Homo sapiens
  misc_feature (1)...(731): n = A,T,C or G
cgcggaattcacactctgttattccacatcgtctattgattacacaggtcagccctatacgatgagggaggacgtctcaaggtgtgtgaatgccacgatttgagaattattgggcattttattgaaggctaacnncnnnnnnnnncnncncactttantcttctattttaaggccacttcctcttaatagttgcttttaaattttccctcactatactaccccgcccatatttccctttaatataatttgcagctttatttccttttccctcgcttcgccttccttcccccccctaattcttcctaagggactccattnctttttttnnnnncncncatacatacctccatttnnnnnnnnnnnnnnnntntnntccntatgctttcccctcccccttccctttccccccccccccccccccnnttttttttgtcctccttttccttttattatgttgttataattatctcctcctccccctccccctcctaaaaaatattttttctcccctcttcccttcttcccgatattcccccctttgttttctccttgatatccctttttcttttttttattagcctttctattttttttattttttccccctttcctctttttttttccctttttgtcttttctttcccaaaatataaaaaatttcttttttttttttctccctcccccctcatatatcttttttctttctctccccccccctctcaaaattttt

SEQ ID NO: 577 - DNA, 889 bp, Homo sapiens
  misc_feature (1)...(889): n = A,T,C or G
gccagaaatggagggtggacttacagccaggtgctcaggtaccagattggtggttactcttctggcctcgagggcatcagcgttgctgacatgggagcagacagcccctttcagtcaggttttgctttcagnnncccncgatcaaccaccgtctgaaaatatgcagtggatcactccggaaataaatcatttataagtgctaaactgtgtgccattctgagtagtgtgatgaagcctggcacagtcctttttcactctatgtttgggtttgactaggcaagcaatttctcaaaccgcggttttatagggttagattctctccccgacactccccctcttttattcttattttgtgttatttgttctctttttttgtgtctgtcggccgcggccattgtggctcccnagagagtgttattgtttttagcctttctcttagtttcgatatttcctcgaccacctttaaacctgccaactcccttccctccctctctaccctctctattctctcttttctcctttttcttcttttttttacttctcctttcttttttatttttttctctttcttttcttttcttctctctaaataaaaacacaattttttttccctttttttttttttttttcttactcccctctttctccttaaattctctttttctttctcctcttttttttttttttctgagtatagaaccccccctcctttttccttttattttttactatctttcttctttgaaaaaactcaaattatttctttcctctttctcttttctttttcaaatctatcctaagttttttttattttcgtcttttcttttttctctttccaacttcctcctttttacttcctgactttcttttttttttttcttttccttca

SEQ ID NO: 578 - DNA, 728 bp, Homo sapiens
  misc_feature (1)...(728): n = A,T,C or G
ttccttattgagcggaaaatatggctgaccacaacgcccagattttatagacagtagttccactgcctttgggaatccatttcttgttcccaatttcaggtattaataggctagggaattctctgatgtgcttttgggnnnaccgnnctcccatggaccattcatgtgttggaggcatgaatgccatggcacgtgaaagcatgcctgccgccctggacactgttcagcaggttcnataaggagcccatttttnatnntncaccctatccctgacatgcattattcctttgcccggcatgttcacggtgctaacactgaattgggttcccttaaaattcacatttttcatttccttattttcccttttttcactccctccccctccccctctagttttcttttcccccaggttgttttttttttttttctttttgtgctgtatggcggttgttttttttttccttttactggaccttctgctttgtcatctctctttccctccccgtctccggtcgaccctcttttattcttttttttcctttttttttttctcgtttttttttttctttttttttttttttctccaattttctttttcttttttattcaattttcaattttttttcctttttttttttttttttttttaaattattttcttttttctctcttttccttcttctttctttctccttctttctccctctttttttctggttttttttttt

SEQ ID NO: 579 - DNA, 770 bp, Homo sapiens
  misc_feature (1)...(770): n = A,T,C or G
tgttttgggggnttgagtggccgttgacttatcagactcactatacggagacgatccgcggaattcacctgcatggctggcccaacaccatcaagcatggttggccagtcatctcctctgattggtcagtggctataccatcccagagggtggttgttgggcttttttttttcttcattttgaaatagtgccccnnnnnttntactcccctgtttttctttgctgtgaaatgagtgattcaattaccctcctactaatggataaagtgttattaacattgtcttgacgcctcattttcatttacgcttccattccttattttcacaccctcatgtttctcgagaagtttttgtggttangaatgttaagtctaactctcactttttcatcccttaaaatttctttcttcctcattttaccattccttcaccttcaaattcccatcgaaaattactctcccctctttacctttttttaaagttctttctttttctttccaagtttgatttctccacctcgagcatttcgaaagtgtccacacagggattgccccaccctagcggtctcccaattttattacactctatacctctcttctttttttttcttctccccctttttaacttaattttttctttcctctctcttttttccttctaaaaatattatttcttttttctttctgtttttcttcttttttttcttttttttttcttctctccttctaagattttttttctccttttttctcttttcttttttattttttt

SEQ ID NO: 580 - DNA, 719 bp, Homo sapiens
  misc_feature (1)...(719): n = A,T,C or G
cgcggaattcaacaagatggcactcatggtttctatctctcctgtactatgtgtatttcactttctttcctctatattcaactacatagttnggccttaattagaacattaaatactatagnnnnccttnnngaacaccacgggcttctgctgggtctctgagccattattctctcgcctgcctcacgtgaacacaggtttcctgggtggagtttanttgagagatcgcattcattctcaggatgaaacctgctgttcccttagggncgcaattagtttttggtattgggacttgtttcttcacctacactttctaaaacccgggacataaaatttctttcgacttccctttaattgggaatttatcaaactcaaaactcctccatttcttaaggtgtttttaaattattggcgtttctttgacggctggacccccccccactctctttaaccacccctcctctttcccccccccccaacttcctctcatttctgtccctctcttctcttttttttttttttatttttttatttcgtatttttttttgtggtttcttttcctttttttctctctctctttccaagaattataattattctactttttttttttctttctttttttttttcttttcctccctcttctttttttctttaatttttttgtttttttacttcttttccccccccccctttttttatttttttttttcccctct

SEQ ID NO: 581 - DNA, 863 bp, Homo sapiens
  misc_feature (1)...(863): n = A,T,C or G
agtccaatttgctcttttgtcctggagggatttccagctgtgattcccggaagaagtgggtggtgggttttacctgcgtgactccagaggtcagtattacttcatcccaggcactgcacctgtctcctggatctgatnnnnnnctcatttgtctgtgccctgcctctggctactggggactgtagacagtgagaggcgtctggaanctcatgtctnnttttttttcttttttaaacgcgctacaaacccaaattggggtgttctgtttccttttacacaagggtctgattcattcccaaattactagactagccttggtttttaccttctgctcaccagccatcttggtggtgagctgaaactttctttttatcatagtgtggtgattgggcccccccccccgntgccacatttcctccccatttgttttgtttattttttttgtcccctttctcctttgttagttttctccgttgttggtgttttgtcttttttttgtgttttaaaatacctccacttttctttttttttatacctttttccctttcccttttcctttttttttttttttttctcttttttcaaatcattatttttcttttttttctccttcttttcttctttccctcctttctttctttttttctaagagggtttttttttttttccttccccccccaaacaccttttttcctcttccccttcttttttactcccttcttttttttccctcctcttctttttaaaaaaagaataaaagcctctttatttttcctccttctcccctcctcatccctatcttttttttttttttattatagattttctttttcctctcttttttatctccttctttctttatt

SEQ ID NO: 582 - DNA, 699 bp, Homo sapiens
  misc_feature (1)...(699): n = A,T,C or G
cgcggaattcatggaaatctcccactttttacctattggggattaattccatattttaagtctgggccggcagagccacagatggtcctccaggtgtgtcctctgtcaggtgctanannacaccccaaggtcagcangggcttctgctgggtctcttagccatttatnttttcncntngctttaatttcatcattagtattttcacttgaatactacctgccctgtaacaacgtaatatattgttattacatcctctttacgaatgtggctttcaattttagaatatataggggaaaatgagtatatttgtttacagatatctatttattttctcttgaattcatctttctattgaatgttatatcacccacaccccctcccccacattggtgttcttccatgttgtttctgttttttttatctaactttcttaattattgtgtttctttcttttcctctcaacttcctctcttcttctttctttctctcaccttttcctttctctactcacttctatttttttttttattttctttttttctccttcttctatatttattttttttttttctcctttcctttttccaaaaaccccccttcttatatttttcccctatttttttttctattcttttttttccacccttttttttttaattttttttttttttttttttaattttttctctccccccttt

SEQ ID NO: 583 - DNA, 644 bp, Homo sapiens
  misc_feature (1)...(644): n = A,T,C or G
atgatcttagagggacttcgtggaggtaattgaatcatgggggccagtctttcctgtgctattctcatgattttgaataagtctcatgagatctgatgggagtatcaggggtttctgcttttgtttcttcctgattctgtctngccgccactgtggaataagtggctttcgccctccgccatgattgtgagacctccccagtcatgtggtctgaaagtcttgtttcctttttcatcatcacccttactcttatgaaaaggtttggtgcttttttttttgttttattcttccttgccccatttttcttatgtctaatggtatagcattctccactgttccctctttgttgtttttcttttacccctctctgtatcaccagtgcttgctctccaagttatcccctcatttttcttttgtctgagtcccttcctccctatttctttttttttttttcttcttcaatttttcctcccccctctcctccctcccaaatcccccactcttttgttctctcttttcttttttattttctactctttccttttttttttttccttttttctcttctcttctccttttcttttttaataattattttcctctttttttctccttttcctttcttttttttccttttctttttc

SEQ ID NO: 584 - DNA, 743 bp, Homo sapiens
  misc_feature (1)...(743): n = A,T,C or G
ctaaacgtttgtggatgaaatgaggtaataaacctagaatgtttgccacctagagccttctatcattatccgtcacatacaccctgagacccagacatccccaggagaatattcatcccggcgtgtctcaggtaggttgtcggtttctccannagggaacaggtgttccagttaaaatgactgtttaatgaagttcattaggacacagctcttgcctgcagtcccgatggctgttaaaggttttttctagtctcatgtatgactttattatcagtttgaatattttctttggtggtgtcatcttacttattctttttttttcgcttgtgattttctttttttcttgacctttctctttttggtttttgttatgctctcttcagcttcctgttttgggttttaggggcctttgttagattggacttaaaggatggttccccactatcactatttttgttttgttctttttcttctctaattattttttatctatcgccatttcttttaattttctttcttctcctatttgtttcttttctttttgttttgtcgaagagagctttttttttccctttttcttttttttttttttctttttttttccttttaatatttttatatttgttcttttttttttttttttttccattttctttttactcttttttttttcttctttcttttcaaaattttttttctttttttttttttctttccctcattaatattcttctttgaggtct

SEQ ID NO: 585 - DNA, 647 bp, Homo sapiens
  misc_feature (1)...(647): n = A,T,C or G
ttacccattccttaaatttattcaaaatcaaagtatacaaatcaacagcactgttatacaccaacaatgaccaagctgtgaatcaaatcaagaactctatgtattttacaacagctgcgaaaaaatagtaaaatatctaggaatatactnnncaaannanatgaaatatctccacaaggagaactacaaaacactgctgaaagaaattaaagatgacccatccctatgggctgtaacaggagagtggggagatgggaaatgcttttattagcagtatgaaaacagactaatacaccatgtcatgtgtgtattttgttcttgttcttctcttacttttcttacttatatattacctttttgtcttctgggggtagtattcagcttctgtttgcctttaggccattgttaaaaaattagttgaatggtcccaaagtaccattttgccaccctccacaccctctcnnntgacaccctctgcagtattccctcctgatactccccgtgctattctcattctctcctctcttttttcaatcttctatattcaaacttcttattttttctcggtggggttgtggtaatttatctctcttttctcttttctcctctttcatcttttttttttttttctctcttttattttcttc

SEQ ID NO: 586 - DNA, 665 bp, Homo sapiens
  misc_feature (1)...(665): n = A,T,C or G
acagaaatagttcagaatcggatatgcccagttggatttaacacatatgccatttattatctgctgttcatttcagtcatatgttctgctatcctgaatatgtttacatctgttctgtatatattttggagaaccactgagcgtggnnnnnnggnnnnaannnnnaagncnaatcctaaacggccacgtggtgtgagctcctattggtgtaaatggggacacannccatggctatggattggaagaatccttcccctggtgtgcgtcttcatttcgttatttacctttccacttctnnaccttttgaggggtgaccgcattctctctttgttcctctgtgagcgctgtcttttgttttaagtgttctcttttccccctttctcgctaaagcatttttcactagctatgctttagtttgaatccacctttaggaaaacacgtgggcaaagcgcccccctggtatgattgttttgtttgtgttttttgttttgnnccctctcctcttttattctcccctttcctctctaccataacatctctttgcttcgtattttttcagtatttttattttttttctcttttccaaaaaaatttttttcttttactttttctcctccaccttttttttttcttttcctcctatttcttcccaattacctcttctt

SEQ ID NO: 587 - DNA, 373 bp, Homo sapiens
  misc_feature (1)...(373): n = A,T,C or G
tacctgaacaaaatgtacgttcacacacagttgccggaagattgtttggagactggagaacgctctcacagctcctggttggacaccgagtgctcaggcacgtaatggggccccacggggttcttcccatgggagccctgcacacctgtnctnacancancaaccatggacctgtatctggcccgggaactgncacttttgattcaatgttaacacatacaatggaaatatatnccatggttatggattgtataaatccgtttaaacgtgtgcctctttttatgtttttccctttttctcatttttttctttttaagtgtgacagatttctggcaattctcacattccttgtaacccttctcaacctatttct

SEQ ID NO: 588 - DNA, 276 bp, Homo sapiens
  misc_feature (1)...(276): n = A,T,C or G
ttggtcataaagtggtctccatggtaactgttgaggccttgatgatggattagacaggctatttttaatcattctgaaaacaatgttggcaggcatgtagagtccttccagaatcttccagctcagccgagccaccagcaggatgnaattgagggagtnttttnnnntgatgtgtaatgactatttttaccaatcattttgccctattgagctattggtgtaaatggggacacatgcaggtgccccgttctatcaagaatccataccatgaaaata

SEQ ID NO: 589 - DNA, 892 bp, Homo sapiens
  misc_feature (1)...(892): n = A,T,C or G
cgcggaattctaggtccttagcagttatataaattggaaatattttctcttgttctatatgttgtcttttcattttcttgacagtgttctttgatacacaaaagttnaannnngctaaagtcaactttatctatttttttcttttgttgcttatgctattggtgtcaaagctaaaagtccattgccaaatccaaagtcatgaatacttacacctttcttttaagagttttatactttagtttttacatttaagtctttgatccactttgtgttaatttttgtatatggagtgggatatgtttttttttcattcctattcttcttaattattttttttctattcttttttattttatatctcccccacattcatctctccccatttatattattgtatattgagtgtgtgactacatacattgtctgccctcatactctaaaatctccctttttttatctttcttcttcacccttcttctcccctatttcttttttttttttttttttttttttctttttttttttttttatttttctctttttttttttttcttttttttttaagaaatattattttttttattttaatcttcttcttcttcttccccctctttccttctattttttattagaccccctccccctataagtaaacccccctccccttttttctcctaatagttaaaaaatttttttctccccccctctttctcttttttcttatctgtaaaatatttttttttccccctcctccatttttcttccccccccctcccccttaatccctcattatatttttttttatcccccccctccttttcttcttcttctctctcctctcaattattacttttctctccctcatttatttattttctttttttcctcccct

SEQ ID NO: 590 - DNA, 866 bp, Homo sapiens
  misc_feature (1)...(866): n = A,T,C or G
cgcggaattcaaagcaaatacaaactagagccttttaatttattcgcctttatgaatgctttcccccaagggccattgcctaaggctgaagtaaggatttgtctttactgataacttgaggttccaacttcanggaagaaccatttaaatctttttttttttttaatttgaaaatatagaagacagggtacagtggctcacgcctataatccttatacttnnngacgcttaggcatgaatgttttttttatcccaatattttgataacatccgtatcaaccatttcagggttatttttttttcatcattttttttttagaatgatttctcacacctaactattccattcctgtgatcacacgagagtactcattttcactcttccnatcatatattttccccccaaacattttttttttttcttttacagtgttttttaattttaatggggagtatagttatttccaattattttttctcactccccgctctgactagcctctccctgtcccctgacacttattacttcttttttttttcttttttttcttttttttttttataatttattttttcttttttgtttccttctttcccccctcaaaaaaattatcctttttttgttattattataattttttttgtcttcccttttttactcctcattttccaaaatatttctttttcttttttttattctttctcttttttctttttttttcttttatttatttattttttttttcttcctttcttctttcttctcctttttctaaaagaatttcaaaacaatattttttttgtctctcctccccctcctcctaacttttttttgttgttattttttgagtaatttttttcttcct

SEQ ID NO: 591 - DNA, 888 bp, Homo sapiens
  misc_feature (1)...(888): n = A,T,C or G
cgcggaattcaccatgaagtcacctgagccttcattttcaatgttggcaggttttcaactacacattcagtttcttttatagagatgcaggactatgtaggtcgtctnctncnnnnnaaataagttcaagcagtttatgtttttttgaaatattcatcaatttcatcaaagttgtttaatttataggcacagagttttttgtggtatttcgttgttagcctttttcatgcctgaagggtctgtggtgatgttcccattttacttttttaatctattaattngtgtgttctcttcctgctattaaattctacactctttttccttgttttttttaaaaaatatgttcttcccccctttctctaccctcctcttatttccttcttttctcccagtgaggtggcagggaggttcaaacagctgccagatggagctctttttattcttcccccctaaantactcctccatccccgcccctcttccccaaccccccccatcccctaactcatccttttattcttatctttatttttttttctttttttcttttaattttttttactcactatctctctttcttttctttttctaataaattttattctttatttcttttttctttttctcttcttcctcttttttatttcctctctcttctctcaaaaaaatttatttttctttttttcttttctttaatactacccttctttttctctcttttcttttttttactttccttcattcctctttcnttttcttcccctctcttataaaatactcttataataagttgatttctcgctttttctccttctcctcctcttcgaaaaccctatcttttttctctccttctttttcatattttctttctctttcttttctcctctcaa

SEQ ID NO: 592 - DNA, 604 bp, Homo sapiens
tatggagaggatccgcggaattcaaacagagtgactttgagatagagcccaaattcactgacttggtatctgttagaaacagcaagaattccaagaagtcccttaatacatggtactgacaactgagccgtgaaccacagaagcttgtaatatacactaatcatcaacaaatcaccaaatactccaaaaattacatcatgacacacagtaacagccacaagagcaattttcctagtagaacaatttattaattaatatgcaataaaatatctccccaaaatctttccagaaatgacaaggcaggaaagtgaatacttttatgcttctctggaaatttttaatgtaaacatgaaatatttgaagaaccgattaaaaagtcttaagtgaatctgtaaatacatttttaagtctgacttcaaatcggtacatgaggcttagacatacacattattggacaagtgacttaaatatctaaatacaaatcaaatagcattttcctaacttcaactataaaaacacaaatttcagtaggtactgcaaatctaagaagaataacttgaaaaatactataataagtgttgtaaaaggtgaagactcatatgac

SEQ ID NO: 593 - DNA, 710 bp, Homo sapiens
gaataaacagattgctcaatatgcggacctttcccatctccatgaccgaacaaagccagcatggtttcttttcatcataaaattgtcatcagataatgggagacaccccgaaaaaatgactgtaataaaaactagatagcaaagcaattcagcagagcttgccctgcaggcatctgcactcatcctcagactcactctgactctccatcccggactacagtctcgtgcctcatgctatttgcctgcgtcctgtctcaggccttgttcagaggcccagatgaagagcccgcctccatgtaaagcagcgtgtcctgaagcctggagatttgagacagggccttgagtggtccatgggcctggaaccaagcaactctgatgtctctgagcatctcattccatcacccaaacgtcggggtgttcggcacccaaacatcaccttgacagcaggtctccctccccctaaagccctcccctgctgtattttctcgatcccactaaccacgatccaatgtacttcatatcttagacgtttatttcatttattgtcaatctctccccaccgaggcgtaggccccatgagagcagagaccttctttctgcctgtttgctcttcaccccagcccccagaaccaggcttggtacttggtgagcactcagcgtttgtcaccaaacccagcctggttctggcctcccgcagcaaagccaaactt

SEQ ID NO: 594 - DNA, 777 bp, Homo sapiens
ctcactatatggagaggatccgcggaattcatgtataactgaccagcgtcgacgttaaaacagacaacttaaggctgaccaaacggtctgtagcattaagatacatcatatgacaaatagcaggccctggaagaaaacgaagtattttaccctgacatgtatttatttaacatagttttacgtagccctgcaaaactgtctcctgggggaaatctactttgtagagaatctccttccttttccacatcttttcctgatccatgagagaatgtaagactctggcacctttttaactctgataagaaaagtttaccatctattctctctgaagcctgctgcctggagcggcatctgcattagaatggccagagtggtggtgctcaagcctgtaatcctagcactttgggaggccgatgtgggtggatcgcttgagcccaggaattcataccatcctgggcaacatggggagacctcgtcttagctggacatgatgacagcacatgcctatagtcccagctattcaggaggctgatgtgggcagattccttgagctcgggaggacaaggctgtggtaaaccacagtttgtgccactgcaattcagcctgtgcaacagaaaccctttcaaaaaaaaaataataaaatttaaacttttgcttctttagcttaacccaaacaatcctttttattgattccagtttttagataataaccacttttttaacccaattccaatcaaaaaaattttgaattcttttataaacttttttcttaaaagg

SEQ ID NO: 595 - DNA, 684 bp, Homo sapiens
tcaccagtgaagtactagcataaaaacagacgcatggaccaatatggaacagcgttgaaaaaccagaaataaccccatgcatatacagtcaactaatcttaggcaagtcaactaatcttgtgtcaagaatacacgatggggaaaggacagtcgcttcaataaatagcgtgaggaaaccggatatccaaatactgctacgcaaaagacctcattgcccgatgtgcacagaagccaatactatggcaccaggcgtttgagaaaagaaaagcttaattgcgagttgaccaacaaagtgacaggagtttagttcaaatctatctctctgtgctgcccttaaggcagcactattgtgaaaaaaggtttagagggtggattctgggattcacaggtgaatggtgaaggaaaaaggaagtctggaaagtccccgaccatgtgcagttgtctcttcaagcctcttcttgggtcccatgtgcaaattaaggtagagttagtgtgaaaagtgcagtggaaattcaggctgcgacattagcaagctcattctgcatggacttcctttggttatattggtttcaactgatttcagccagttgtattatattacaaacggagtttaaacaaactgtttcttatctgccatcctgtaagctcaagaatttttgttagccggacccggttgcttactct

SEQ ID NO: 596 - DNA, 454 bp, Homo sapiens
tgtagaggatccgttgaattcagtggcacgatctcagctcactgcaacctccacctctcgggttcaagcgattctcctgccttagccttccgagaagctgggattacatgtgcctgccaccacaactggctaatttttgtattttgagtagagatggggtttcaccacgttggtcaggctggtcttgaactcctgacctcaagcaatccaccagcctcgggctcccaaagtgctgtgattacaagcatgagccactgtgcccagtcaagaacagtttttatattttattttcacattgaaaatcattcacatttgcttcagcctcaaagagcgtgtttatgtaaaattaaatgagtgctggcagcaaactgcacttttttttttctaaacatgaaatgggttaatgggtatggagttgtattttagttttaaaaaaaattggtattatttttat

SEQ ID NO: 597 - DNA, 511 bp, Homo sapiens
aatattctcttctatgtagaatggggatgacggcagcagtgacatcacagtttcggcgagaattccaagagatcgtgtgtgcgcgcgtagatagtcatacatcccatgcatatttgttgagcctgactgtgtatcaggaagggtgggtccagccgtgacaaaacaggcacagccccaggccttgggtgctttctagggggaagtagacaagaagcccaagaagtcagcacatgccgggggtgtcagaaggtgagaagtactgggggtagcaaagcagggaaggcaggaggaacggggagatgcagggcactcctggcaccacccggattcccctgctggcccccttccaccctgagcaccggcgggggtgactgccttcatgcaagtgggagtgtctcccaggccacagccagtgaccaaaacagactgacaccgggagcaagaccgatgggagggcagaaaccttgtcccctgataggaaggacttggaaagattttggtgctcaggcat

SEQ ID NO: 598 - DNA, 1040 bp, Homo sapiens
gactcactatatggagaggatccgcggaatttattggaaaactacagttagaaatcgccattgatttctttttttttctttctaaagtattattattctttaaaaattagggtacatgtacacaatttgcaggttagttacatatgtatacatgtgccatcctggtgtgctgcacccattaactcgtcatctagcattaggtatatctcccaatgctatccctcccccctccccctaccccacaacagttttcagagtgtgatgttccccttcctgtgtccatgtgttctcattgttcaattttcacctatgagtgagaatatgcggtgtttggttttttttcttgcgatagtttactgagaatgatgattttcaattttatccatgttcttacaaaggacatgaactcatcattatttctggctgcatagtattccatggtgtcgatgatttctttcagtatatcattcttaacatttgtgatttcagacattgcaactttactgagagataagtattgttttaagtgctttaaatactttactttttttcttacgatcacccactaagaatggtatgttaaatattctttttttactgattaaaataatgatcctctgaaagttaatttttttgttaaagcacacttttattaaatttgcttcaaaatcagatgtgttgggttttaaatcttataatctaataaggatcttgtatactattaggttaaaaagaattagaacttatgtattattgatttaatactttggttcttatttaatcacattttttatgtctgaaatttatcttaaataaatttccttatttttaagaggtatatttgtaatagttaagctttatatgatattttttgttgatgaaaacgtattgattttttttttcgtcaaagattttaatttatacatgtttaataattatcatcattaatgaataactgattattataatgattaataattttttactctatctactaacgatgtattattgatgatatattcatctatttatttattatc

SEQ ID NO: 599 - DNA, 1014 bp, Homo sapiens
tctgtagtacatccccttcccaagctttcctattaatttctaactcatatcattttgtaccctcaaccagagtaggggctctccttgtggtccagcacatcgttagaactttagcaggtgttgtatattggtcccttggccacaaatgcagttttgtcctctgtttacacaggtaaaattgccaggagaatgtccagtatatgggggacagagttagagggagctattattcagttagcgttgagtatctggggacttgacccaggagaaactccttgtggaagagacttctgtcacaaacactcaaccctcctgtgatagtcatgatatgtttttgcaatgttatcccatgatctaattcacagaggtgggctctcattcagagttcttagtgttctgggggcttattggtttgtgattcctaagaattgagttgcatggaggaggaggagcacagaggaggaaaggggaagtttcttgcatacattattaaatggtattagtctcattactggtttttcatgattggaaggacaatatctttattttctattgtcgtatgttttccaattattttagttcattttgtttttcttctttttgtataccatctttttatctctatttatatagcactttttttgcctttatttcatgaatatttctatatatgtatttaatacttacttatctctattttacaggttcttttcatgcatatatgacttaactttttcttttgtatatttattttcctggaatttgactcctttattaatatcccattaattatcaatttaaatttgcattttgacaatttcttattcttttatttttgttgtatttatttttcttttatgttatatttagtaattcttatattttttatatttttttgtatattttcttttttatacttatttattactttatcaattttaaatctatttattttgatttctttatatatgctttttattcttatgtctgttactgttttattatcttatttat

SEQ ID NO: 600 - DNA, 734 bp, Homo sapiens
tatggagaggatccgcggaattccactgctatgaattcagtcttcagatattaagctcaacaataatatacatggctccagcaaggctgctaaaagaagcatagtttgagaagcaacttacttgtgcattggtgaagaccaactctttttttttggagctctgtgtgtgtgtgtgtgtgtgtgtgtgtgtactcacatagaaagactggttaaaaaaaaaacgtatattggtgaacaaaagatgcttgtacaaaaacaaaagccataaacacacatttctatatgcacagagcatctgtgatagtacacaaaataataactgttgtcacctctgggaaagagacctggaagactacagatctgggatgggccaggtgcggtggctcacacctgtaatgccagcactttggaaggccaatgagggtatatcacctgatgccggtagtttgagatcagtctgtgtaacactgcaaaattctgtctctatttttgtaaaaatacgaaaattagccaggtgtggtggggcacacctgtaatccgacctacttcgaaggctgatgcatgagaatcacttgaacttttgaggcagaggttggagtgagctgagatcacccaccgtactgcagcctgtgtgatagagcgagacttcttcttaaaaaaaaaaaaaaattttgtgttgtgagtgagacttacttttcattttgtaacatttaatattgtttgaattttttact

SEQ ID NO: 601 - DNA, 741 bp, Homo sapiens
ccttcgtgtgcatgtgatgaaataggaggctactttgtctctcggttgctggttcaattacttactcagcacacactcatggaacacctgctgcgtgcctggcctggtgcaacatgcaaaagatggaataatggccgagacctcaaggtgctcacagtcagagggcagaggtagagaagggggcagctatggcacagaatgattgacaccacgatgggtaggggctccactctgctgctcttctgctcccaccccattgtcgacagaagttgcctgtataccccagcctatcttctcgtggtcttacagaaactcgaaggtctgatgaaagaaactcttctctctcagtgtgaatggagaattgcccttctctattaatattaatagccacagcaacaataataagagactccatttagtgagcacttagtccacgccaggaccgatgttaaacatcttttagttatttacttacaactccttctgaggtaggtggtttacccgcctgtcatagatgaaaaaacaggtgcagagcctccttcccaaggccacagctagcaaggttgaaagtaaaagaatgatggtaaaatgtacaatgttaacactaataaaaggctaacgtagctatacttatgtcaggaaaagaacaccttacaacaaggaagcattactagagatgaacaccttacaaatcataattaaaaattatttaaaaggaagctagaacaagccctaattatg

SEQ ID NO: 602 - DNA, 602 bp, Homo sapiens
acgttagacctaacaccataaggatttgtcaatagatcaagaatcttggggccagccatgatggctcatccctgtaatctcagcactttgggacatcaaggcagaaggattgcttgaggacaggagtttgaggagtttgaggttagcctgggcctctgttgagcaagacctcatctctacaaaaaaaaaaaatgtttaatcgctgagtgaggtgggatgtgcttgttgtcccagctaatcaggaggctgaggtgggaggatcacttgagcctgggagttcaaggctcagtgagctaggaacatgccactgcactccagcctgggtaacagagaaagaccctgtcttcaaaaaaataaaaaacaaaagaatcctgggatttcttacttgagcaactagtggatggttcatacatttactgaggtaatgattgaatgacttaaaagaaaaaactggccgggtgcagtggctcatgcctgtaatcctagcccttctggaggtctatgttttttttatttcatgtttgttttttatatactctattttctttcatattattttatttcttttttattttttttttctctttttttgcttttcttat

SEQ ID NO: 603 - DNA, 658 bp, Homo sapiens
caagtaaaggacttttccagagtgaccagaatggaacacgacacagcaaggcctccagaaaagggctgtaggagccacccactgtctaatcttaccccacaactgagaccatgggacacagagctgagcctgaaggggccaagcagagccagctgatgtctcagcacccagatggtcatgggggccaccagccagacgccagagggagcccacctctcgcctccattttatggccccctgtgacttgacatgtcctgccccctcctcccagcccagcaccacctggctgcaaaccaccaccagcagcctctctttgggctgtgtagaggcattggcagctggagtttggcttttggtggtgtgaccaaagagaattcaagctggtgccaagggctactgagtcaaatccacgatgagtcaaaatgctttccaagtgcacagccaacaccacagaatttggccatgagctacccaggaaacccaggaggccccgagtcccagtgattaccggcaggcctccgggctgtagaactccagcgaggactcaggagtcatgaagggcggccacatttgcccagaagttccattgatcatgttgcactgatcggaatgccagaagttaacctggggggaagcattcagactagacccttcaata

SEQ ID NO: 604 - DNA, 465 bp, Homo sapiens
  misc_feature (1)...(465): n = A,T,C or G
ctaactacagggagaggatccgcggaattctaacattcaagaaaggaggggccaggcacgatggttcacatctgtaatcccagcacttcaggaggctgaggcaggtggatcacgaggtcaggagtttgagaccagtctggccaacatagtgaaactctgtctctactataagtacaaaaaattaaccgggtgtggtagtgtgcgtctgtaatcccagctacctgggaggctgaggcaggagaataacttgaactcgggaggcggaggttgcagtgagccaagattgcgttccagcccgcgacagtgcaagactccgtctcaaaaaacaaaaagaaagaaagaagggatactcttttttaaaaaatagatgaaggaacacttcccatctcatctcttgagtccatcataactctcatacctaagccagataatgattctgtgtttgggggagggggtgtntttntn

SEQ ID NO: 605 - DNA, 655 bp, Homo sapiens
tatccgggcaacacacggagcagcaccaggacaccaccctacacgtgggcagctacacaggagtggggcttctgagacgggaagtgcagcaggaccagcatgagcctgaaacagctggaaacacctgaggctgcagagcctgctgcccccaggagggtgcctcggtctccagctccagacacccaatccttgcggaaaggagctttctgctgaggccacagaaagggccgttttccctcacaggcagggacagcaaagggggcacatgcccagagcccacactcacccaggttgcaggataacgtcctcgtataaggctttttgtcggttagaaaggcgacacttcaaaacatgctcatatttctttgttagttgcttttccacatctctcttagttctcctcaaaataaatggctgtgtcacctgaaaataaaaactgtttactgttctctttccaaaaatgctgctgtaacacgtttataacgaggcatacgcatgtttaattaattaactgaaatggcagaacccaacctaccctgtgtaaccttatgaccactttatggtagtaatcctggctctcttcacttggggccctcaagagggagctcatgtagggcctggagatccctgggaccaggaagttcaccatggtcca

SEQ ID NO: 606 - DNA, 554 bp, Homo sapiens
  misc_feature (1)...(554): n = A,T,C or G
catccgcggaattcttcgctactccatttatatacatgatacctcatcacaatgtnntncatcatcatagaagtgtcatttatgtgcatgaacgtgtctaccaggagaaaaacagcctgaagtagcctgttacatttacccggatatccgccctttctgtttctctcctctgtccagtgtttcctgagcaccaactacgtccaggtggcccgacaggcactggagacacagtggacacaaagctgagaggccctggcttgtgtggggctgacatcccagtgggaaagacaagcgttgatcgggtgaggatataaaaatgcaagcttgtgatgcatgggtaaactgaggctcacggagatgactcagccccttgtgagtacattccacactctgggacagagcgctcattctgtatcactgcgctggggacagggacagagcggttcataaagacagaaccccccctggcccttctggagcccacttcacaccccagcaagcattaggcctagaagttggcaccttccccgcaccaccggtttccctgcactggt

SEQ ID NO: 607 - DNA, 1010 bp, Homo sapiens
  misc_feature (1)...(1010): n = A,T,C or G
atggagaggatccgcggaattcatgatcgtctcggaagggaagggctgacgggcttcttcctgggtgccgggtgtcagctgcaggggtgctgaggctctgtcatggcccccaccccaggcttttaagaaaggccccttcaggcaaagtttggcacccgatggacacggccccgctcgcctggggagtgcgccccaggcttctcagacagcagcggctcagggcctggacttgtcttcttgggggcggggtggaggggggggaannnnaannannnananannnnanaaaaaaaaaaaaataaaaaatatatatatatttttattattttttttttattatttaantaaaatnaataaatnaaataaaaaaattaaaaaatatanaaatatattattttatttttatatattatatatatattttatatatttattanttattattttttttattaatttatttttaaatatatttattatatttttatgattatattttttttattttatatatatatatttatatattttttttttttttatttaatatatttaatattaatttatatattttattttatatttattatttttttataaaatatatatttattttaaattatattatttttatatatgtatatgtttatttttaataatactatttttgttaatatataatagatgtatataatatttatgtttgttattttttttatatataattttatatttttttatatttttatgattattgttttttattaattattattgtttttttttttatgtttattgatatattatatttttatttattattatttatttatattaatattataattagttatatttgtttttgtgtattaatatattatagtttattatatatgtatatttattatataattagttattttgtatttagtattatattgaattatgttaaattttgtattatttatgtatttttaattatgttattttattatttaattattatatat

SEQ ID NO: 608 - DNA, 735 bp, Homo sapiens
atgtgcccttctacacattttataaacattaatttgttcaaagttctaaagaactatgaagcaggtgccatcattatttccattttatggagagaaaagagagacaagagaagttgtcaagaaaggcaacgttgaacagcattcctaaatatttagcaaagatttgaattcacttatgtgctgttctaaacattttataaacactaatttattcaaagctcagaataactctgtgaagtaggtgccatcattatccccatcttagagagaaaaaacagagccaagacaagttaaaagactcactgaggtcacacagaaaagacttgaaccctgcgatctgactccagtgtttgggtgcttaactactatcctgtatcagctccctgtggtgaacttctgcctctgttgagatgaatcgggaaaacagcttatgttgaacaatcagattcaggagaaagccctcgcaggaaaaaatggtaaatttaaaaaataataataataaaaagccttttccaaaagcccatgttggctcctggctatggcagcagttagtcaaaatgagaagcatcgtgggtctcacatgatgcacccctcaccgtcctggacacagacggccttagtatttatactttagcctctgaactttattccacttaatgaactcaagcaccataaatgccagcctgaacacacagcatggctcatttgaagacagaaatttgatttttttattac

SEQ ID NO: 609 - DNA, 764 bp, Homo sapiens
actcactatatggagaggatccgcggaattcaccaatgtgcagaggctcctctttggaagttatgcggtaagctctttagaaatgcaggcacaggctgaatcagagaaaaaagccctcattatttgggcatgcttgcaagatttgaacccttgtgcagggattggggtcagagcaaatagaccacgacagtagatacagattaaccccctgtgctgtggagattcttctgctggaggagtttcctgcatctcccataacacggtaccacaaactgggtggtactttgcttaaaacaacagcaatttattctctcatggttctggagaccagaagctgaaatcaaggtgtcagctggccacgttctctcaaaagcctctatgggagaattccttcttgcttctggggattgctggccattctgggcttgtggctgcctcactccagtctctgcctctatcttcacaatccgtctttcctctgcatatgtcagtggcttcagatggtgatgatagaatgatgccagtcattgaatttagggctcttttgactccagaatgacttcattttaattaatttacttgcaaacagttgttttgaaataatgtcatattttgaggtttgggtgacatgaattttatggaactccattcaactcaatatatgtgccaaggatgactttttttcctaccaccaaaaaattaaagcatcactccccctttctgttctttttatgggtgcaaaaatcccatgtatggttgattgc

SEQ ID NO: 610 - DNA, 790 bp, Homo sapiens
tttacatacgccatcttccaaaatgtattgatcacgtggcctggtgtgtgtctattctcattcattgtgctgatcacatagtgggctcttccaatctgaaaacacatcctttcattcggagacattttcttaaattatttcattaatgattcatcctctttcttttctctgtttcttttttctgttattgacatattgaacctcaaagccatcctcttaatttttttctcctatcttccacttcgtcttttctctgcttcttaggaaatttcctcaacttcatccatcaaccattccaccgactttccattttgctatatttttaatttccaagggctcattttgtccctgctgcgtgttctttttttaagatatagcagtcatttttgtttcatgattgcaatatcttctcttatctcttagtgaatgcgaatgattctctgattttggttttgttttgttttgagacagagtttcgctctgtcaccaggctgcactgcagtggcacgatcttggctcactgcaacctctggctcctgagttcaagtgattctcctgcctcagcctcccgagtagctgggactacaggcatgcaccaccatgcccacttaatttttgtatttttagtagagatgggtttttgcccatgttggccaggattattttttttttgctgacctcattgatctccttaccttggccttcccaagatgcgggtattacagggcttgaaccccccccccccacgccaattttttgtttttcttaaacctgggtttttcttttactg

SEQ ID NO: 611 - DNA, 687 bp, Homo sapiens
gccttttttcactagaggattgtagaattcacttgtacatacgccatcttccaaaatgtattgatcacgtggcctggtgagtgtctattctcattgagagtgctgctcacatagtgggctcttccaatctgaaaacacatcctttcatttggagacattttcttaaattatttcattaatgattcatcctctttcttttctctgtttcttttttctgttattgacatattgaacctcaaagccatcctcttaatttttttctcctatcttccacttcgtcttttctctgcttcttaggaaatttcctcaacttcatccatcaaccattccaccgactttccattttgctatatttttaatttccaagggctcattttgtccctgctgcgtgttctttttttaagatatagcagtcatttttgtttcatgattgcaatatcttctcttatctcttagtgaatgcgaatgattctctgtttttggttttgttttgttttgagacagaatttcgctctgtcaccaggctgcactgcagtggcacgatcttggctcactgcaacctttggctcctgggttcaagagattctcctgcctcagcctccgagtagttgggactccaggcatgcaccaccatgcccagcttatttttgtctttttagtagagatgggtttttcccatctggccca

SEQ ID NO: 612 - DNA, 854 bp, Homo sapiens
tgtagaggatcctccgaattccatcttatacacttactagccgtgcaggaacttgggcaatttacataatcctttgtgtctatttctcataagagcacgtgggaataatagaaccaccccctgcctttgtgttaaatgtgtattaaatgtgtcaatatatttacagaacttagaagggtatttggtgtggagagagtggactctaaggattttatattattatgtataatttacatgttatacttaaagtgataaatgtttagtatttgtgtgggggtgttaaacatagaagatatagtatttcacatcactttgcattacttaattatctcctcatcagttcattctgtataactttacatattagtacagatacctcttttgccttatacttcttatactgctgcagagaattccagacaaactatggataaggtagtcattctctgttgagaaggtgaccacatttttatttatccaaactggtaatttttcagagtgaaaaaattgttttattaataattatttctagataccaagtttatactatgacttttcttgatttaactactataagttatattcttctttcattcttacaattaatgtttcttggctagacaattgtccctatatttgtcctttctaaattttaaatattgttcatcatcttttttatcttcatttttttactaggcattttttcatctcttatgtaaataattgcttttctatattgtcataaaagttaaggaaattattatcatgatttttcatcctcacgagattattgttattttataatgtcactatatttaatttattataattttaaatctatcatttttagtttg

SEQ ID NO: 613 - DNA, 772 bp, Homo sapiens
ggccatcctgggcttgtggctgcctcactccagtctctgcctctatcttcacaatccttctttcctctgcatatgtcagtggctagtgatgagaaatgatagaaggatgcccgtcattgaatttagggctctcttgactccagactgacttcatcttaattaattcacttgcaaacagttgttttgaaataaggtcatattctgaggtttgggtgacatgaattttagggaactccattcaactcagtatatgtgccaaggatgacttcttttcctaccaccaaaaattcagagcatcactccccctttctgttctctttattgttgcaaaattcccatgtatggttgattgcattatgcaaagatggctgcactactacatctcccatcccacctgctctaatgctgtgacagggtgggctcatggaatctatgtctcctcccttgaacttgggtggacctttagactaacataacacaatggttactgatgatgaatgacttccgagactaggtcattagtatggtttctgccttatgcgcatgttctttggtctctttctctcgctttctttctctctctcctctttcttatccttctttctctttttcttccctttctttgctcttttctccttgtgctttggcaccctgacctacctttttaatatgttcagtccatctaccctgaccccctcctgtgcttgtagaaactctttttgtttataccacatgctgagaactgttttaaaatttttcaagcctctttgta

SEQ ID NO: 614 - DNA, 839 bp, Homo sapiens
atatggagaggatccgcggaattctcaatgattcatgaaatcatgggttattcgtaaaacatttttaatgtttttcatattttttactcactttaaagcatgtataacagatcataaatattcagttaagttgcatttacaaatatctgtagcctatagtgaacaggcaaacactgtaaaacaccagcacgcattcaaacacagtaaaacatcagtttctagaaaacatccgattaggatttcatattaagattagcagtgatgcatagaagcatagaactgggtgtcaaaattgccaatttagggacttacttgcttccaaggtgtgttatttttgatacatccttcctggagtgtgtataaagtatactatgactgcaagtgtattagcttttcttttatcagcaacaatgactcacttttggcagcagacagagccaccagcagacatcatagtacggccacaactactatcaagactgacccatgaaatcatacgggttctacttctacgtgctcctgtcccagtgaccccaaatgttaactttgatgctggatgcccttctctgggtaccctgtgcttgagtattcccgagatgtccggggattcttctgatctaaacacatctttgtggatagtaaaggtttcattcacacttgagaactgtcacacatcttctaaatttctccactgattattttcaggattgggagatttgaaaaagcggataaggttcttgagaaaatgttaggagggaattcctgcataggaacataaactcacgttgcctgaatcttagtagcagttgtgacatttattaaaaccacacccgttttgt

SEQ ID NO: 615 - DNA, 1037 bp, Homo sapiens
atcccctaaacgccttcacacattcagcctctatctatatatctatgctgaatttatctatatataaaaatatatatttatatataatttatatattagtatataattaatatatgttcatacctccctatatgtccatatttatatatgtttatatatttatatatatttatatatgtctatatatataaaaaatcacactatatatatagtgtgattttttttcaatgaaagtaggaaattcaattttaaattgccatttgtggcttattactttacctttatgcgtagtgtaatccaggtcagtgagctgcacctagaagaatgtctgtcttaccctctgatgtgtcacataatttgccggtaaaggttggaggcgacctcctcagccactaagcaccatattcgggcttcccctgcgatctgcccaaaccatcatgatgctaccagaccagaccccccaacctcacacatccgcttacgacaccatgctccaccccatgcccccctcttctccctgcttcccccttccacccccccctctctctctctgcccctcccaacatccccttcctcccccttccccacccacttccccccactctccttccccctcccccaccaatcttcccccccctgcccccttccctcccccctccctctcccgcccctttccccaccctaacccccttctctcccctccccccccccctctcccgcccgcgcccccccacccacgcccctcctcccctctcatccccccctcccccaccccccccttcccccccccccctcctccccccctctcccctcccccctcccccccctccctcctcctcccccccccctccccccaccacccatcccccccccacacctcccccctcctcccccccccccccctcattcacctctcacctcaccctcccccccccaccactcaccctccatcctctccccccccttccacctctccctccatcctaccctccacccctcctcctcctctcgtcccctccgctcaccactcctctctc

SEQ ID NO: 616 - DNA, 643 bp, Homo sapiens
cgcggaattcttcctttgaaaatgggcttttcttttctaacacacggctaggctataaatttaacaaacgtgtgctctgctaaagttttaaatataagttccagctttaggtgatttctttgctccaacatctgagcataggttgttagaagcagacaggccgcatcttgaatgctttgctacttagatatttttttctgccagataccctcaagtcattattttgaagctcaaacttccacagattgctagagtataaacacaatacagtcaagttttttgctaaggcatagcaagggtgacctttgcttcagttcccagtatattttcattttcatctgagacctcatcagcctgtacttcactatccatattactatcagaatttttttcaagatcatttatctaatctctaaagaattccaaactttccctcatgttcctgtcttctgagccctccaaattcttccaacctttgcctgttactaacttccaaagttgctttcatattttcaggtatctttatagaaacagaacattttggaggttcctcagaaaagtaaaaattgagctgtcaaatgatccagtaatcccactgctgggtgtatacccaaaagaaaaaacatcattatatttaagagaa

SEQ ID NO: 617 - DNA, 1018 bp, Homo sapiens
tttgtctatgtacttttctgcgctttctagtatgcaatatactgctaccattattcatttggcttcaagctgcattatgaatagagggagagatagttgttagtatggtttcaatgtatgtgtctctccaaatttcacatgttgaaacctaatccttaagatgatgattttaagaggtgggtctttggaagataattaggtcatgaggctggagtcctcatgaatgggatttgtgcctttaccaaaatggcttgaggaagcttgctagcccttttttgctcatccactatgtgaggacagagcaagaatgtgtcatctgtggggaatgggccctcaccagacaccaaattttctggagccttgatcttgtactttccagccttcagcactgtgataaataaatttctgttgtttataaattacccagtataacatgttttgtcatagaagtctgaactgacaaacgcagttgtattttcttgagagtaaataaaaaaacagttctaagggtgagctgtgtttccgagaataatactctgaatatccatctgtctggcaagactgctatttatattgctcattgtgaaaattgtttcaactttttgctcttgttatgaggtaacatttctttccaactctcctactaggtagtattttcaccctggttaggtttttgaaaaaggaactaaggtttttttatctatttttgggcctcctgaattttataacaaaattgtaaagttgtgttaggattcctttttaaaaactcaaaaaattctttattggattttttgaaaaaataccacattatctaatttttccctctttttttttttcaattaacagccttttttcctttgatatttcactagaaaattgttgaaccttttatatgttttgatatttattaaaatgtgcccttataatttcgccatattttttaattcttggaaaactatttctacctttggtatattttcctcttcagcttataattgaaatataaatccataaattt

SEQ ID NO: 618 - DNA, 568 bp, Homo sapiens
gtagaggatccgccgaattcatcaaacatgaagctacaaacagtaatttgtgaattgggagaaaataagcctactcattaaaatttcaccagggaagctagcggtgagataccaggttgaaatgtgcttctgaagcaggctttgggatcgatgggtttctctgctctcatttccttctttacttacagaaagggcacaggtggaaacgccatgtctccctgtaggtaacctgtcagttctctgtaaagatgtggacggacttagggtataaatgccagccgttcactcagctgataactatgatcttccctgatgcctgcctgatgctttcttatccctgctttgcccagggtgctctgtgaatactgaaatgctcttctctgaggagtgggatagaatactctccttccctagtcactgcccactgtagcagttgttgaagcttgatctggaaggatccttccatgataatttatgaggcatacccttgagaggactggcttaatgcttagtactcttccatcttctatacctctaagagaagcctgatgctgttagaattgcaggt

SEQ ID NO: 619 - DNA, 552 bp, Homo sapiens
gtctgaaagcaaacaattgattttggagcagtttattccaagaaggcaccactttagagctgggccgtgaggtcgggaagttgaggaagacaatgcaggcgtgtgaacgagcataccacctctgcgacaaatggaactcagtcctgcgaggactctgagggagatggggtcagtggtgtcctggtgaacggctctgaaggaaactctgatttgtagttgaatgcattgaatggtgtcctctcctaaattcatgtccacccagaacctcagaatgtgactgtatttggacatagggtctgtgtacatgtgattattaatgttaagtcatgctgaattagtgtgggccctatatgcagtgactggtgttcttggaagatgcagcaacatgcaaaacttgagggaaggcactgttaagatgggggcagagactggagcatcgcagccacaagccaaggaatgcctgaaagccaccaggagctggaagaggggaagcaggatcctgctttagagcctttgtagggagcatggtccactgacaccttgatttccgac

SEQ ID NO: 620 - DNA, 734 bp, Homo sapiens
tgactcactatatggagaggatccgcggaattccatacaaactatggataaggtaaccattccctgttgagaaggtgatcacattttattatccaaacagggaaaagttcatagtgaaagaatgtgttattaataattattccaagacagtaagtgtaaactaggactgtcctgaatgaaccacgataagttgcatccagttttcatccttacagtgaaggctgctgtgctagacattgtccctatatttgtcccttcaaagtcttaagatggcttctacagctgcattcatcacatctttacaaggcatgtgtccaggctaaaggaaaaaatggcccttccttatgtcctttaaggtcaaggaaattatttccagaatcttacattttcacggactaagccttccttattactggtcaaaactgaaatccatgtttatttctaaatccatcactggtaagggaaatggaattacaagtctgttgtattctcattaatactttttcctttagggctggggaaagaggctcacctcgctagaggtccttggctcagtcaaaatttggtactattgacaaggaaaagtgaggtgttggcagttagtgagacctcttgagaagttgtctttccagcctttacttgtagtgtcagaaactttctttcaatttgcctggcggacctgacttctgctaggtctattgcccttctttgttataaaggttttgccccttgtt

SEQ ID NO: 621 - DNA, 430 bp, Homo sapiens
  misc_feature (1)...(430): n = A,T,C or G
acataagtttgaaagctaacaattggctttggagcagtttattccaagaaggcaccacttctgagctgggccgtgaggaagggaaagagaggaatacaatgcnngcgtgtgaacgagcataccacctctgcgacaaatggaactcattcctgcgaggactctgagggagatggggtcagtggtgtcctggtgaacggctctgaaggaaactctgatttgtagtttaatgcattgaatggtgtcctctcctaaattcatgttcacccagaacctcagaatgtgactgtatttggacatagggtctttgtacatgtgattattaatgttaagtcatgctgaattattgggggccctatatgcagtgactggtgttcttgtaagatgcagcatcatgcaaaacttgatggaaggttcttttaagatggtggca

SEQ ID NO: 622 - DNA, 555 bp, Homo sapiens
actcactctatggagaggatccgcggaattctaatacactctgtgagtctgtatcttttaagtgaagcatttaggtcatttacattcaatattattattgagaaatgatgttctattctattcatcatgctatttgttgcctgaataccttgtttttttattgtaatttttgttttataagttctgtgagatttatgctttaaagaggttctgttttgatgtgttttcaggctttgtttcaagatttatagctccttttagcagttcttgtagtgctggtttggtcgtagcaaattctctcaccatttgtttgtctagaatcaatattgtgaaaataaccatattgtcaaaagcaatttacaaattgaatgcaattctctttaaaataccatcatcatttttcacacaactggaaaatacaatcctaaaatgtatatggaaccaaaaaagtgcctatatatccaaagcaagactaagctaaaataacaaatttgtaggcattacattaccctattttaaactaatactataatgctatagtcactaaaacatcat

SEQ ID NO: 623 - DNA, 613 bp, Homo sapiens
  misc_feature (1)...(613): n = A,T,C or G
tcatacaccagagctactgtcatataaatcatnttcttattgngctgtacaagcacagtatgcctctagttcttttgtatttagattccataatattttgaggaattcttggaaatgtatttttatattactgagctgaattggatgtaacaattttcacctctttattttttaggttacctctggagtatgcaggcagctttggataggtttgttttgttttgtttttttgagacagggtctcactctgtcacccaggctgtagtgtagtcgtgcgatctcggctcactgcagcctccacctcctgggctcaagtgattctcccactcagccccccaagtagctgggactacatgtacaggaatgcgccactacacccagctttttttctttcttttttatattttttacattaatttcctaaagaggaagtcttgccttgtttcccaagttggtcttaaacttttggaattaatctatcatgtctgcctttggcttttcaatgtgctgggattacaagcatgatccaccttttcccttcctttgggtggttttttttttaaaaaaattgatctttttttaaaattttagttttattaattttccttactta

SEQ ID NO: 624 - DNA, 874 bp, Homo sapiens
  misc_feature (1)...(874): n = A,T,C or G
taataactcctttcattattttattttcacaattaacttctaaatccaaattgtcctagtttttccatttttataacttccctttggaatacatttacttgaggtaaaaagtaaaaggagttaanggagcatgtaagtgaccctgaaagtttgatgtagacacgataaatattgtgaaaagattgttattgtcagagtttcaggaaacctggaccaagcttcaccatttttataccttaagccctccaactttttaatgatttcaggtaaaagaatgatcaaggcacgccacgattaagctgtacatgttgagatcatctctgtgtcttgatattaaaaaccaaatccaatcatcctctcccatcagtgctttcagacactcacgtggtctcatttcttttcaagaccttcacacaggttttctgcctgtagatctgctataataaggacctatagaccaaacaaaatgttgctctcatccatgttacacttgcctccaggagtgagtaatcaaaaccacattcagcaagtttcccagactttgaaagttgttcaaaaacaatgctgagtaattgtagacaaaaacacccaggggctgaaattgatattgactaaacttgaggagatactttcttatatttacacagtcccaattgatgtcttttgtaaactttgaatttgatcctgatacaattacattaaatgttggtattttgttcacaaaacaaaaaaccaattttacttttggaggattttcaaattcaagttattaggaaaagggtcacctggtttttggaaaacgaagttaaatttaacacccaacatttttttttttgtggttaaaaaaattgattcttactcttaaaaaaaaaaa

SEQ ID NO: 625 - DNA, 719 bp, Homo sapiens
atggagaggatccgcggaattcctggccctatattgctattttaagccactgtgtctcagggaaaattgttatgcaccaatcgataattactacagcactatttgaaaaatagttttgatctcacagactccttgaaagggtcttggggacctccaagagtttccataccacattctgaagactgctgaatgcagccatgcaggatttaaagagatatattccataaagatttgaggtcaggagaagcctttgcctataaaaatgaatggaaaacgcaaggtttcatgctaaggagactgttctcattcagtgaccttattgattctgcacacatggtcgaggtgcaaagaaaagggctggttgctttcctcctgatcttccagaagactgagtgctcctcctactctgttatcttcccattttcgtagtctgaaaaaaattactcctgttcctccactcacctgggactttaagcgcacaattttaccatgtgtgttagcacataaactagcataatactaataaatttggagtattgcatttggagagaaaaagaacatcaattaagtctgtatggatcataaataacatcaactagcttctttgaagtaaacaaagctatttctttattaacattgatgaagagctaattaattgtactgttactactgctactaattaataataatggccaatattttttattagatttaaatat

SEQ ID NO: 626 - DNA, 753 bp, Homo sapiens
atttagggtacagatttatcaccccaatcaggagtgtgactgtgagacctgaacagccttcccctgggccaggctggtgtgaggggatcacagtgaactggaggggaagccttgctgcactgcttacaaattatctgagcaggaagaggacaaagtcatacatcatcttccagcccatcattcaccaaaaaggattcggctgcttggaaagggcttgtgaatacattttccctgtcagctcagagagggtggggacggagcctatgttgtctcccagctcctcacagggtccagctccttgcactgttcccagcatctcgcacgcttcctggctcatagtaggtgattaatgaatgtgaactgaagacgcgaatgaacaggtgcatgtgagttgctcatggagtccaggcctgtgtgtggtcagttctgcttttattgtgatgaaacatccagatgcctgaatgtatcattgccagagtcgggcctgtatttccaccagcctagtaagggcagcggcaggtgacaccttgtaagggtacacgggtgctagctgtgacccagacactcagtgtgcattaggtcatttaatctttcaacaaccttaacgatttttacgcattgtttaaaacaaggcacttggagatctgtgaagtgtgtccaaggttgcttcttttgccaagaatatgggacatgaacgttcacccagtccggacagtttttggggcccccggttttttaaccttttttgtttgt

SEQ ID NO: 627 - DNA, 503 bp, Homo sapiens
cctaaccacttactagcatttacgctacagatttatcaccccaatcaggagtgtgactgtgagacctgaacagccttcccctgggccaggctggtgtgaggaagacacagagcactggaggggaagccttgctgcactgcttacaaattatctgagcaggaagaggacaaagtcatacatcatcttccagcccatcattcaccaaaaaggattcggctgcttggaaagggcttgtgaatacattttccctgtcagctcagagagggtggggacggagcctatgttgtctcccagctcctcacagggtccagctccttgcactgttcccagcatctcgcacgcttcctggctcatagtaggtgattaatgaatgtgaactgaagacgcgaatgaacaggtgcatgtgagttgctcatggagtccaggcctgtgtgtggtcagttctgcttttattgtgatgaaacatccagatgcctgaatgtattattgccagagtcgggcct

SEQ ID NO: 628 - DNA, 581 bp, Homo sapiens
tgggagaggatcctctcaattctcggactcaagacatcctctggtctcagtctcccaccgtgttggaattacaggtttgagacactgttcccgaactgttttagtttattgtagaggagtactccttggtgtgaacgtaccggtttgtctgttgcccgctgatggaccatttggattgtttccagttctttgttttccatctttttttttaataagggtaacacatgaacagtttacattgaaagatattcaaacaacacataaatacatagagctcgttaagagttcctttgccctttctccctattcatcagtttctcacagctactaaatttggaattcatttttctgggtttctttccatacatcagaacatgcattcttagtgagggcgatatcttcaataattggagtgaaaattatttattgtaagaatggtgaaaaaacttaggctattacattgatttgtggcctccctaagatcctagtttctgaacagatgtactgtgtgtgtttatctgtgtacagtcttagtattaaaatttctttttatgctatttttagataaatttattacatat

SEQ ID NO: 629 - DNA, 614 bp, Homo sapiens
actcactctatgcagaggatccgcggaattccccttcaggaacccaagattttattgtatttatttatttattttgagatggagtctcattctgtagcccaagatagagggcagaggcacgatctcagcccaccacaacctcactgagctcccaggttcaagcaattctcctgcctcagcctcctgagtagccaggattacaggcacccgccaccacacccggctaatttttttgtatttttagtagaggcggagtttcaccatgttggccaggctggtctcgaactcctgacctcgtgatccgcccacctcagcctcctaaagtgctgggattacaggtgtgagccaccgcgcccggcccgattatcttttctttctatgcttgggtggggagtgcccggcaggcagtcttacattcaacattcaagtcatagttttgggccacatgcatgtgtactttacttaaagaatgaaaaacattgttactctttggtaaaatatttcatactttactgtgaggatgctaattaaacattaaaaatgagaccttacattgtgattaggcttcattcaaaattttataaggacataaagtgtgactccagctaccaatg

SEQ ID NO: 630 - DNA, 824 bp, Homo sapiens
ctcacaactcccatcggagcagggctggcagacagtgcaaaagagtcttgaagccggacaacagcgggggattccagcactgccattctctactggaatgctcagctgaatgcttgaccctggagaaattctttctctctctgaagttttccttagtggagagggagaaaatgaaaaaatatgcatatgcctattttgttaaatgtaaggtaataatagctattaagattcaactatttgtaagaaggtgagagttaaaagacagtctgggagacaagcacaacaggcaggacctgacatggagcagagtgctcatcagattgagtatttctcaaccttcagtgatcaccataaattttctatgactttctattcatcccatctatatcattcatcatttgaatacttctggctgtttaattaaacacattgactcacttttcttttttacttaaatatgtattaaaggaagccttatatctaaaccaaaaatggaaaaactaatttatccatggccattaattaaaaggtaccattataataaaaaaaattcaacagtttttatcaaacttgagctagcttggtcagtcatttaaaggcgtcatgcttgaaggcccacttctgcctttcttttttttaaacaaaaaagtttaaaaaagggttaaaaattattgggtacccaaaaggaaaacctcctttgttgatttaattttttagaaaaaatgggttaatttaaaaagtgattaactttacctttggattcaaaggtttatatctggttttaaaaaattttaaaaaacttaaaaatttggcaaaaccaaacc

SEQ ID NO: 631 - DNA, 685 bp, Homo sapiens
gactcactatatggagaggatccgcggaattcatctgaagggtaccatggagcttactattcttgcagcttttctagaggttctctaggtattaaatttttttcaaaaataaaaggtttggttgagcatgggtggctcacatctgtaatcccagcactttgggaggccaaggcaggtggaatatatgagcctaggggtttgagtccagcttgggtaacatgccaaaacccggtcttaaaaaaaaaaaaaaaaagccacaaaaatacaaaacaaacaaaaaaacgagtagggcatagcggcacacgcctataatcccagctacatgggagactgataggggaggactgcttaagcccaggaggcagaggttgcagtgagccaagattacaccactgcactccagtctgggccacagatcaatactttatcttaaaaaaaaattaattaaaattaaatcacaggttaaaagttactaacctatacatatacattctattgcatagtagtaacatattattttaggtgttttaataaatttagacttttctttaaattaagaaaaaataaaagcatttgtcatgtgcttaactgtttaccctctaaaattttaattttgagcctcaattcctaatattttcaaatgtgactaaattggctctttaaaaggttacaagatttaaaatta

SEQ ID NO: 632 - DNA, 856 bp, Homo sapiens
acctccaaagtctgtatgttgaagccctaacacccagttcctcagaatgtcaccgtatttggagatagggcctttaaagatgtgattaagttaaaattaggtcattaggggaagccctaatccaatgtgactgttgtcctcgaaagaggaggagattaggattaggacacagacacacatgcagggggacgaccatgtgaggacccggcagggaggcagccattcgcaagcccagaagagaggcttcagaagaaaccaagcctgccagcacctagatcttagacttccagcctccagaaaagtgagaaaatacgtttctgtatctcaagccccgccagcctatggtattttgttatggcagcctgaggagactaatacaccttccaccctactcactgtggctggattttccaaaagagtggaaagatttcacattgtctctcttctgaaattcttcactcccttcctgtcaagaatagagccccttctaaagatcctcccacaagagcatggcaaatggcctttgggggggcccaacattgtgtattcatttctgatatggggtttaaggtctggctagaacccagctccagacagcttggcccagcaatgcagcaacatccaagtttttaaccttttaagagaaaggaatggggctttgtttgtcccaatccggtttttcagttttgcagtcaatctccaaaaccagagttgtggttttccgaataatggcttgtttgcttaaaataaatttgaaaatggggaaaatactggatatttccctgccaatttcttaatttttttaaaaaatgacttacctcattttttgttttttccccccatattttttttcttt

SEQ ID NO: 633 - DNA, 580 bp, Homo sapiens
ctctgggagaggatccgcggaattcaccaagcatagagcctgcgctagcagtgagcttcttatgatatgtgacaatacagtttctttttattccctaagccgtttttatccctgttgcttacagccaaagtcattctacgtagataagcctcttcttgccaatatgcattgcttcccttagcatgcctacatttctatatcatgctaaagaattgtctttttcaggggtgatgagcacaggagtggagctctgtgacttctggtatctttgcactggtcttgagcatttctgagtcttctgttagaggcagacaataatctcagtggcagattatgcgaatgttggctttgagatgggcagttccttgggtccatgatgtgcattccacgtgatttctgaagttcataaacatatggacactagttcctgatcaagtatgatgtggatctgtgctcttccagcatgagcctcctaagaggagggtacatctgatggcatcagctgtgaaaggaagactctgccttttgagcagttactgactcagttgagagataatttctgggttatctttctatttct

SEQ ID NO: 634 - DNA, 647 bp, Homo sapiens
cagtggttacttttactgaagcagcaatgaacagcagcaacacatgtcctgcccctggcagcagcagggctgctccacaggccgtgctcccagagcagaaactcagaggcagttctgcagtcgtactgatacccacttttaattacatgcaaattaaggggcaagttatgcagcaatttctagaaatagagtaataacttccaggtcattgggtcgttgccatggaaaggggaggcagcttttgggtgttaccatggcaatgataaaccaacatggactggtgggcatatattatggggaggtgcttatgccttgtacctgtttcaggtagtcttcaatctggtccacagcccaagccccacttctggagtcaagtctcacctcctacctcaaactgacctaagtttatctaattattactctgtgtgatcaattttcatttaattacccatgcacttatcatggcctttcattcattcctgcatttgcatgctttcttagagctggttttccttctatttgaaaatgcctttagcatctctttcactgaaggctgactaagtcaaagtctttctggttggtttttcaaaaatactattaattagtcttcatttttaaaaaatatatttttttatatatagaattct

SEQ ID NO: 635 - DNA, 532 bp, Homo sapiens
  misc_feature (1)...(532): n = A,T,C or G
gactcactatatggagaggatccgcggaattccagctgaggtgatggagtgagacccggtctcaaaataataataatgataataataatatcctgtaagtgagaacacacacgagtgcagcctttttggggatatttccataacacatatcaaagttctttaaaatctgcaaatctctgactgttgaattctacagtgaagaacttcgttttaggaaatggtaaaaaataagctctaagaagtatagacagagacattctttacagcactacttataatattgaaaaatggctaacaaagttaatttccaataataggcaattggctaagtaaagataaaaggcatggagtgaaaatttgtgcagtaattatcaataaagtcacaaaataatccttaatgacacatgaaaatggttatggtatattntaaatggaaaaaaatattatgttagagtaagctgtatatgtacaaattacacgcaattgttggataaaaatattcaattttttaaaggtgactgcataactcgta

SEQ ID NO: 636 - DNA, 560 bp, Homo sapiens
tactcgatgtttctttcctcatatattcctccaaaaacagtccagtacagaattgcaggttgaagcactgtgaataggctctaggtttgccccaggttaagggttaatatgttgagtttaagaacaggtaggcgacgccctcctggattttaaacagataacgtccttgccatgtaagagcacttagaaggctggctttatctctttaaaaaaaaaatatatatatatatatacacacacacacacacacatatatacacacacacatatatatacacacacatatatacacacacacatacacacacacatatatacacacacatatacacacacatatatacacacacatatatacacacatatatacacacatatatacacacacatatatatacacacacatatacacacacatacacacacatatatacacacacatatatacacacacatatatacacacacatatatatacacacacacacacatatatacacacactatatatatatatatgattgtgtttgttgttgttgcagttgcagtaatgaaatata

SEQ ID NO: 637 - DNA, 680 bp, Homo sapiens
cgcggaattccagcaagtcccttaatacatggtactgacaactgagccgtgaaccacagaagcatgtaatatacactaatcatgaacaaatcaccaaatactccaaaaattacatcatgacacacagtaacagccacaagagcaattttcctagtagaacaatttattaattaatatgcaataaaatatctccccaaaatctttccagaaatgacaaggcaggaaagtgaatacttttatgcttctctggaaatttttaatgtaaacatgaaatatttgaagaaccgattaaaaagtctcaagtgaatctgtaaatacatttttaagtctgacttcaaatcggtacatgaggcttatacatacacatcattggacaagtgacttaaatatctaaatacaaatcaaatagcattttcctaacttcaactataaaaacacaaatttcagtaggtactgcaaatctaagaagaataacttgaaaaataccataataagtgttgtaaaaggggaggactcatatgacagaccttgaaggaaaggtgggacatcacgggaggcaggtccccctgtggacatgattccacagaggcgtggagtccttttgccaccagcatgatcctgaaatattgaaaacccttaagacaagtgataccttcaacatagccacaaaatcagtgaat

SEQ ID NO: 638 - DNA, 621 bp, Homo sapiens
gcaccgcggaataaacagattgctgaatatgcggacctttcccatctccatgaccgaacaaagccagcatggtttcttttcatcataaaattgtcatcagataatgggagacaccccgatgcaatgactgtaataaaaactagatagcaaagcaattcagcagagcttgccctgcaggcatctgcactcatcctcagactcactctgactctccatcccggactacagtctcgtgcctcatgctatttgcctgcgtcctgtctcaggccttgttcagaggcccagatgaagagcccgcctccatgtaaagcagcgtgtcctgaagcctggagatttgagacagggccttgagtggtccatgggcctggaaccaagcaactctgatgtctctgagcatctcattccatcacccaaacgtcggggtgttcggcacccaaacatcaccttgacagcaggtctccctccccctaaagccctcccctgctgtattttctcgatcccactaaccacgatccaatgtacttcatatcttagacgtttatttcatttattgtcagtctctccccaccgaggcgtatgccccatgagagcagagacctttcttctgcctgttcgctctgc

SEQ ID NO: 639 - DNA, 433 bp, Homo sapiens
ctactctgggagaggatccgcggaattcctggccttgagttatccttccacctcggcctcccaaagtgctgggattacaggtgtgagccactgcgcccggactaacctagtaacttttatctgaaatgcaaggttccccctctcccagcagtggagctcacgggtcctttgcatgaaaggcgtctcagtgcgtaggtcgggtgcctgtggtctggcttcctgtctggcacccctgcttttattctggtttttctttcgggaggcatgacagtaagtatctgctgttagtttgaactcacatttgtaagtgaaagaaaccttttctttttttgagacggagtctgtctcttttgtccagactgcagtgcagttgtactacttaagcttactgcaagcttcactacgcgggttcacgccattcttttgcttcaga

SEQ ID NO: 640 - DNA, 571 bp, Homo sapiens
cccagggctcatcccgcgctcctggcatccactggcttccccacggcggggagcccgcctgccccccttgcagatgcccccactcctcacctgagagcagcacccacccggggccgcccacccggcacagcgcctgccctctgctcggccccggccaccccaagccggcgcagggtccatgctgtactcccaacccctggctccccacggcccgtgaggatgctcagcctcatgcaaaggtctcaggacgaaattgtccaggaagggaaggcgagcgggaggaagggggcgggcagacaagctgtgcggcctcttctcgcctctcctggctgcgccctcaggtccccgattcgagcttcctgcccccactgcctgcatcctaccggcgcctgactgcacttagggcctcctggaagtgcagactcgcctcttcatctcaagacccttaacttacttacacctgcgaagctcctgttaccacatgtggcagcactcccaggttccacggcggggatgcgttttcttgccgtcgctcagtctaccacgcagacctaccggccccttctttctt

SEQ ID NO: 641 - DNA, 613 bp, Homo sapiens
gacagagaccatataaatgtggcgaatgtgggaaatctttcacaagaaagtcacaccttatgaggcatcacaggattcatacaggagataaatactatggatgcaatgagtgtgggaccaccttcaacaggaagtcgcagcttatgatacatcagagaaatcatataatataaaaatcatgactttggcgaatgcagaaaggttgctatcaagtgtcatactttctgacacttttgaggatgcatgtgggagagaaaccctattgaggcagtgactgttgaaaaagcttgaattgaggagtcaagagtcactaagcagaatttagaaagagaagtttttaaaaagcaaacagtgtaaaaaaagtcatctcccagaagacactactcgttacatattggatgactcattgaggtgaaaaccttattagtgttgtgatagtagagaagcttttagtcaaaagtcagtttattaaatgtttagaatacctaaacaggaagaaaattctattgttttttataacaaagtggaagatttcaagaaaggacaactcactgtacacttgagaataatacctacagaggtttatactgaacaatagtcttaataatgtaaa

SEQ ID NO: 642 - DNA, 493 bp, Homo sapiens
tacgaagctgtggcttccacgcaaaagctttcctacattcactacattcaaagggcttttctccagtatgtgttctctgaaaatgaatgtatacttgtaggctcactgtaggttttcctgcattcactgcattcatagggtttctcacctgtatgtgttctctgatgtgatatcaggcttgacttctgggtgaaggccttcccacactcactgcattcataaggcttctccccagtgtgtgttctgtgatgcgttaggagctgggacttcccaaagaaggttttcccacattgaatgcatccatatggtttttctcctaagtgaatttttagatgtcttattaactctgacttcttaaagaaggcctccttacaatcactgcattgatagttcttttctcctgtgtgagctttctgatgtttaatcagctgtggtttttctgattaaagctttaccacattcgtttcatttcttagggcttctctcctgtata

SEQ ID NO: 643 - DNA, 715 bp, Homo sapiens
cttggagaggatccgcggaattctgaaaagctgcgagagaagtaagtttaagagaaaagctgacaccttggaaaccaactttcccactttcaggagaggaggtcatatgccccaacaaaattattttacacccagggccagggactttacctcttcatgcagcttctgtcttccccatctctagggatccctttcaccttggtgggataactgacatagggtgcttggacagggtgaagtttctgatacgctggtccatgtcacagtccggttaccctggctcagccctctccctttctacaagctgctccccccgcctcctgcctcaaatgcccacattggctcttaacaaaagccctcgacgctgtgcccaacgcacccttacctctgcaaaccatagcagcggcaggaccacaggctcaatcttcccagtttgtctggaaataagcaagacatagctgtgtgaaacaaagtcttacacctaaacttgatctaattctgcttgaatacaacatctaaacaggtttagtataattttgcacacactaaaccctcaccaccaaatataaacaatgagctgaaacactttatgagccatatgacaaaactgtcctcaggctgaaggtctcagtctacagcccctcaataatacttgtaaataagacttacttttaaatcttttaaagggcgttttgtttttttttttctttaattt

SEQ ID NO: 644 - DNA, 931 bp, Homo sapiens
agcagacgtttcagtgagccaagatcctgctactgcactccagcccagaagacagagcaagactccatctcaaaaaataaaataaaataaaataaaataaaataaaaaaatatgtgattggtaattgtagtgggatgaatagtgacctcttacaagatatatctgcccagaacctcaaaaggtgaccttacttggaatccaagggtctttaaagagataattaagggagagagctcaaatgagttgatcctggattagggtggatcctaaatcccatgacatgtgtccttataggagacagcaaaggaaaaagcaggccatttgtggtagctgacacctgtaatcccagaacttttggaggctgaggtgggaggatggcttgagcctgggagttggagaccagcctgggcagcagattgagacccccatttctacaaaaaatgtaacaacaacaacaaacataaagaaagaaaaggggaaagtacacagaggcatggagaggaaggctatgtgaaaaagtgggcagagagtgcaatgatgaaactacatgacaaaaggacaccaaggccaccactagaaactgggtgtgggaggttgcattggaacaatttttccccatagcccttcataaggaacaatatctgttttatccctttaattttgactcttgttctatcagaacttgtgaaagaattaattttttttctgtttatatgccactcatattgagtttattcctttccctccatattttttaaatcaatataggtattataataatctaaaaccctgttcttctttttttttcattctgaatatttattttaaagtcttttttttttgaatatgtctgattcttttaccatatttatgttgtcatactactttctctgtttaatatatattatatttcttttataaatatttttat

SEQ ID NO: 645 - DNA, 849 bp, Homo sapiens
gctactaccaaacataattggccttagaattcatcgtacatccaaacttgacagaacgaagaacaaaagtacataaatgctcacctacagttgcagagagattagagtaggcctaatcattggaatgcacaaaagtagcattacgggaaggaagcacagtgagcttgtgggttcgggacgctgggtgaaacaacaaaaagaaaaagcacagcaagtgagtgagacaaaagacaaatgggaccaacatatctctcaacctgcagcaagcaccaggaggggctctttcatccaagagcaccctggactttctcttcggacctcacatcccccagcctccaccacccttgtttactttggtcagcagctcggacactccagtggccccactcagttcccacaccagggcgtgatggctgctgaatttggccgcaagcgatagttctaattttctggctccaacacataggcagatacttagttgagagatatgaaattgaacttggccactcataacacaggctcaacaaaaggatgaatggttatgatgtcacaagaactgatgagacagacactctgcatgaaaatgactgcttgagatgattacaaatggacaaaacgaccgatagttttgtaacaaacgacaaagtcgtacatcttaaaaggcttgtccaaacttttcacctgttccccgaatcataatgtcctgatgggggctatactttttcttttcttcccttaagaagggttgtgattcaatttaaaattatcccagcatttgcttttcctaccctagaaaattccatccattttgggaaagtgtaataaaaaatcctttccatatttgtaatt

SEQ ID NO: 646 - DNA, 505 bp, Homo sapiens
cgcggaattctgctggcatctgggaacccagattttatgagggtccctaccattttctaactgatgagagtagttcactgggacgaaattatttgtacaaacaatatggttcttgctcagcacctgctttccttcccagagcctagaattttggtacctgccaggcagaggtgcccacatgactggcccctagcaaaacaccatgggcactgaatttctaatgagcttccctgctagacaacatctcctacatgttgtcacaactcattgctaaagacattaagtgcatcctgtatgaacctcctgtaagatgactctggaagctccagcctggcctcccccgacttcacccaaggtgctttttccctttgctaattttgctttgaattctgtcattacaataagtcttagctgtgataccaccataagcagcgtcctgttgagtcccccgtccccatgccctcccccagtttcaggagcagaaaagtggccacactgaagcagc

SEQ ID NO: 647 - DNA, 674 bp, Homo sapiens
aacgttcccacctagtctcgactagttggacgatccggccacaccagcagtgtccccaccaagctgctgacccttaaatggcctgtgtgcaccctcccacccagtcacaaccccactctgtggtctcctcagcctgtgctgctcatttacatgaggcctgactggtgcctgtgagcactgtcagttagtgactgtttatcgagtgcagagactgtcccaggctctctgctaggccctggggatagagcagtgcacagaaataaagtcctttctcttaaggagcttcccagtgtcatggcgggagatgtaatcgtgggaagtcatcaggcgagtgcatctgtgtcccacgctgggaagcactgagcagaaaatgaagcagggaagagcgaggtggagggagaagggtgagatgtggggtttgtttttggttttggttttgttttgggtttttttgtgttttgttttgtttttgtttgtttttttatttttttccttttttttcggttttttttctgttctccgtttttgggtataatctctattacatcttttacattgttctttattttatttatgtttatcttttttgactatttgtagatttcttttttttttctttatcctatttttttaatcttaatctcacttttcttatttcttttcttatttgtcta

SEQ ID NO: 648 - DNA, 597 bp, Homo sapiens
  misc_feature (1)...(597): n = A,T,C or G
ccttctcctgacgtgccgcanatgccatttattttctaagcgtcagaggaagccactggcaagtgagactggggcgtacatatnaaaacataagaggctaatactagaatcgcattcagcctgtccagatgccctgtcacgggacccaggaagaacagcagggtcacaagaaactcactccctacattgacactaaccaagtctacttatgagggtcactgctgttttcctttttttttctaattgaatgcatgtagatgattttgcatgaatgacatgcttatgggccacacctccacattcctgcacggagcaaaatcacaagcagaatggacctcggtctcctgactcagcctcgcacagtcctgctaatgagaacaaagtgaaacataaaggattccatttttttttttttttttttgagatggagtctcactgtcacctaggctgaagtgcaagtggcgcgatctcagctcactgcaacctccaccttccgagttcaagcagtccttcgcctcagccttccaagtaactgggactacaagtgtgtgccaccatgcccagctaatttttgtgtttttagtagagatggggttt

SEQ ID NO: 649 - DNA, 744 bp, Homo sapiens
agccatctttaacagcccatcctttccacttaaggaaatttcagtggtatccctaaggttgtcttaacacttggtgagttcaagccacaacaaattgcataatgaaaagagcatataaaaacaaagacaactgcaaaaactttaggattacatcattttagatagttattaattggtatttaatgctaaagtaattactcttaaaaattatctttggccaggcatggtagctcaagcctgtaatcccagcagtttgggaggccaagctggttggtcacctgaggtcaggagttcgagaccagcctggccaacgtgatgaaaccctgtatctactaaaaacacacaaaaaaattagccaggtatggtggtgggcgcctgttaatcccagctacttgggaggctgaggcaggagaatcgcttgaatctgggaggcggagcttgcaggtgagccaaggttgcaccattgcactccatcctcggtgacaagagtgaaacaccatctcaaaaaaaaaaaaaatgtatttttacaccaactttataaaggcaaagcatgggaacccacagagcctcatggaatgggaggttactcagtaagactagccctgagtgttctccatcttcacaggtgggcaagtttcaaatcaaagcttaatttaaatgcttaagaattgcctaaccatattctgttgctaaactttgagggaaaccactttttttttttgagacaaaattttgttttgttcg

SEQ ID NO: 650 - DNA, 605 bp, Homo sapiens
  misc_feature (1)...(605): n = A,T,C or G
tactagggagaggatccgcggaattccactccctcaacagatagcagcatacctctctgaatatacggtgagctctctgaacccctgaaagtttccctgagaaaaacaggagtaacctgatatttcagtccttacgaagcttcttttctcttgattctttctcattaacttatttattattattattattattattttgggggttgggggacagggtctcacttttttgcccaggctggagtgcagtggcacgagcctggctaagtgcagccttatccacctgggctcaagcagtcctctccctcagcctcctgagtggttgggactccaagtgcatgccacaacccctggctaatttttgtattttttgtagagacagggtttcaccatgttgtccaggctggtctcaaacacctgacctcaagacattctttcatcttagtcttccaaagtgctgggattacaggtgtgagccaccacacctgggccctatttttatttaaaaaaaacattaaagtctggtttagaacaacttanacaagcatctaatcctttggagggcttatgaaaagggacactgctgggcccctcttccgagtgtccga

SEQ ID NO: 651 - DNA, 778 bp, Homo sapiens
ctcagagagcagcttcaggcctgtggcgtgaactctgttctactcacgggtgatctcatgcccatcccaccaggctctcgagggcaagcactccccagtcgtgggcgtaagtgaggcctttaatgagctcttctttgccacaggggcctggaaggtcctcagcatgctgggccataatgaagaaaacatcctttccctatagtgtacgtgataataacctaggcatttatggccctgcgtgtggctatcttgcataccttacttttgctcttgcaaaaattctgtcaggtcgggagagttctctctgttttacagatgaggacgcgactctcagttaagaagaaccaactgcagttctctgacctcaaatctagttttatttccactatcatttcctgacttcattctggaaccaccttcctgttgtttttgatgacacatgtgtgtcacttcggttatttacttaaaaaaaaaagtctcgttaaaaagagctgggtatagtggctcatggctgtaattccactgctttgggaggctgaagcaggaagatcacttgaggctaggagtttgacgccagcctgggcaacatagtgaaactttgtctttacaaaaataataatgataaataggcctgggtggggtggctaacccctgtaatcccactttgggaggccaaaggtggacaattatctttcttcccaggaatttgtaaactgcctttttaaacatggttaaaaacccttttttttttttaataattcaaaatatttatctctat

SEQ ID NO: 652 - DNA, 772 bp, Homo sapiens
atgtagaggatccgcggaattctttcctgggcaatgccaagaaccctcctgggttaagccccaattttggggcttatctgccctgagacataggagtttgaatttaactagatactgtttataatagtgattttgctttgagaatcactttaatttgggttaaatctaatatgaacttgtaatgaaattttgagacagaccttaccagtggggcagctgaggggcttttgtaggataatatttaaacacagtcagtatctctagaatttccatgtagtaagagaaagagcaagtatagtattgcaagcgtggccctttccgtctcagacgtgtttcatttcccaaaaaggttgtgaatggttttgttgttatttatttctgactaatgtaaaacatgttgctcttgatacctttaaaacagttgcacaaagaaagacattcatgttttatctgcctttagaagttcctcttaggctataacatttttcatgaacataaatttgcatttaaacatttttatagggaagtgtttgtatgattattaattagcccctgtgatattagctcacaaaactatatttacttgggtatgccgtattttaaatatatgtatccctacatattaatttcatggtatttcccttgagtacgtatgtttttccttttagaaattgaaataaaattactgtctctttgtatctccaaagggaaaaattttttctttttgaaaactacttggtaaggttatcacttttaattaatttccctactt

SEQ ID NO: 653 - DNA, 675 bp, Homo sapiens
cgtcgcatacagctatcagaagcatagtaactgacagttgttttccaattgtgtcttctggaaatcttgttcctaatagaattaaaataggtagaagagctgggaaaaaaaaatatgctccacggtctattaattttgaaaaacactggatcaataaagctcagcaggttcttctctgctcaacttctcagagcctttactggtcccaggctttgggaatctccaggaggaagataaggaatgcactattctccaaacttatttaatgctaacttgtttgattttgttcgtgaaacccttaatatcccaaagaacataatcgaagacaggatgtgcaattttcccaggatttaggaatttaaatacttaaaccaagttttagactattttggaagaaaacatcaacattcaacaggcttgtgtgtacagtatttgcatactactcaattgtactttttttctacttttatgtgccaattttttttttctgaaatggagtctccctctgttgcccaagctgtagtgcattggcacaatttcagcttactggaaccttttcttttccaggttaatgctaatctcctacctcagacttcccgagtagctgtgattactggcacctgccaccattcccccactaattttgtatttttagtaaatacggggtttccacca

SEQ ID NO: 654 - DNA, 661 bp, Homo sapiens
tatggagaggatccgcggaattcctgttttagcaaacaaactctttaaacattgtattgtgtctcagtttacctaaagaacaagttctgacctagggagactgttgaccttaaaagaagaggagattaagagacaggtgcacacagaggaaagaacatatgaaggcatcgggagaaggcagcatctacaatcttcagagagaggccttagaaggatccaaacctgcctgtaccttgattttggccttccagcctccagaactgtgagaaaataaactcctgttggtgaagcactcccagagtgtggtgctttgttttggcagcccaagcagactcatacagaaggcttctttggggtttgggcatttccaaggtgtcataattcaagatggggtgtgagtcaaggggaggtcttagagaagagcattccatgctttgaaaaaagcatatgcaataatttcttcatctccattgagaaatgctgttaaaacaaactgtataataaaattaactgttctgcttacttgcttgagatgttgcccaggggatggtttaccatattccagtgtctcttttgtgagaattcacaaaatgaatcttgttctgggtctgatatttagatgaacttgtgtattttttcaggaaaccattttggtttcatt

SEQ ID NO: 655 - DNA, 660 bp, Homo sapiens
aacatatcacatgtgataaaaattaatgaaattttgaaaaatcaaacttggaaatccatgtcagcaaatcacacatctgtccagagatttgtgcatttgaagagtcatttgagacagctccttacatgccaataatctccacaagtgcctcagttacggttaataacgcatggaacgcgcggcccacacgcagccaaccaatgacagcgctcctgccagccctgcggctgctccactttcaaatgtgttgaaaaattgctgatcttctctgcagattcctgaattgtgcctccaaaacaaatgggtggttttgagtgtgtggccaccttctttctcttcctcacaaaacctcatccctgctatgtagaatgtgggcgtccttggctatgtagaacatgggcatgacagtgtgtatgtaacactcttggctttttcccttaataacatatgttttaaatttttctaccattctgatgatttcatttgtattccttaatatggatgaaatgccattgcctcttcttaattcctaatgaaaatgattatgaagacactgtgtattgatcattgttatatgtcaacactgtcttagtgactttatttttattcatttttttaatttttaaatccattaccttattgatactagtatttttttca

SEQ ID NO: 656 - DNA, 883 bp, Homo sapiens
tattagcccctgtctttctaaatcagtagacacaggaaatgatcttctttaattggtgtgaatgagcactctttataaatgtgtgagatctcaccatacagatgtgtgggttttttttttttttttttctttttttctagagatggagtttcacgtttgttgcccgggctggagtgcagtggtaccatcttggctcactgcagcctttcacctcccgggtttaagtgacaattttctggcctcagcctcccaagcagttgagattacaggcgccagccaccacgcctggctaattatttgtatttttagttgagacggggtttcatcgtgttggccaagctgattctgaattcctgacctcaattgatcacccaccttggcctcccaaagtgctgggattacattcataagccactgcgcctggcccagacgtgtattatattgtgtttatttgataaatgcactgttgaacatgcactttatgttcacattgaaaaaggaagtgccagaataacccagctttaaaaaggtctttagaatataggaagttctactttttaatataaacaaattacaaagtgtttttttagtagagcagaaaattggacatcttgatttcataacacttccttccccttttgattttgccgggccacaccctcctttcacctttgtgcaaaaacgttcagaattttttttccactgtgggcatgttattttccttggattgttagacataaggtactccttttttgtcaagaacctccttgtttgatatcattttggcaatatttttttttgtcctggttttcccattttttacttgttttatagtccttcccttttttttttttatctttttgttccccttttgttcctttta

SEQ ID NO: 657 - DNA, 816 bp, Homo sapiens
gactcactataggcagaggatccgcggaattcaaacctgggaggtctgcctcggaggacaagctgtcgcttgtgcttattcttgtcctgaaaggaaagacaccaaatggatcaccccagctggcagacactgctccaccctggttcccgttaaatctctttcactgctctatatccctcggtaggtgtgttagccagctagggctgcctgaacaaaattccacagactggttggcttaaaacacagaaatttattttctcaccatctgaattctggaaagtccgaggtcagggtgctgtcaagggtggtttctggtgagggatctcttcctggcttgcagttcgccaccctctcggcatcttgtgtcctcagagggcctttcctctgtgcatggagagagagaagctcctggtgtcttgtctttttttttttttcgagacagggtcttgctctgtcacccagcctggggtgcagtggtgtaaacaggactcactgtagccttgactttctgggctcaagctatccttctcttaagcgatcctccaagtagctgagactacaggcatgcaccaccaagcccaactaatgtttgcattttttgtagagatagggtttcatcatgtttcccaggatggtttcaaactcctgacctcaagtgaaccacttacctttgtcttccaaagttttgagaattcatgtttgagccacttaacttgcttttttaattttccctaaaggcacccatccttttggtgatagaatcctctcttatgacttttattaacctttaatttccatttttaagagctttttttt

SEQ ID NO: 658 - DNA, 580 bp, Homo sapiens
gtacaacctggaacaaaggtttgaaagcaaacaattgattttggagcagtttattccaagaaggcaccacttcagagctgggccgtgaggtagggaaagaaaggaatacaatgcaggcgtgtgaacgagcataccacctctgcgacaaatggaactcagtcctgcgaggactctgagggagatggggtcagtggtgtcctggtgaacggctctgaaggaaactctgatttgtagtttaatgcattgaatggtgtcctctcctaaattcatgtccacccagaacctcagaatgtgactgtatttggacatagggtctttgtacatgtgattattaatgttaagtcatgctgaattagtgtgggccctatatgcagtgactggtgttcttgtaagatgcagcaacatgcaaaactggagggaaggcactgtaaagatgggggcagagactggagcaacgcagccacaagccaaggaattgccgaagccaccaggagctggaagaggggaagcaggaacctccttttaaacctttggagggagcatgggccactgacaccatgatttcagacttttagctttt

SEQ ID NO: 659 - DNA, 597 bp, Homo sapiens
tatggagaggatccgcggaattccaaggccaccagtataaaagcaagatgcaagaagtcaggtgagtcttcactaagagtcaactacataaaacacaggatggtctgagaaagaagaagagacattatagacaggcaagcaaaaggccaccagtggcagccggtcatcaggcaggagtgacacttgccttatgtcccaagattcttctcacccctcaagctgggcagccctgcttggccaagctggggctcacaggaacaggaagcagatatgaggcagacagaaagcagatgaagggcaaataggaagtcagcaggagcaaatgggaagcagacagggagagagaggaagtggaaaggaatcagacacagaacaaaatggaagaagcagatagttcctgctcccagctccagccttgcagttgcctctatcttcccttataggcaggacctaagaaggaacacctgactaagagtggttttgcagagacccacccttagcatcacacaccatagaatagaacagcaaggttaaaacttaaagcctattatgtaataactgacacattccacttaacataggaagaaactgaggcac

SEQ ID NO: 660 - DNA, 765 bp, Homo sapiens
atctgggagaggatccgctgaattcaccaaccaactatctgctgccttcaagagactcacctaacacatattgactcacataaacttaaggtagaggagaggaaaaagacatttcatgcaaatggacaccaaaagcaagcgggagtatttattcttgtatcagatgaaacaaactttaaagcaacagcagtttaaaaagacaaagagggacattatataatgataagaagccttgttcaacaggaaaatatcacaatcctgaatatatatgcacctaacactggagttcccaaatttataaaacagttactactagacctaataaatgagatagacagcaacacaataatagtgggggacttcaatactccactgacagcactagacaggtcaagacagaaagtcaacaaaaaaacaatggacttaaactataccttggaacaggccaggcgtggtggctcatgcctgtaatcccagcaccgtgggaggccgatgtgggctgatcacaatgtcaggagatcaagaccattctgtctaacatggctaaaccccatctctactaaaaatactaaaaaattagccggccatggtggcaggcgcctgtagtcccagctactttgtgaggctgaagcatgaaaatggcaattaaccttgtgaggcttgagcttttattgagcccagaatgcccccattgcacttcaagctctgggcgacagaatgagaactctttttttaaaaaaaaaaaaaaaaaattttatcctttga

SEQ ID NO: 661 - DNA, 854 bp, Homo sapiens
  misc_feature (1)...(854): n = A,T,C or G
gcctttatgttgtttactgatacagctacccataaggcattaaaatgtcccttcttcccattcctatttaccttactcgtgtttttacaatttagaaaaaaagcgtnaattgcaacttttcccatcttttctgatctaggcataatattctctgatgcacaccatcgtttcattagagaaattgatataaatccacctgctatagccttggggattaacaccaaactctgtgaacatgctgcaaagagaaaaacaaacagaaaaaaaaaatatctagcattagatgaattaacaaaccaaaaaaccactgctggtgaaccgaagaaaattaaattgattctgaagaaaagtgctgattctttaggaaaatgtgattagaggtagcctggcctggagcttaagattgtcaaaaaacactgttacatgtttgtcaaatcctttttgatgggaagttcacaggttataaaaaaaatacatttcaaagctttaaatcttagctgaagcctaatcctcaatgttgcatataaccaaccaagcactttgatttaggtatcaatgaccagctacactggacaggttttctggcttcattcagggtcccagtgctagccatttcattttgaaggcaggagtcatctcttccctgtctagccacgtgtgtttcattaatgaggaatagtgggtagagtctttttttaaatgccttttttattatttggaatttccagcccatttttttttggaagtaggttttattttttttttttgaggtcataaaaattttttatttcttttcgtttatattggtttttccatttttttttatttttttcttttttctgctttttattatt

SEQ ID NO: 662 - DNA, 927 bp, Homo sapiens
  misc_feature (1)...(927): n = A,T,C or G
ngatgatccatcattccttcttggtccagaaggatacatgaagatcctatagcggtgtataatgtaaaaaccttannggtgagaatctaagatcaaatgtacagantccagagtggcttgtctctatcagagtccacagaatggctttaagtatcatgaaaaacacctaggtattatagtttgcagaactaccaacaaaatagagaatataggcataacatcaggtctgagggaggaacagaaggaatttagtttggacacatttgagtgaaggtaaagggaagactggtagagagatagctgaaaatatgggatcatgggattcaggggtagtggacccctaatttatttccccacaaaagaaagcatctttacacaacacactacctcattaactacctctgctttctcctaaaccaaggattctcaaccctgactgcttggcgaatgtttataatatgcttaggccctgcccccttataacttcttcacaattgtccctagttgagcccctactctttcttctttgatattctattattatttaaattgtatcagctttagtaaataagtctattttactctttcttagtaatacctcttcgtccctcattgtatacctattaaaaattgaaatacttaatacttttgataaacctacctcttttatggaacaacattgtattcattttctcattcaatatcattataatagtaacaatgctacttttttttatttcataactacccatattactttctatattttttctaatatcgttctacagtgttaaactcacttcttttttcttatgtatttcgttccactgatctcatttcttttaaactatattccactgtgtacatacattctctttttaccaatatttattccacttatgaccctctcatctctctcccatttga

SEQ ID NO: 663 - DNA, 830 bp, Homo sapiens
  misc_feature (1)...(830): n = A,T,C or G
cacactaatctnactcactctatggagaggatccgcggaattcagaaaatcttcatgttcatgtaaaatcctctcattttctttttcatttggcaattactttattcatttattagaatcatttattcatttatttagatagggtcttgctctgttgcccaggctgaagtgcagtggtgcagtcttggctcactgcaacccccacctcccaggcttgaatgatcctcctgcttcagcctcccaagtagctgggactacaggtgtgtgccaccaggcctggctagttttatttatttgtttatttttgtagagttggggtctcactatattgcccaggctggtctcaaacgcctgggctcaagcaatgcacccaccttggcctcccaaagtgctgggatctcaggcctgaaccaccgtgcctggcctggtaattactttatttttttattttttatttttatttttttcttttattattatgctttaagttttagggtacatgtgcacattgtgcatgttagttacatatgtatacatgttccatgctggtgtgctgtacccactaacttcattatttaacattaggtgtattttccaatgctatccttatccctctctcctcaccccacaacagatctccagagtgggaatgtccttatatctgattccatgttgaacttattttttcaatttccacctaacatttaatatattctgttgtttgtaatatattcatctgaaattcttacctgataatattattacccaattatatcatttttttatatgacgatccatgattcttttatctattatgaatttatttttat

SEQ ID NO: 664 - DNA, 371 bp, Homo sapiens
  misc_feature (1)...(371): n = A,T,C or G
gatctgcatggtttcataagggacttttccctcttttgttcggcacttctccttgctgccgccatgtgaagaaggtacgtgtctgcttccccttccattatagaaggtnagtttcctgaggcctccccagccctgctgaactgtgagtcaattaaacctctttccttcataaagtacccagtctcgggtacgtcttcattagcagcgtgagaatggactaacacaattatgtgcattgtgttttttgttattgttgaagtttgttctgtatgagcaaaagctgatgtaaggaggctgagtagacaaggagatgaagaacactggattttgtcgctgttgtatatttgttcgtgggttattggttacattag

SEQ ID NO: 665 - DNA, 702 bp, Homo sapiens
cgcggaagtcttcgtttacatctcagcaatggaaatatttagctttttttttttttttttttttttttttttagctagccaagagggcctgtacagtgagcaatcttttggggtcttatcttctcagcactgaagaatttctatgtggacactaaagtaatattaaaaccactcactctcactggtaatttacaaaatacagttttaataaacagcaatatcgacaacaacaatagcagtgatgaaacctctgaggcaagagagaatgttaattttagcaaagagtgtcttgtcaactggacaagccttaccagttcctagcctctagtttgtatacatttatgcaatcattttgaatatctactccctgcatgctggtaaaaaaaataagtgtcaggacattacatgtgaagggataattcaacatttaagtttttaagagtatgtttttttcagatcttgttccccaaagttaaacattgtggtagattgagactttcattattaaatattcttacagaaaacaggaaatcataaggtcttatttataatcattaagagaaacctgaaggccaattactcattgagtgtcaggcaactcaattacattattgtataggactttggtatgataaaagaatcctcagaactttattaaaaaattgtgagaaggagtttacacaggtcaacctataaaactac

SEQ ID NO: 666 - DNA, 703 bp, Homo sapiens
attcctccttatccttatctaccacccttcattattttcttaggtgaaggcaaagacgagaacaacaatgagtgttcccttgcctaatgggagcatgataatctgtaaaaaatactcagatttcatgacatggattcccctaaaattcagatcctacaaagaattatttctgtaatgaattattgcaggtaaaataattagatcagtggccatagtagtgctcatttaatgtcatctattactatttgctatcattactatatatttttgctattattactgacattattattctttagaggatgatatgctttgggtgtgttcccaccaaaatttcgtcttgacttgtaacccccacaattcccacatgtcctggaaggaacccggtgggaggtgattgacttatgggggcgggtctttcctgcactgttctcctgatagtgaatgagtctcacaaaatctgatggtttttaaaaatgggagtttccttgcacaagctctctctcttttttgcttgctgccatccacgtaagatgtgacttgatcctccttgccttccaccatgattgtgaggcttccccagtcacgtggaactgtaagtccaattaaacctttttcttttgtagttgcctagtctcaggtatatctttatcagcagcatgaaaatggacgaatacaggggacaatactttacaactgttta

SEQ ID NO: 667 - DNA, 560 bp, Homo sapiens
  misc_feature (1)...(560): n = A,T,C or G
cgcggaattcctgcttaatttatataggcagaaaacatccaggtcaaatggacaaaagactaatttgaatgataaaaacagagaaccatggcccctcaattaatgtccagattggagccagaaccagaaccccttgaataaaggggaggccaggtccctttgatcaagaaccccactatactactgacaatttatgctgttattctttctcccattcttccccgaggaggcttctgacctgttaccagggcaactgtgcattgatgaaagggaaatgattagacgtttcagggactattagacactggctctaagctgacgttgattccaggagacccaaaatgtcactgtggtcctccagttaaagtagggacttatggaggtagtaattgatagagttttagctcangccctacttacacaactccagggggttcccagactcatcctgtggttatttcttcagtgccagaatacataattggcatagacatacatagcagctggcagaacccccacattggcttcctgactggcaaggtgagggatattatgggaag

SEQ ID NO: 668 - DNA, 871 bp, Homo sapiens
  misc_feature (1)...(871): n = A,T,C or G
attctaccgactaaggttttaaagcaattcatctggcatgtggagtacaatctctttagttatctttagtgaatatcctgcataatattcacaaagattgtaagtaaatagtaaaatgtatcaatgttaagacttcaacaatttaagaaatgttcccaaatgcagctggttttcttacaaactgggaggtatagttgagtgtatgaattggaaaatgaggactaaaactctctttaaggataataccaaaggtaattttcctaatccatactttttaaaatattgcattggctttggtcttcttgttgaacggttaataatttgaccgataaatctataaattcttgttaagagcttactataatcttagctacataaaggtgatacaaaaggaagggaactatatagtgcatgaaatttgacctaagagttatgaagagtttgagaaaacaagagaaaatatgaaagattatcatagaacagaaggtaattgcatggtattaattttaaatgctgccactattcacaggctaaggaagaacaaagaangtttttgttgtaaagtcangtttcaagaagtgatttggctaagatctggacctaaaagctgggtaatatcacttacagaaaatatcattactgaaaataccgaaacagtcactacccacaatttaaaagaaaaaaacctaaagttatctttgtcccataataatcaaacagttgtcatttaactcctttcaaggtaacaagggatttcatagaatattatacttcaatagcactttattaaaatttcattttgcagaaaatctaattatctcaattcttttttttttttttttttttttgagagggattttctttttttacc

SEQ ID NO: 669 - DNA, 571 bp, Homo sapiens
cgcggaattctcttgaaggctaattaatataaaatacacttcatgaatgatcctagaaacccacatcagcacaaaggccagccagcacaaagctgaatagaaagcctcttagatgctggggttggtccgggacgtgttgtaccttactcatccatcatgtgtctgtgtcgcatgcgtccctttagttgagctttccctattctacaactagaagcagagatgtgggcatttcattgaccctcctactcaaaagagggacacagcaagagaaccaaaatagaaggtgggatgatggaatacaaaatttgaagaatcccagaggagtcatcaacccacttcttatatttaacaaaaaaatttcctaggaaccaagcaactcccttaagatgactattagtagggctgggcgcgttagcttatgcctgtaatcccagcactttgggaggctgaggcgggcagatcatgaggtcaagagatcaagaccatcctggccaacatggtgaaaccccgtctctactaaaaatacaaaaattagctgggaatggtggcatgtacctgtagtcccagctac

SEQ ID NO: 670 - DNA, 764 bp, Homo sapiens
aaaactataatacagtgcgtatcaagggaacatatctcaaaatattaatagctattcatgacaaacccagagcttacatcatactgaatgggggaaaactggaagctttccctttgaaaaccagcacaagacaaggatgccctcttcaccattcctattcaacataatattggaagttctagccagggtaatcaggcacgataaagaaataaagggtattcaaataggaaaagaggaagtcaacttgtctctgttcgtagataacatgattgtatatttagaaaaccccaccatttcatccctaaatctccttaagctgataagtaacttcagcgaaatctcgggatacaaaatcaatgtgcaaaaatcacaagcattcctatacaccaataatcgacagccaaatcatgagtgaactcccattcacaattgctactaagggaataaaatatctagtaacacaacttacaagggatgtgaaggacctcttcaaggagaagtacaaaccactgctcaaggtaataagagaggacacaaataaatggaaaaacattccatgctcatggataggaagaatcaatatcatgaaaatggccatactgcccaaagtaatttatagattcaatgctatccctatcaagctaccactgactttcttcacagaattggaaaaaactactttaaacttcatatggaaaccaaaaaagagcccacatagccaagacaatcctaaacaaaaagaacaaactgggggcatcacgcta

SEQ ID NO: 671 - DNA, 662 bp, Homo sapiens
cgcggagttctttgaatttcaaatgaagtataatgtgatttcttaaaaattacttctcatctagctagggtagaaactaacgtttggtgtgttcttgtatgtatcagggactttatataataatagccaatatttattgagaagtacgtaagtgactcagattatctttacatagattgcttaatccgttaacatgattttttttcccaattctgtttataaaggttgttttatctaatcatctctaaaatgccttgagatggatatcatgcccgtcctcattttctagatggagaaacctagtcccaaagagattgataagttagacaaattcacatagttaataaagtatggagctaggatttaattttaggcagagaaagagatttcccatgaaacaaaatttaaaattcaggaacaattacttctaccacctccttccaagaacttatgcttaaatcacatttgtaactttgaactgtttatctcaagaatgaccctaaaaagtttgctaagcttctgccgggcgcaatggctcacacctgtaatcccagcactttgggaggccgaggtgggtggatcacttgacttgaggtcaggagtttgagaccagcctggccaacatagtgaaaacccgtctctactaaaaatgcaaaaattcg

SEQ ID NO: 672 - DNA, 756 bp, Homo sapiens
cctctgcagaactaaaaggttcaggagatgaatttattcacagaaattcttctcaaacccaaacctctaaggagcaattaattatcttttgtatgaaaactgcaaatgaacatatcaacataacattttcaccagagctgtttaaactatgtagaatccaagggtaaaaggtcatttgttacaaaaacaaaaaacaaaaaagtaccacatttcatcaaatcgaatacaacacagactgacagaaaaatcacaatttcaaagatttcaaaatgtgaatctgttctctctctctgtctctatctatctttttctctctttctgtctcctatgacctatgggacttttctttcagtatctttgcagcagcacaaggccaaataataccttatggaagataatgtaacacttttattagtaagcggattgtcttttaatttggggtcattttgtgtctaacaacaagaaaacagtagagaaggacactcctttatggcttccttcagattttgtgtgtgtgtgctttactggttgacattgtgaactctacttacattgagagactctaacatggaattatggtgaatcaccatgaacctgctatttaatgtgttgtataaaggctgttaatgacagcactgtcctctcctatgctctactgtagtgtgctaggtataaaggctagtagaaaaaattactttaaagccaaaacaaacaaacaaaaaaaccccaaacaaaccaaaaaatccatcttcaacc

SEQ ID NO: 673 - DNA, 662 bp, Homo sapiens
tcgataataccactcactatacggagaggatccgcgcaattcaccagtgaaagcatcaggttttgggcttttatttgaaggaagacaatttgtttactgatttctctggttattcaatataggtctgtttagatagtcatttcttcatgatccagtctgggaaggttttatgtttctaaaaatttattcatttttttaggttattcactttgttgacatataacttttcttttctttttttttgagatgaagtctcactctgtcacctaggctggagtgctgtggcgcaatcgcagctcactgtaacctctgcctcctgcgttcaagtgattctcctgcctcagcctcccaagcagctgggactacaggtacaggccaccacatccagctaatttttgtatttttagtagagacaggtttcaccatattggccaggctggtctcaaactcctgacctcatgatctgccttacttggcctcccaaagtgctgggattacaggtgtgagccactgtcccccgccaacatttaattattcattatactggcatgatcctttgtatttttgtaataacaggtataatatcttctctttcaatactgattttatttacttatttactccttcttcattagtctaagttttgtccatttttttatctt

SEQ ID NO: 674 - DNA, 716 bp, Homo sapiens
ctaagccaacttagcaggattcttgctgcaacagaactgggtggacataagacaggagtggaaccaaggtccaggcatactcgagaggagagctcatagaaccctgactaaagtttggtcaaggagagagtctttttaaatgtacttgacggagagcccttttggtgggcctttgctttggattagttgccacagaatacattttggaagacaatgccctagtacatttatcagacaaccagacacaccttagacattggtctgcattgattctacttgccagcctcagaataggtgatcccaatttagagacacaaagttatcctcgtgtcagactattaagattacataggtagggaaaataaacaatagatttagcttgccttttgttcatctgagattccttctagaagaatctttatttttcacttattcactgaataactctgggtaagccacttaacctctgggtcttcagttcctcattggtgtaataaaaaggtttaactgaatgatctctgatgccctttccatcataaaataatacctattacgttttctgtgcttctgtatatccaattaatgttttacaaagagcagattaaaatgatcagttttcagtgccatgggctggggagaggaacaaaatattttatacaggaaaggaaagcaagtgtaaattttgatcttttgctacaaaaaatgtattcattctt

SEQ ID NO: 675 - DNA, 722 bp, Homo sapiens
cgcggaattctttgaaataactgttagttggactggtttaatatttggattcaccaaccacatgcagttacacattggtgcaacctttacagcaaacagtactccctgcaatgaactatttaattcacatactatccccagacagcaggtgccattgaaaaatgactcaaattctcaaagaaaatgggtcattacacattacatacatatatcaaaatatcgcatgtaccctcaaactatgtacaactgttatatattgataaaaaataaaacaacaacaaaaaaccttagcagaggggatggttccaagatggctgaatagaaacagctccattctacggctcccagcgtgagcgacacagaagacgggtgatttctgcatttccagctgaggtactgggttcatctcactggagctcattggacagtgggggcaggaaagtgggtgcagcccaccgagtgtcagccgaagctgggcgaggcaggaagcgcaaggggtcagggaattccctttcctagaaaaggcaaggggtgacagatggcacctggaaaatcgggtcactcccaccctaatactgcgcttttccaacagtcttagcaaacggcacaccaggagattatatcccacggatggcttggagggtcccaagcccacggagcctcgctcattgctagcacagcagtctgagattgaactgcaaggcggcaacaaggctggggga

SEQ ID NO: 676 - DNA, 803 bp, Homo sapiens
cccgcatacccctcttggaggcctactagtgacaaactccgtccgtctttgtttatcaaaaacaatttaatttctccttttttttagaaggacagttttgcagatacagaattcttgattttttttcttccagcactttaaatatgtcatcccactctcttttggcctccacaattctaataagaaatcagctttttccctgtcttttgcattttatattgatatatcatagttgcatgtattttgtgggtacatgtgatattttgatacatgtatacaatgtgtaataataaaatcagagtaaataggatacccatcacctcaaacatttatcttttccttctgttgggaatattacacttcttcttatccagctattctgaaatatatgacaaattattgttaaatgtaatttccctgctgtactattgaatactagaactcatcccttctatctaattgtatttatgtaccactaaacaacttatcctttgcatatgaaaagttgcttcttgtgctactttcaagattctcacgttgtgtttcaagagttttatgacagtgtgtcttggtgtaaatatattcttataaaattttttcttttaatttttgctaatacatactacgtgtatatattggggtacataagatattttggtacagcaatgcaatgcataataatcacataatggaaaatggggtattcatcacctcaaacattaaccctttgggttacaaacaattcaattatatactaatttagtaatttttcaaagtacacttaaattattaattgactttaa

SEQ ID NO: 677 - DNA, 724 bp, Homo sapiens
gggagaggatccgcccaattctttatatattctagatagtagtcctttgtcagatacatggtttgcaaatattttctcccagtcagtagctggtcgttttactctctttcacagaacaaaaagttcaagtttatcaatttttacttttatggatcatgcttttggtatgaagtctagtaacgacttctttcctaaccctaaatccctaagattttctcgtatgtttattttcaaaaagttttgtagtcttatattttacattcaagtttgtgatccattttaagttaatttttactgtatacaaggtatgagacttaggtcaagtctctttctttctttctttctttctttttttcttgttttttgtgcctatgcctgtcccttgttccagcaccatttgttgccaagaccatctttcctctgtcaagttgctttttcacctctgtcaaaaatcagttccgggttctctattctgttccttcaatctatatttctattccttcaccagtactgcagtcttcattactgtagtcatatggtaaaccttaaaattggctagattgattcttctcactttatccttctttttcaaaattattttaactattctaattcttctacctctccatataaatattacaataactttgtccatatctattaaaaatcttgctgaattttgacaggaattgtctgtcaatttatacatcaatttggggagtat

SEQ ID NO: 678 - DNA, 658 bp, Homo sapiens
  misc_feature (1)...(658): n = A,T,C or G
gctggaacagcggctcatgacctatcaccgcaggactttgggaggctgaggtgggtggatcacttgatttttggggttcaagaccagactgaccaacatggcaaaaagccatctctaccaaaaatataaaaattagccaggtatggtggtgcatgcctataattccagctacttgggaggctaaggcaggagaatcgcttgaacccgggagacacaggctggagtgagctgacatcgtgccactgcactccagcctgggagacagagcgaggccttgtctcaaaaaaaaaaaaaaaaaaaaaagtagaattcagtccaaatgcatgcctgcctctaggcacagtgtgctgtaacataccaatccaagtgaaatggttaaaagtggcacatcaggaaatcaaaaaaattcccctgaccacaacatattcagtatgatttaatctctcattctggatcttttagcatagaagaattatcatactgcaagtaatgacactgtatctgtggcaggcagaattctaaagtggtcctcagattcccacctcctggggtgtactcctgtgtcatccctttcccttgggtgtaggtggaacctgtgactccgacgggatgtcactcctgtgattaggttataatatggggtaaagtgaggggatcn

SEQ ID NO: 679 - DNA, 592 bp, Homo sapiens
cgataataccactcactatacggagaggatccgcgcaattcatggaaatctcccactttttacctattggggattaattccatattttaagtctgggccggcagtgccacgtggtactccaggtgtgtcctctgacaggtgctagaggacaccccaaggtcagcaggggcttctgctgggtctctgagccattattctctcgcctgcctcacgtgaacacaggtttcctgggtggagtttagttgagagatcgcagtcattcgcaggaggaaacctgctgctccctcaggggcgcagtgagtttcaggcattaggacggagccaacacccacacttcctaaagccctgaacataaatttctctcgactcccttttattgggaattagcaaatcaaacgctgtatttttcagtgtctcaaatctcccttccttccagctgagcccaaggagagtgaagggcagagggtggcacaaggtagagatttgagaagtttaattaaagcctcaggttcaagcgtggggtgatcctgatccatcaccaaattgtggctgctcccacttcatgaagagacagcccagccctgaggatcag

SEQ ID NO: 680 - DNA, 954 bp, Homo sapiens
cgtgcccagcaccccatatccgccaccccatcctgctgctcttctctttctctctcatgaccttctgcccctctgggctcctcactgaggaccaccaggactgtaaccgacaccgatgctagctgggatgtccgggcgtccctcccacaaggtctgtgcctggagagggatgggcactggtgtaaggcccactatggggggagaccaagggcgggcagctcacccaggtgctgaggaatccaggcagagcacagtgtcctttgctgcagggtctgagggctctctgcccatagagctgctgcgtctacgcactgttacatctccggaagatgtgccttgttatgctctcagtacttataaaaaaggaattctctgtccacaatttattcctgtgctttaaaagtttgaattccagtggaaaagcagcaagaagacatgagcctcaaggatggttctggagatgggtctgatgattgtgcttggtccaccaaagcttcccacgagaacagcatgtttgttcttgctgacacccccagcccccaagctcagttcctctcttgggaggctgaggggtcacagggtcctgaagtgtccccgggctcacacccaaatggaagacctgttttcctcaagaagtaatcctcgccaagcatgtcaggtgtaggataccatatgtcagaagtcacaacaggaggccgggcacgggggctcacgcctgtaatcccaacaacttttggaggttgagggtggatggatcatcttgaggtcacgagtttaaaaaccgccttgtgaacatgatgaaaaccttgttttttactaaatatacaaaaatttgcccggcgcaagtgcacatgccttgtaattccatcttcctatgaagctttaggacgataatctctttaacccttgaggttggagttctcgttatgacaatatcttcatatttactctcaa

SEQ ID NO: 681 - DNA, 611 bp, Homo sapiens
cgccgaattccatgactcttgaaacattctgccaaattctttaccaaaagaatttggtaaagagttatcgggtcagttttcactgctggtgataacttattaatattctcagtgagaacttattgatactctcatttctcaaaacttttacaggaaaggtgagcagtgttctcatcaccagcttagtatgtgtgaaatttatcatttgtattttcttgattactactgagtttgaacagtgtttcatatgtctttacattttcttaggaaggtggctacaattctgaatatataggggagatgtttcatttgtttacagtatcactcattgccctgcaaccatccccattgcgctctcctgtggtgatggtgggaccaggtcccaccggagccgcacacatggtgacaggagccagcagctgtggccgtcctgggtgcttggagaaatgcctcagccggtgccacccatccagggtggtgcagggccctccctctcccacaagccactggacgcccagccttggccaggcctctccctttagcctccggggatgaggggacgagtcacgttggtggagctgcaatcattaggcagaagggccactttggaa

SEQ ID NO: 682 - DNA, 760 bp, Homo sapiens
  misc_feature (1)...(760): n = A,T,C or G
accactcactatagcgagaggatccgcgcaattcatgtgtcctgctaaatcctggggactctattgccacagcacaaaaaggaggaaagcacattggggggctgtagtaactgccccaaggttgtgcccaggaggagtctcaaagacttgagggcccttcccatttataaacgtaagtaattagagatgaacaaggcagaactcaagagagaaatctcagctgggtcgggtgatcacccacaaggatagggaaagaaaaagaggagatatcaagcaagctagaattttaagttcatgaggcttgttttcctagaagtaattagataatacaaatttaaaacttaaaaagaaaaagacaacagccagctccacgtgggaaggatgtggaaactgcttcttaaaacatttatgctacctcagccagaagagcccgccgtgaatgcctaatgatatttttaagttgcttttgtgctattggactctctttagcagttatcgctcttgttatttgtcatgacgacaagtcatttaatgcatttcataagatccatgtgtcaactgtcttccctttgcaatgtgaattcaaacacagcaatctcgctaacagctatttccttccctggtctccagtaccacccaggaagcttgccttggggcangcagggtgccctgtccctcttgccgtggagctccaggcagcaggcatgggcagtaccgctgctccatgtgcacacaaagcccagactccacacaagaaaac

SEQ ID NO: 683 - DNA, 491 bp, Homo sapiens
  misc_feature (1)...(491): n = A,T,C or G
atttgatcttccgtcctggagggatttccagctgtcattcccggaagaagtgggtggtgggttttacctgcgtgactccagaggtcgtgttaaatcatcccaggcactgcacctgtctcctggatctgatttgcttctcatttgtctgtgccctgcctctggctactggggactgtagacagtgagaggcgtagggaagctcaggctgagaatggagccatttcccagcatcaccctcactctcaggaaagggtgtggagctctagagaatggtggtgggggtgccatctgacagaaagctgtccttgctctggtgagacatctctgacctttgggaaccagccctcctcaactatcatcctacctggggcacatagcccaggccaggcccatacatcacacacatgcgaccacagtacctggcacctggctcaggggtgagcacagggtgtgtgtgtgtgtgtgtgtttnntgggcgccccgggcgcgct

SEQ ID NO: 684 - DNA, 662 bp, Homo sapiens
gataataccactgactatcgggagagaatccccccaattcatgccatgtcttgttgtgattaactttgcacaaatctattgatctgaaccgtcagtgagtggacaactgctgcatgacagtcactcatgtccgtttccctccttcaaccacaacatcccatttcctgctgggaagagacctcgcagacactgttcaatccaggtgaaaatgcccctcttaacccaagcagcccccctcactcgggtcctaagtgagacccgcgtgggcagagtgagtcagtggggcccatgcactccagggagaccccgaacaggctccgtgagccgctcctgcttgtggaccccgagctgtcctttcccagccaggtgttccatcctccccttcggtttccattgcttgtcaccccaaaagtcctgactgctttggtcagccaccccaagagcacctggatactggggtcatgttagcgctgcgccagtgagccatggggcctggatggggaatctggctgcctgaggcttgagcagagcccctggacgggataaactcgctcatccaagaaccattcactgagcacccatgctgtgccaagcaagcacctgttaaacgtgcacgtgataatcagagaaaaagctcattgttaatagtgaactggtgagcg

SEQ ID NO: 685 - DNA, 502 bp, Homo sapiens
  misc_feature (1)...(502): n = A,T,C or G
acccatgttgtgagagggactacatggacggaattgaatcatgggggccagtctttcctgtgctattctcatgatagtgaataagtctagtgagatctgatgggtttagcaggggtttctgcttttgtttcttcctgattctctcttgccgccactgtggaagaagtggctttcgccctccgccatgattgtgagacctccccagtcatgtggactgaaagtcaaattaaacctccttttcttcccagcctcaggtatgactttattagcagtatgaaaacagactaatacaccaggccattctgcacttttgaggggtgacagcatgctggcagtcctcacagcccttgctcgctctccacgcctcctctgcctgggctcccactttggcagcacttgaggagtccttcagcccaccgctgcactgtgggagcccctctctgggctggccaaggccggagcccactccctcagcttgcanggaggtgtggggggagaggcc

SEQ ID NO: 686 - DNA, 625 bp, Homo sapiens
cgccggattccatggtgaggatttcccccgtgggtgcactcactggagtacacaagacacaggacacagattgggtgaaagcgagatcgttcacaaagacagacccacagctcacatttcccacagcaggggaggggcacacacagagggggtgatttacaggtaaactacttaaagtcattcggtcactaaatacctaccgagtgcctgtaacacaccaaacactactgtaagcattgataacagaaggatctctactgtaagtgaaaaaagttgtcagaaaaatatgtagggtatgatcccctatgaggttttacacctccacatacatgaatcgaattgagtttttcccctcaaggattcacttggcctcccaaagtgttcggaaacaaacggggtagatgcacacgaccgagcaccattcaactgtaaaaaggaagggggtccaatgcggctgctgcatggctggacccagaggataccacgctaggtgaagtcagccaggcacagaagcacagacactgcagaatcccacacacatgcggtacccaggagtcccgttcacagaggctgcaagcaggtgggtgccatggctgggggaggggagggcagatagttacttttt

SEQ ID NO: 687 - DNA, 712 bp, Homo sapiens
  misc_feature (1)...(712): n = A,T,C or G
ccactcactatagcgagaggatccgcccagtcagggctctgtgtccgttctcactcaatcagcaagaaacaccctgagttctaatgaacagagctcagatcagacgggacactgtagagaaaaatccaagaaataaaccccatctgcggccatgtcgcacgcctcacggttgcctctgaaatggaatttgtgctctgttgtctcaaaaagcaaagactagaatcaggaatggggcagtcgcggcagaccctgagagaccaggcggctgatgggggcatcctggtggggcagccctgagccgcccacagcaggggaggccccccggggaggcagctggtcaccaccctggtgtctgtggtcacgacggtctcagacgtggggcccccgggggaactctggggctcggtaggtagcagagttaagcacgtcatggtggcctgagccggagtgctatgtgaaggctccatgtccacgctaggctgaggccgcctgtcaggctatgtgtgtgggtggggacgctctgcgaccctgtctgcagctgggatctggagtctccaatggacagttgcatagatgcctggcgtgccttgtggaatcgcagtgccaaatgcaccttctcactgcatcangctcccagaataaagggctcccactgcccagtctcgggggtagccactgaaagggtgtcttgaagacgtgggactacagacac

SEQ ID NO: 688 - DNA, 831 bp, Homo sapiens
  misc_feature (1)...(831): n = A,T,C or G
tttacaaatcaacagcactgttatacaccaacaatgaccaagctgagaatcaaatcaagaactctatctctaggacaacttctgcgaaaaaatagtaaaatatctaggaatatacttaacaaaagagatgaaatatctccacaaggagaactacaaaacactgctgaaagaaatcaaagatgacacaaacaatggaaatatatcccatggttatggattggaagaatccataccatgaaaataaccatactgcccaaagcaatctgctgattcaaattcctattaaaatgtcaacattattttttcattgaaatagaaaaaaaattctaaaattcatatagaaccaaaaaatagcctgaatagccaaagaaatcctaagaaaacaaaaaaatctggaggcattacattacctgacttcaaattatacaaggaaggctacagtaagcacaacagcatgatgctggtataaaagtagatatatacaccgatggaaaagaataaaatcccagaaataaagccaaatacttacaaccaacttatccttaacaaagcatacaaaaacataaattgagaaaagaatacctgattcaataaatggggctgggaagactgaaaagccatatgtagcagaataaaactggatccgtatctctcaccatacacaaaaaccaacttgagattgattaaagtcttaaatctaatatcccaaattataaaaaaatctagaggaaaaactcttctggacatttgcttangcaaagaatattataagtaatatttcaaaagcaaatgtaataacaaaaaaagggacctaattaaactaaaaagttt

SEQ ID NO: 689 - DNA, 790 bp, Homo sapiens
  misc_feature (1)...(790): n = A,T,C or G
gataataccactcactatcnggagaggaatccccccaattctaggtccttagcagttatataaattggaaatattttctcttgttctatatgttgtcttttcattgtgcttgacagtgttctttgatacacaaaagtttaattttgctaaagtcaactttatctatttttttcttttgttgcttatgctattggtgtcaaagctaaaagtccattgccaaatccaaagtcatgaatacttacacctttcttctaagagttttatactttagttcttacatttaggtctttgatccactttgtgttaatttttgtatatggagtgggataggtctaatctcattctttgcatgtgaatatcctgttttcccagcaacatttgttgaagagattattctcaccctgttgaatcctctttgcacccttgtcagacatttgactgtggatgcacaggactatttctggactctctattccattggtctatctgtctatccttatgccagaaccacactgttttgatgactgcagcactgtaatatgttttgaaatgaaaaaaaaagtgagtcctccaacctggttagttttaagattattttagcttcttgccataacttgcaattcacatgaattctaatatctgatttgccatttctgcaaaaaaaaaaaaaaaaaaggaaaaaggataaaaaaagaaaaaattcacttgagattgtgaatcaaaaatacttctgaatctgtagatccctttgggaaagttttgaagtctaaacaattttaaattttccaag

SEQ ID NO: 690 - DNA, 581 bp, Homo sapiens
  misc_feature (1)...(581): n = A,T,C or G
aacccctgaacaaaatgtacgttcacacacagttgccggaagattgtttggagactggagaacgctctcacagctcctggttggacaccgagtgctcatgcacgtcatggggccccacggggttcttcccatgggagccctgcacacctgtgctgacagcagcaaccatggagctgtatctggcccgggaacggccacgtggtgtgagctcctattggtgtaaatggggacacaggcaggtgccccgtccacctatcctgtccctgctcagtgtcaccctccttgctgagtggggtcccattggcgagttttcagatgaatcaaggatgctccaggtagagcccctgttactccaggcagagcccttgtctgcggggagctgcccctcctcgggtgcctggagagggcacatatgttgggggtggtcagtgtggctcaagtctncacactacctgccttctgcttcccttctgctgaggccgggtggactccatggaggggagccagtgttcttgggttcacggacacagaacaagatttggggacagaaaaatcaaattcctgcacagacccctctgttc

SEQ ID NO: 691 - DNA, 666 bp, Homo sapiens
cgccgaattcatgcacacctgcaggggcaaccttggtagccaccccctgccatggagcgtggacgaagcccaggtgggtacaaatctttactttcctgcatgtggaggatgcaggtaatgcagctgcctctgaaaaccccaggatctacacactcccctagggacaaagattccatctgctgcagacccctggcagctttagatcattgggggtagggagatgagagtctagtgttacaggaaatttcattctttcaaatccagagtgtccaagaaagttttatgtaatgaaaagaaaaaagtcaggtctgtttcaacagacaaaccagatttatccaaaaaggaaaaggtaaagttcacatgtcgtagtctaggtaccttctcacagggacatgagataatgtggccatgaaaagacttaggtcagttaaacctgagctcatgtctttactctgaaaccttgttgctgtgtgaccttgattgagttgcttaccctctctgtgcctttcttgtctgtaaaagggtgaaatggcaagccttatgatatggtttggctctgtgtcccccctacccaaatctcatctcaaattgtaatcctcatgtgtcaaggaagggacctgtaatccccatttgatgagggaggatggtgattggatcattcgggac

SEQ ID NO: 692 - DNA, 699 bp, Homo sapiens
ctatacggagaggatccgcgcaattcaaacacagcaatctcgctaacagctatttccttccctggtctccagtaccacccaggaagcttgccttggggcaagcagggtgccctgtccctctgcccgtggagctccaggcagcaggcatgggcagtaccgctgctccatgtgcacacaaggcccagactccacacaggaaaactgccatctgaaaggagaattggaacgcacagcccatctgactcttgtcttactgagacgttaaacaggaacactccccatatctgtatgcacagaagacaataccgccagctgtgtgaggaccaatctttctctctcttttggtgcacaattttcctgcacaataaccactgacttgtctttcatttctgaagacaattgtccacccgagtgtcagatgaagggtgaatgatttccgagatacagcgcgggagcacgaccatgtttccagtgctgaggctttctctgcagctctctgaacctgtgttggtgcgtctgcaggcagacgccccaatctgtgctcgggaggcagcccttgaaagggagccaggatgcccatacacacacaggcacctgtgcccaaataccggcgatgatccagaaattaagcgccccagtctgtctttaattgcacgttttaacagcgccgaccacctaatacattactctctgatgtga

SEQ ID NO: 693 - DNA, 736 bp, Homo sapiens
  misc_feature (1)...(736): n = A,T,C or G
ttggtaataaagtggtctacatgccaactgttgaggccttgatgatggattaaacaggctatttttaatcatcctgaaaacaatgttggcaggcatgtaaaataattccataatcttccagctcagccgagccaccagcaggatgcaactgaggaagtgaacccaggcaacgccacagcagaagagccacccagctgggccctgcccaagatcctgaccacagaattgtgagaaatgatggattactgattttgtttgaagtgacagcattttttgggtggtttgttaagcggtgagacgtgagtcaggacaggtggtacagattgggcatggttgggactttatttagccaatagaagttgttcggtatggctgttcacctgtctaggacccatgccacaccgccctggacatgtttaccttcatcttatgtttatgtttganngntgtatttgaccccttttattaattatggtgctttaatgcctttcagtattgttacgaaataattttctttcagtttttattattttctattgacacgttttttctcatacttaatttatttattttatacgttgctattttcaatttcattcctataattgctttttgttccctatgagttacctctatacctgtttgtcattaattgtattctcttcgtatcctaaaatatgattggctccgtcttgggtattctttttttttgccatttttttatttattcctcctc

SEQ ID NO: 694 - DNA, 122302 bp, Homo sapiens
gatcacgaggtcaagagatagagaccatcctggctaacacggtgaaaccccgtctctactaaaaaaaaaatacaaaaaattagccgggtgtggtggcgggcgcctgtagtccggaggctgaggcaggagaatcgcgtgaacccgggaggcggagcttgtagtgggccgagatctctccactacactccagcctgggcgacagagcgagactccgtctcaaaaataaataaataaataaataaatacaataataataataataaaagtggcggggtgcagtggctcactcctgtaatcctagcattttaggagactgaggcaggtgggtcacctgaggtcacgagttcaaaaccagcctggccaacatgacgaaaccccatctctactaaaaatacaaaaattagccgggcgcagtggcgagcgcctgtaatcctagctactccggaggccgaggcagcagaatcacttcagccgggaaggcagaggcttcagtgagtgaagatcgcgccactgcactccagcctgggcaacagagctagactctctcaaaaaaaaaaaaaaaaaattaaagttagttttacttacaagtcttactgaggattacagaccgagggctatagtgtgggagcagttccatcagactggtccaacacagaatttcagccactcatatacaagtggtgagtgtacggcgcctgcaaaatcacattaaacttgcttcaaagttacattaaagcacaatcatatcaaagtttgggtgcaagagtatatctggttatggattacagaggtatcatcactaaccccatcagacattatcttgtgcaggaaaaggcaatgaccagagtcatttatcttttaatgaatatagtgacttggaagagacatggagggctgtgtgctctattctgttttgtcttcaaagcatctttctggagagctgtatgttgtcacagagtcaggggcttcatgaaacgatgctgccaagtcgaaataagcaggcccggcatggtggctcacacctgtaatcccagcactttgggaggccaaagcaagagctttccttgagttcaggagtttgagaccagcctgagcaacatagtgagaccgtgtctcgacaaaaataaaaaataacaaaatttagctgggcgtggtggtggatgcctgtgatctcagctactcgagaggatgaggttggaggatcccttgggcctgggaagtagaaactgcagtgagctgtgatgtcacaactgcactccagcctgggtgacagaacgagaccctgtctcaaaaaaaagaaaaaaaaaaagcagaaatgggcaaactactaaatggtcattttgccaatattacctccaaagatacaatgatagaaccaaaaacctaaaaactctttctcaagcttccacattacttctctgcacttcagttcatctttatttattattattattttttgaagagatgggatctcactttgtcacccaggctgaagtgcagtcgcacaattatggctcactgcagcctcgatctcctgggctcaaagtgatcctcccacctgagcctcttgagtagctgggactacaggcacacaccaccacaccccgctaattttgtttattttttgtagtgagtgggtctcactatgttgcccaagctggtcttgaacttttgggctcaagtgatcctcctgccttggcctcccaaagtgttggtattacaggtgggaaccactgcactcagcccaattcatcttaaaatgggggaagggagtccttaggtggtcttcaaggtccctgctggccgcccacctttatgtccaaagacacttatacatttattgatttaggtgatgctgcagagcggcagttctggttgtctacacattaggaacaattaggaaatttgtagatcagaatccctgggagtgagacgcaggccttgtttgattaacttaataaaaaaaatatgataaataaaattggagaagccaagcaggttaagtacattagtccaggtataatatatttggcttcatattaactgtaaaaacatcacttttggctgggcacagtggcttacgcctgtaatcccagtactttgggaggctagggtgggcagatcacgaggtcaggagatcaagaccatcctggctaacatggtgaaaccttgtctctactaaaaataaaaaaattaaccgggcgtagtggcatgcgcccataatccctgctactcaggaggctgaggcaggagaattgcttgaacccgggaggcggaggttgcagtgagccgaaatggcaccattgcactccagcctgggcaacagagcgagactccgtctcaaaaacaaacaaacaaacaacaacaacaacaacaacaaactatcactttttcagatatgtataaacacatttcttcacaagttcaaggtattttaccaatagcaaataacttgatactgtcgttgtgaatgaaaaggatcacaaactctgatgtttagaatgagtcaaatctaggccgggaacagtggctcaggcctgtaatcccagcattttggggggccgaggttggcggatcacctgaggtcgggagttcgagaccagcctggccaacatggtgaaactctgtctctactaaaaatacaaaaactttaaaaaaaagtcaaatctagatccatgattaatgacgtgctcatttcacattgcatgtttgtatcaaaacatctcatgtgggtaaagcatagacaggcacagagaaaagaaaaaaagacaaaaaataagagaaaagatggccgggcgcagtggctcacgcctataatcccagcactttgggaggtcaaggcgtgcggatcacctgaggttaggagttcaagacgagcctggccaacatggcgaaacccccgtctctactaaaaatacaaaaataatcccagctactcgggaggctgaggcaggagaatcggttgaacccgggagagggaggttgcagtgagccgagatcgtgccactgcactccagactggagttttttcaaaaaaaaaaaacaacaactccgtcttaaaaaaaaaaaagaaaaaagaaaaaaaatcttatgtacactataaatatatacacctactaagtgcccacagaaattgaaaacaaagaaaaaaatccatgattaaaagcttttatattaacgggggaacctctgaccagaaagagccgacagggggcgttcctggatgatctggggctgtcaattgcgagacgcggaggattgtgggacttgtggtttttctcgcatcatttaagctttctggactacatgtcccaaaatgcaaatgcaatcagacggtcccactgtggggtgtgaagtgtccgtagagctgtgagaggtaagtgtgttctgtgtgtgctgcggatttctagaagttgtggatttcttgtgagggattctatttctcctctttgccctcggtgggacctggaagagagtagttgttccactgatgcacgttttcagcgggggtttcccctgaccctttggtctcgggaaaccggactgtgtgtttgttcagctgttcacgttttgctgtggaatgtcaaggagaaagcggggtcctgatctcagatctggaaagccaaacataaaataatgtttacatacggggtgcatgtcactagaggatttatgcattgcattgtgtcaaataatatgtcaaagttttttctttttctttttttttttttttttgatacggagtcttgcttcttcgcccaggctggagtgcaacggcgcgatctcggctcactgcaacctccgcctcccgggttcaagcaattctcctgcctcagcctccctagtagctgggattacgggcacgtgccacaatgcccggctaattttttttgtatttttagtagagtcggggtttcaccatgttggccaggcatgtctcgaactcctgatctcaagtgatctgcctgcgtcggcctcccaaagtgctgggatttcagacgtgagccaccgcacccggccctctattgttacagctagaaaagctgacgggcaggggtcttgtctctctgatgtgtccaagtagcagagcttgcagtggagggtaaactaaaataagggggaaatgaaaaaataaaaggaatgcgtgtgtgtgcttaattacatgaacaaaatcaaacaaaacctgactcattagggccagactcagaggctcacacctgtaattccagcacgttgggaggccgaggcgggcagatcactagagctcaggagttcgagactagcctggccaacatggtgaaaccctgcctctactaaaaatacaataattagccgggcatggtggccatgtagtcccagctattctggaggctgaggcaggagaatcacttgaacccgggaggcggcggttacagtgagccaagatcatgccactgtactctagcctgggcaacagagggagactctgtctcaaaaaacaaaacgaaaacaaacaaacaaaaaatgagaaaaaaaaaaaaccaccccagtttctcacatgaggcttctttttctctagaatgaagatgagctttgcgttgactttcaggtcagcaaaaggccgttggatcgcaaaccccagccagccgtgctcgaaagcctccattgggttatttgtgccagcaagtcctcctctggaccctgagaaggtcaaagagttacagcgcttcatcaccctttccaagagactccttgtgatgactggggcaggaatctccaccgaatcggggataccagactacaggtcagaaaaagtggggctttatgcccgcactgaccgcaggcccatccagcatggtgattttgtccggagtgccccaatccgccagcggtactgggcgagaaacttcgtaggctggcctcaattctcctcccaccagcctaaccctgcacactgggctttgagcacctgggagaaactcggaaagctgtactggttggtgacccaaaatgtggatgctttgcacaccaaggcggggagtcggcgcctgacagagctccacggatgcatggacaggtgcaggagctgtacacggtttgaacgcaaacccgtgtgttgttttgggagagtagggaccttggctgtcttgatcaccacagtcttagaccttgagaaaaggatttcagagcaagttgtttattttgcagttgattccagtaaattcattgacggagcaaggatgtaaaacaggaaagagaggaaagccaagaaagtgtgtgttaatgagtgggttactgccttgggcactggggttcagtcctgtgagggaccctccaactgtctaggacatgcctgaggattgtctcaatgaaacttgaggactggggccgggcgcagtggctcacgcctgtaatcccagcattttgggaggctgaggtgggcagatcacatgagctcaggagttcgagaccagcctggccaacatggtgaaaccccatttctactaaaaatacaaaaattagccagtcgtggtggcacatgcctgtaatcccagctgcttgggaggctgaggcaggaaaatctcttgggaggcagaggttgctgcagtgagccgagattgcaccactacactccagcctgggcaacagtgcaaaaaaaaagaaaaaaagaaaaaaaaaagttgaggatggtgcacagtggctcatacctgtaatcctagcactttggaaggctgaggcaggaagattgcttgaggctaacagttcaggaccaacctggcaaacacagtgagactctgtctctatataagtaaagtaaattttatatatatatatatatatatatatatatatattttttttttttttttttttttttaaagaaagttgaggccgggtgtggtggctcacgcctgtaatcccagcactttgggaggccaaggcaggcagattacctgaggtcaggagttcaagaccaatctggtcaacatggtgaaaccccgtctctactaaaaatacaaaaatctgttggaagtggtggcacgcacctgtaattccagctactcaggaggctgaggcaggagaatcgcttgaacctgggaggtagaggttgcagtgagctgagatcatgagctgagatcatgccaccacaccccagcctgggcaacagagcaaaactccgtctcaaaaagaaaaaaaaaaaagaaagttgagcaagctagggtgattttcttttattttcttttgtgtttgtgtgtgcacgtgtgtgtgtgtgtgtgtgtgtgtgtatgacaggctttcactctgtcacacagactgggatgtggtggtgtgattatagctcacttcagcctcaatctcttgggctcaagtgatcctttcaccccagcctcctaagtagctgggactacaggcaaacgccaccgtgcccagctaatttttaatttaatttttattttttgtagagacgaagtcttactatgttgcccaggctggtctcgaactcctgggctcatgtgatcctcctgccttggcatctcaaagtgctgggatgactagtgtgagccactgtgcttggccttgaagctagggtatttattcaccatctctcatccctcatgggtccaggatcactctaggggaattaattccctaacattttgactctgctcctcccaaggaggcttccgtgggcagagaacatctgaggcaagagagacacaggaaactgcttgtaagaaaattgtgtaggctgggcgcggcggctcacgcctgtaatcccaacactttgggaggctgaggcaggcggatcacgaggtcagttgatcgagaccatcctggctaacatggtgaaaccccgtctctactaaaaatacaaaaaattagctgggcgcggtggcggacgcctgtagtcccagctactcgggaggctgaggcaggagaatggcgtgaacctgggaggtggagcttgtggtgagccgagatcgcgccactgcactccagcctgggtgacagagcgagactccgtctcaaaaaaaaaaaaaaaagaaagaaagaaaattgtgtccaccagggtgctgtggttcatatctgtcatcccagcaactcaggaggctgaagcaggaggattacttgaggccaggagatcaagacctgcctgggtaacacagccagactccgtctctacaaaaaatttttttaagaaaggaaattggctgggcacggtggctcgcgcctgtaatcccagcactttgggaggctgagttgggcggatcacctgaggtcaggagttcgagaccagcctgaccaacatggagaaaccctgtctctactaaaaatacaaaattagctgggcgtggtggtgcatgcctgtaatcctagcgactcgggaggcttagacaggagaatagcttgaacccaagaggcggaggttgcggtgagccgagattgtgccattgtactccagcctgcagcctgggcaacaagaacaaaactccgtcaaaaaaaaaaacaaacaaaaaaacagagaaaggaaactgggacgggtgcggtggctcatgcttgtaatcccagcactttgggaggcagaggcaggcagatcacttgaggtcaggagttcgagaccatcctggcccacacggtgaaaccccatctctactaaaaatacaaaaaattacctgggcatagtggcgcacgcctgtagtctcagctatttgggaggctgaggcacgagagtcgcctgaacctgggaggcagaggttgcagtgagccaagattgtgccactgcactccagcctggacaacagagtgagactctatctcaataaaaaaacaaaaagaaaggaaactgttcgaacgtggcctttagcatgttctgaggaaaatatgagctgaacaccaatagcatgtgctataaactgctgggtttccaatgcctaggatggctagatacatagaccataacgtagccgggcagtagtcagaactcaatcaataatgagggaacagatacatgggagggtatcatgcttatgggtctggcaataattgtagctaattggagacttatttctttaagccctagagaggctcctctgagggctgaagtcagtctgccaatgctgaaatatttactgggtgcctagaatgtatggtgtacatacgttacactatgtagtacattataacactaactactgtgcttcttagtggtcagaaccaaagtataggctgggctcagtggctcacacctataatcccagcattttgagaggctgagggggcggatcacttgagctcaggagtttgagaccagcctggccaatatgtcgaaacccagtctctactaaaaataaaagattggccaggcgtggtggcgggcgcctatagtcccagctactcgggaggctgaggcaggagaattgcatgaacatgggtggcagaggttgcagtgagccaagatcgtgccattgcactccagcctgggcgacagagggagattgtctcaaacaacaaacaaaaaccaaagtataaaacatggcccactttatatgcaagaactttgtaatatttgggaagacacaaaaataacataattggccgggcacggtggctcacgcctgtaatccgagcactttgggaggccgaggcaggggatcacctgaggtcaggagttcaagaccagcctgaccaacacagtgaaaccctgtctctactaaaaatacaaaattagccaggcatggtggtgcatgcctataatcccagctactcaggaggctgagacaggagaatcatttgaacccgggaggcagaggttgtaatgagctgaaatcgcaccattgcactccagcctgggcaacaagaacgaaactccttctcaaaaaacaaccaagcaaacaaacaaagaaaagcacataattaatgataaatgacaacgcatgattgtgaaattgtgtggttcttgatttatatgctgtgcatgttcaaataaacagatttagtaaagattggaataatcagttgagaaagctttttaaaaaaaaaatttttttttttaaatagagacaggatcttgctgtgttgcctagtctggtctcgaactcctaagctcaagccctcctcctgccttgatcttccaaagtgttgggattacaggtgtgagccaccatgcctggcccaagaaagctttttttttttttttttttttgaaacacagtcttgttcttgttgcccaggctggagtgcagtggcacggtctcggctcactgcaacctccgcctcctgggttcaagtgattctcctgcctcagcctcccaagtagttgggattacaggtgcctgccaccacccccagctaattttttgtatttgtagtagaggtagggtttcatcatgttggccaggctggtctcgaactcactcctgacctcgtgatccgcctgcctcggcctcccaaagcgctgggattacaggcgtgagccacagcgcctgccccaagaaagcttttatgggtacagggggcttgagattggctcaggtttgtctaggcaagagcgggaaacagggctttccaaatgaagggaagttgtagatcccagaggagtctggcctggcctctgtagaggtttggacctgggacttgcagaaaccagattgtctgggaaagttaggcccaaatcatggttacatttgaaaatcaggcagtgcagttgggtctgctgtgagacaccaaaggggtttattagtggtttctgagcaagcaagcaacatgataaaaatagcatttgaggaaggctaaacaggattaaaaagagcaggtcagggaggtcagcctgaaagacctagactaaggtggtatccagggaatttgagttaatgatgcttatggattcattaaaacaattttttccgccgggcgtggtggctcatgcctgtcatctcagcactttgggatgccgaagcgggtggataacctgaggtcgggagtcaagaccagcctgaccaacatggagaaaccctgtcactactaaaagtacaagaacaacaaaaaattagccgggcatggtggcacatgcctgtaatcccagctactcgggaggctgaggcaggagaatcgcttgaacctgggaggcggaggttgcggtgagccaagactgttgtgccattgccctccagcctgggcgacaagagtgaaactctgtctcaaaaaaaactcacaatttttttcatgaagaaaatctgttcttttaataatgaaaatttcaaacttcacaaaagtaaagagaattgtataatgaattctcatataccatcacccagattccaaggttttatcaagattttgtcatgtctactttatccattctgtctcttcttaagcattttaaaacaatccaggacttcttgacatttcacaggggcctttttttcttttcttttttttttttttttgagacagagtctcactctgtcgcctaggctggagagcagtggtgagatcttggctcactgcaacctccacctcccgggttcaaccgattctcctgcctcagcctcctgagtagctgggattacaggcatgcaccaccatgcccggctaatttttgtatttttggtagagactgggtttcaccgtgttgggccaggctggtctcaaactcctgacctcaggtgatctgcctgccttggcctcccaaagtgctgggattacaggcatgagccactgtgcccgctttctttttttttttttttttttgagatgaagtcttgctctgtcacctaggctggagtacaatggcatgatcttggctcactgtaacctctacatcctgggttcaagcaattctcctgtctcaacctcctgagtagctggaattacaggtgtgcaccaccacacccggctaatttttttgtatttttgtagagacagggtatcaccatgttggccaggcgggtctcaaactcctgacctcaactgatccacccatcttggcctcccaaattgctgggattacaggtgtgagtcaccgtgcccggcctggcctttttttcttttttagacagggtctggttctgacacccaggctagagtgcaatggtgccatcataactccctgtaacctagaactcctgggtaattagaactccagctaattaaaaaattttttttggctaggcgtggtggctcacgtctgtagtctcagcactttgggaggccgaggtgggcagatcacaaaaattagctgggcgtggtggcaggcgcctgtaatcccagctgctcgggaggctgaggcaggagaatcgcttaagcccaggaggcggaggttgcagtgagccgagatcgcgccattgcactccagcctgggcgacagagcaagaccccgtctcaaaaaacaaagacaagccaaaaaaattttttttgtagagagagcgtcttgctgtctacccagactggtctggaactcctgagctcaagcgattctcttgctttacgctcccaaagtgctgggattacaaggtgtgagccaccatgcctggccacaggggttcttttaagagaagaaaatcaacataatctgatggctgactagaactaaaaggagaaaaatgaggctggttgtggtggctcacacctgtagtcccagcactttggaagactaaggcaggaggattgcttgagcctaggagttcgaggctgcagtgagctatgatcatgccactgcactccaggtaagagccaccacgcctggccaagaccctgtctcttttttttttttgagacggagtctcgctcgttgcccaggctggagtgcagtggtgctatctcggctcactgcaagctccgcctcccgggttcacgccattctcctgcctcagcctcccgagtagctgggactacaggcgcccgccaccacggccggctaattttttgtatttttagtagagatggggtttcaccgtgttagccaggatggtctcgatctcctgacctcgtgatccgcccgcctcggcctcccaaagtgttgggattacaggcgtgagccaccacgcccagcctgaccctgtctcttaaaaaaaaaaaaaaaaaaaaaaaaaataggccgggcgcagtggctcatgcctgtaatcccagcattttgggaggccaaggcgggcagaccacctgaggtcaagagttcgagaccagcctcaacatggagaaaccccgtctctactaaaaatacaaaattagccgggcgtggtggtgcatgcctgtaatcccagctactcgggaggctgaggcaggagaattgcttgaacctgggaggcagaggttgcggtgagccaagatcgcgccattgcactccagcctgggcaacaagagtgaaactccgtctcaaaaaaataaaaaataaaataaaaaaataaaaacagacacaaagtgctctccctcactggctcaagctctggtgattggagaggtgagaaggggggccaggtgcagtggctcacacctgtaatcccagcactttgggaggccaaggcaggcggatcacctgaggtcgggagtttgagaccagccttaccaacatggagaaaccccgtctctactaaaaatacaaaaaaaattagtcgggtgtggtagagcctgcctgtaatcccggctactcaggaggctgaggcaggagaatcgcttgagaccaggaggtggaggttgcggtgagccaagatcatgccattgcactccaacctgggcaatgagagtgaaacttgctctcaaaaaaaaaaaaaaaaaaaaaaaaaaaaagaggtgagaagagaaccaggagacactgtgtcctggaaaccaagaaggagaagcattttagaaggaatggtaatagacagtggcaaattcagcagatgagcaagggaaagtatagagggaaaaacgcaggtttgggcattaaggaaatcagcaggcaaggcatttgcagtcatgttaaggataaaagtgagctatagcagaaggttaggaaggagtgtataggaaggaaattgatgggctgggcgcagtggctcacacctgtaatcccagcactttgggaggccaaggagggaggatcacttgaggccaggagtttgagaccagcctgggcgacacagtgaaacaccgtctctaccaaaactacaaaaattagctgggcgagatggcgcgtgtttgtagtgcagtccctgccactcaggaggatgaggtgggaggataacctgagcccaggaggttgaggctgcagtgagctgagatcgtgccactgcattccagcctgggcaacagccagaccctgtctccaaaaataaaaaaaataaaatagaaagtatggctaaaatggggtggggattgtgtgttagggaaagaaagcagcgatggaagggctgaaaatggttggagatgaaacgtctctgacagctttgtgcctcccaagggcatactgttcagtcagcgtcttccttggttccagggtcctgtgcttggattgtggggaacagactccccggggggtgctgcaagagcgtttccaagtcctgaaccccacctggagtgctgaggcccatggcctggctcctgatggtgacgtctttctctcagaggagcaagtccggagctttcaggtcccaacctgcgttcaatgtggaggccatctgaaaccagatgtcgttttcttcggggacacagtgaaccctgacaaggttgattttgtgcacaagcgtgtaaaagaagccgactccctcttggtggtgggatcatccttgcaggtatctgacttggcaagagtggtaaccaccccttgtgcgggattgggagtcctggagagacaccctgtttggtttaactttttctagatctagagaacctagacattcttatgtgtgtcttttctccgtgcaggtatactctggttacaggtttatcctcactgcctgggagaagaagctcccgattgcaatactgaacattgggcccacacggtcggatgacttggcgtgtctgaaactgaattctcgttgtggagagttgctgcctttgatagacccatgctgaccacagcctgatattccagaacctggaacagggactttcacttgaatcttgctgctaaatgtaaatgccttctcaaatgacagattccagttcccattcaacagagtagggtgcactgacaaagtatagaaggttctaggtatcttaatgtgtggatattcttaattaaaactcattttttttaaataaaaaattgttcagctttatatgaaatgcttcatgaatttgtgtgtcattcttgcacaggggtcatactaacctctgtatcattccaattttagtatatgtgctgctgaagagagcactaaaactaatttttttttttttttgagacaggatctggctctgtcacccaggccgaagtgcaatggcctgacctcagctcactgcaacttctgcctgccaggttcaagccatcctcccacctctgcctcccaagtagctaggactacaggcgtgcaccaccatacccaactaattgtttttattttttgtagagacagggtctcactttgtcacccaggctggtctcgaagtcctgagctcaagctctccacccgcctcagcctcccaaagtgctgactttataggcacgagctaccacacccggccaaaacttttttttttgagacagtctcgctctgttgcccaggctggagtgcagtggtgtgatcttggctcactgcatcctctgcctcctggattcaagtgattctcctgcctcagcctcccaagtagctgagattacaggcacgtaccactacacctggctaattttttatagttttggtagagacgaggtttcaccatattggccaagctggtctcaaactcctgacctcaagtgatctgcctgccttggcctcccaaagtgctgggattacaggcgtgaaccaccgtgcccgggtgttttgttttgttttgttttgtctttgagatggagtctcgctctgtagcccaggctagagtgcagtggcatgatcttggctcactgcaacctctgcctcccagattcaagcaattctcctggctcagcctcccgagtagctgggactacaggtgcccaccaccatgcccggctaatttttgtattttcagttcaccatgttggccaggctggtcttgaactcctggcctcaagtgatccacctgccttagcctccaaaagtgctgggattacaggcatgagccaccaagcccggccagtggtcatctttccatgtcctaagtgctatggtattgtgactgataggctgatgttcacaagcattccctggaccctgctcttcgtttatctttgcattcacttgtttcatttctttacagatccctaaggagcatccgttttttctcaaactaatcaaagctcgctgagtgcagcctgtagggggcaacaaatcaacacctctctgccagcccatttctcaacccggcagctttcccagccaaagagttaaggtctaggctgaggagatttgccccagaacaaagactttttcaaagaagcagctgcattcatttcctttttatctcacctggcaggagaaatggcctgggacatatgtaggccagagtggtctctggagcgccaacccaaggatctcactaattttgtggggtaagggtagaaggaaatgactaaatttataatccaaatggttaagtgtctttaactgaaccattttgatataatttttgaaaaaataagcaatggccatgaattaattttttataaccaagagataaaggaatctttcaaaaatagcacagcagctgggcgtggtggctcaagcctgtaatctcagcactttgggaggccaaagcgggcggatcacgaggtcatgagatcgagaccatcctggctaacacggtgaaaccccgtttttattaaaaatacaaaaaaatgggccaggcacagtggctcacttctgtaatcccagcactttgggaggccaagacaggcagatcacgaggtcaggagatcgagaccatcctggctaacacgatgaaaccccttccctactaaaaatacaaaaaaattagctgggcgtggtggcgggtgcctgtagtcccagctactggggagactgaggcaggagaatggcgtgaacctgggaggcggagcttgcagtgagccgagatcttgccactgcactccagcttgggcgacagagcgagactcaaaaaacaaacaaacaaacaaaattagccaggcgtcgtggcaggcgcctatcgttccagctacttgggaggctgaggcaggagaacggtgtgaacccgggaggcggagcttgcagtgagctgacatcgcgccactgcactccagcttgggcgacagagcaagactccgtctcaaaaaaaataaaaataaaaaataaaaaataaaaatagcacaccagggccaggcacagcggctcacgcctgtaatccctgcactttgggaggcataggcgggtggatcacaaggtcaggagatggagaccatcctggccaacatgatgaaaccccgtctctactaaaaatacaaaaattagccaggcatggtgggatgtgcttgtagtcccagctactcaggaggctgacgcaggagaatcgcttgaaccagggaggcggaggttgcagtgagccgagattgtgccactgaacggcctgggtgaaagagaaagactctgtctcaaaaacaaaacaaaacaaaacaaaaaaaccacactaggtatgtggattgtatgtttatatatttaattatatatatatatatttttgagacggagtctcgctctttctcttttgcccaggctggagtgcagtggcgcaatcttggctcactgcaagctctgcctcctgggttcatgggactacgggcgccagccaccacgcccagctaacttttttgtatttttaatagagacggggtttcgctgtgttagccaggatggtcttgatctcctgacctcgtgatccacccgcctcagcctcccaaagtgtacctgtttgtcttttttaaaaaagattgcaaatgaggctcggtgggaggccgaggtgggcagatcacctgaggtcaggagttccagactagcctggccaacatggtgaaaactgtctctactgaaaatacaaaaattagccgggcgtagtggccagtgcctgtaaccccagctactcgggaggctgaggctgaagaatcgcttgagcagaggaggcagaggctgcagtgagccaaggtcatgccactgcactctggcccgggcgatagagcaagactccgtctcaaaaaaaaaattatatagacacatatatatacataaaataataataataggcccggcacggtggcttatgtgagtctgtaatcccagcactttggagggctgaggcgggtggatcacccgaagtcaggagttcgaaaccagccagcctgaccaacatggtgaaaccctgcctctactaaaaatacagaattagctgggcatggtagccggcgcctgtaatcccagctacttgggaggccgaggcaggagaatcgcttgaacctgggaggcggaggttgcagtgagctgagatagcatcattgcactccagcctgggcaacaagagcaaaactccgtctcaaaaaataaaataaaataaaaataatagtaataaaaagtaaaaaaatagaaaaagattacaaatcaaggcttgcttaatgtaataaagactttctcaagaaaaattaaagtgcattatcctttcctctccttccccttaggaaaacagtatttatcgaacatttactatacaacaagcacttaggaagcatttacacaacatatttggacacttaattcccacaaccctatgataagagcactattatttcgggtaacctgcccaaggtcaccaagagggtgactaggccaggaatgaaggccagtctgtccagttctgagttcgctctcggactttctgctgtagaaacccggtggggtaacagcagctgtacctgcggaagaaggacaaagctcaagaaacttccagaagtgacccaggctgggttctgaaagatgaacatgccttcacgaggtaggaaaagggaggaaaccactcatgcaaaaagcatggctgttacaccaccaaatctcttcggttttttttttcccttcaatgtgggggtggaaatttaagtgtagatttggggcgcctcagaggcctgtggctcgcccaacatccccttgcctctctgcttggccacctctcctctcagctcccctttgttccctgcaccccactttccctaccccctaatccgtccccgggataaaagcaatgcaggcgatgcccacaggaaaccggcaggaggagctgggtgacagggaagagcgacccggagagtcacatccacgtgagttcgccctcttttcacactctagcgcccattctgtccttcctgctggattctggctcaggagaagagcgccgccaggaccccaggaagctgcagacaggagccgctgacacctccacctcacgcggacgccacctagtgtgaccattaccagccactgcgcctgcgcagactcgggttttctgtgcgcgccagaggggcggggcctgggccgggaaggggcagaagtagaccgacggctgggccgccattcaccaatagaaaagagagatcgagagccacgtgctcataagatatccaatcacaatcacatcctgtggcggcggattggggggcgtggactagaggttgatcgggttgggcacacagcatcacgtgacacgaaaaggtaaataaggccacgtggctttttctccttggcttcggcgaaacattacgtcacactaccgtctctgaacaattatttaatgaacttatgtgatgcgctagacaatgtgaagacaatgcggttgctagaaattgtaatctctccatcaaattactctgtccagcttatttccttgtttcttcattcaaatcatcctagacattcaactagttttccgtatcctactttcatacaaatgctcatttaaagataattaagggaatttattctctctttcccaagccttgataatgaaaaagaggtaggttattttgttgttggttttttgttttcttttttcttttttttttttttttgagacagggtctcattctatcacccaggccagagtgcagtctcactgcagcctcaaccttctgggctcaggtgatactcccatctcagcctcccgagtagctgggactacagccatgcaacaccttgctgattttttgtagagacgggatttcaccgtgttgtccaggctggactcaagcaagcctcagcttctcaaagtgctgggatttacaggcctgagctaccacgcccggcccaagagagatttttacatcagaggatatctttagagcctttagtagccctgtgactgctctctctctctcgtttgttctgtcatctaaataaataaataaataaataagaagaagtaagcaccattttcctaaaagcccacttttcttccatccaacagggacttgcaatttctttccactgaagaaatattttttatggccttcacagttcgttgaagattaaggccaggtctaacttgattttgcatcccttgaaattcttcatagcacaatatgcaaagaagggttcttcggtttatgcttgttgaatttgaatttgagaatagtcccattcttgcctgccaaagaattaaaaagacttaaaaagaattaattttaattaaaaagaattaaaaagatagcacttctctgaattatctggatttgggttccaaggtcagctatgccacccaggaattagtgacttttggcaatccattgcatctttaagccagtttcctcatccatcagatgtggatataacagtacctacaactatagaacttcaaggatgacaagataattgtgcaaaagacatgacaccgtctggagcatacagcataatatatacaaggatgccagtttgaagagtagggaagaaagtctcagagcagactgaattgtagacagatactaacactaaatcattgtcttgtggccagccccgaatacattgtatcctcagcattttgtgtggtgcctggcccagagtaagtgttcaataaataatcattgaatggatgaataaaatgagggaccgggcgtggtggctcacgcctgtaatcccagcactttgggaggccaagtcgggcagatcacgaggtcaggagatcgagaacatcctggccaacatagtgaaaccctgtctctaaaatacaaaaaattagctgggcgtggtggtgcgtgcctatagtcccagctactcaggaggctgaggcaggggaatctcttgaacccgggaggcagaggttacagtgagccgagattgcgccactacactccagcctggtgacagagtgagaatctgtctcaaaaaaaaaattataaataaataaataaatgagggagaaattatgccaaaagataagtccacacacactcccttcttcaaatggaaggtcttctattgcccaccacatacccagaaatggtggctgttctgtcagtttccagtggtctgaaactgcttaatggtgccttttgatagtggacagagtctcactgtgtcacccaggctggagtgcagtggtgttatcttggctcactgcaacctcttcctcccaggttcaagtgattcttctgtctcagcctcctgagtagctgggattacaggtgcacgctaccatgcccagctaaattttgtattttttagtagagatgaggttttgccatgttggccaggctggtctcgaactcctgacctgaggtgatctgccctcttcggcttcccaaagtactgggattacaggcgtgagccaccatgcctggcctcaactttgcttttctgcttcagttcccttctctgcctctccccacttgctctggtgaatttcttttttttttttctttctttggccgagtatcactctgtcacccacgctggagtgcagtggtgtgatctcagctcactacaacctcagcctccctggtttaagccattctcctgcgtcagcctcctgagtagttgggattacaggcctatgccaccatactcggctaatttttgtattttttagtagagacagggttttgccatgttggccaggctggtctcaaactcctggcctcaagtgatctgcccacctagacttctcaaagtcctgggattacaggcgtgagccactgtccctggcttagttctggtgaatttcaatgtaaatgtagtcataaatactcatagaggaattgggctgaagtgacttagtggttaaaagcttgggcactgccaccagacagacctggccaaatcctgattttgccatttgtgtgatcttggacaaatgacttaacttctctgaatttttagttccacatccatgaaatgggagcaaaaatatcaatatcacagagctggtttgaacatttaatgagatgagatgtggaaaactccgaacaaggaagtatgcagtaagtgctccagaaatgcaagctgttattggttttttgttttgttttgttttgttttgttttgttttgtttgtgttttgtgtgtgtgtttgtttgagatagtgtctctctctgtcactcaggctggagtgcagtggcgtgatcacagctcactgcagcctccaactcctgggctcaggggatccttccacttcagcctccctagtagcttgaaacagggtctcactctttcacccaggctggagtgcagtggtgtgatcatagctcactgcagcctcaaactcccgggatcaagagatcctcctgcctcagcctcttgagtagctacgatcataggcgcgtgccgccatgctcggcttgttaatgtttattatatttcatgactacagtgtcaaaattagcctgtagagtgtggtgaagtcttttatttagaaaagaaagtcgtggccgtgtgcggtggctcacgcctgtaatcccagcactttgggaggccgaggcgggcggatcacgaggtcaggagatcgagaccatcctggctaacacggtgaaaccccgtctctactgaaaatacaaaaaattagctgggcgtggtggcaggagcctgtaaacccagctactcgggaagctgaggcaggagaatggcgtgaacctgggaggcagagcttgcagtgagccgagattgcagcactgcactccagcctgggcgacagagcgagactccatctcaaaaaaaaaaaaaaaaaagaaagtcattgtagaaaaatggtttaatacagttgaaaatggaggcagaatcatgagacgggggcaaggtctggctcaaactaaagcctaccacttcaggcagggaagggcagtggttcagcatgtgttttctgttgttagacttgccgagttcaaattccttctctgctgcttactagatgatagcattggaaaagtgacctctcctattgagcctcagcttaggaaaataagatttgctaatagcgccaatacctcacagggctgtcaagaggatttatggacacacagtcctggtacagagtaaataatcagtagatggtgatcgttaatcattactcaggtttcaaggtgcttgcttgcttcctggaagtgtctttctaattcaacttagcttccaaggctggaagaaatgatactcacaaaagactaggcagagtagccaggcgcggcggctcatgcatgtaatcccaacactttgcgaggccgagccaggcagatcacttaagctgaggagtttgagaccagccagggcaacatggcgaaactctgtctctacaaaaaatacaaaaattagccaggcatggtggtgcatgcctatggtcccagctactcgggaggatgaggcgggaggattgcttgagcccgggaggcggaggttgcagtgaggcaaggtggcatcactgcactccagcctgggccacagagcaagactccacctagaaaaaataaatacataaaaataaaagagtaggcagagacctagtttatagacagagaataaaacaatatccaaacatgaggtctttcaacaaggtgctttattggagagtacagtgtgagatgaggcagatagaggtgatgcttttgagaggtgatattcaactctgacaatacttcttggtgtccaggttcttgtgtgccttgttatatggagcttttgaaaagcagatggcagcgttgcggtcgcagttgcaaatgaaggcctcacactctttgtttttgcctggagagggatgaaaggagaggactgagccaaggtggaccctgttttgtacaatctggggcaagaagaattaactggaataagctggcagccattccactgatgcacatttagggctgacagattaagtgaatacaagtacatcaggatgcccagttaaatttgactttcagataaacaatgaatgcaatatttgggacatataccccccaaaaaattatccattgcttatctgaaagtcatatttatctgggcatcctgtgtttttttgttttgttttgtttttaagacggagtttcccttttgtcgcctaggctggagtgcagtggcgtgatctcagctcactgcaacttctgcctcctgagttcaagtgatactcctgcctcagactcctgagtagctgggactacaggtgctcgccaccatgcccagctaatttttgtatttttattagagagggtgtttcatcatgttgtccaggctggtctcaaactccggacctcaagtgatccatttgcctcggcctcccaaagtgctgggatacaggcgtgagccaccatgcccaacctagtttctctactttaaagcatgtattttaaaaattatggaacatccttaaatggaatactacatagacatttagaaaaattaggtatgcctgcacatggaaattttcccaaataaaaaaagctagtgtatgccccaaaaatctggaggaatatgtaactggttatctttgggtagtaggattatagatgccttccactttccataatagatatttatgtagagtttgaagttgcattacttttggcttgtttacttttataaccaaaataaacaataagattacagttaaaatgcatttaaactttattacatataatttacgtatctctgcttaccttcaggaatcttattagttttgtttctctccgatcctttattttatttatttatttttttgagatagagtctcgctgtgtcgcccaggctggagtgcagtggtgggatctcggctcactgcaacctctgcctcccaggttcaagcaattctcttgcctcagcctcccgagtagctgggactacaggcatgcatcactacacccagctaatttttgtatttttagtagagatagggtttcaccatattgaccaggctggtctcgaacttctcacctcaagtgatccacccaccttggacttccaaagtactgtggttacaggcttgagtcactgtgcccaactgagttatttttaattaatatgaacaaacatcctctaatgcaggtttcttgtcttagttgcaaacattaaaaaaaaactgtgtgtgagtgtgtgtgtgtgtgtgtatttctctggggagagggttcatagctttcatcagatttgtaaatttggccttctaaagtggagcaggaggatgtataagcaaattaagccatattattcagtgactaaaatagtaacaatgaaaaaacagtaacaataaaggtttgaggcaatatgaaaaagtcataacaaggtgataagtgaaaaagcagaatgcaagattgtatttattctgcaaagttgtcaagattgttttaaaaaaagaaaaagaaagtttatatctaggctgtgcattcatcaattatttattgagcacctactatatgtcagacactgctctagatctggggatatagcaataaagaaaatagacagtaatcggccaggcacagtgactcacgcctataattccagcactttgggagactgaggcaggcagatcacttgaggtcaggagtttgagaccagcctgggcaacatggtaaaaccccatctctgctaaaaatacaaaaaattagccaagcatggtggtgcacgcttgtaattccagctactcaggaggcttaggcaggagaatcgcttgaacccgggaggcagaggttgcagtgagctgaacggaggttgaggtgatgaagtgagactctgtctcaaaaaagaaaggaagaaaataggcagtaatccctgttctgtggatcttacattctattggaaagatggaatgtaaagaaataagtagccgcacatggtggctcacccctgtaatcccagcactttgggatgccaaggtaggaggattgcttgaagccaggagtttaagacaagcctggccaacgtagtaagacccagtctctacaaaaaaatttttttaattagccaggcgtggtggtgcacgctcgtagtcccagctacttgggaggctgaggtcagcagatcccttgagctcaggaggttgaggctgcagtgacctatggttgcaccactgtgctcatgcctgggtgacagagcaagaccctgtctctaaacaacaacaaaaaaaaacccaaactgtcaccacttacaagctgtgtgatcttgggcaaatagctcagccttctgagcctcagttttcttatctgttaagtgaggataattgtacctatcccatagtgttgttctgaggattaaaggagacactgcccagaaccaagaaaattaacactaaatcatggctgttgttactattatttccccccggcctactgagaaccaactagaattcataggtcaaggaagggataaacctactgctacaggtgattgccgagccagagcacgagtatgaataggtgtgggtgtacgggttgtccagcagaaatttacagctgtccagcttcttggcctggtcatagcagttgtcatgtgtctggcagcacctggaaagtgggagggacagctgagataggagtaagtgcagagcaataggtcagccctcacctgcccactctcaggaacaggtggggatgacttcgccaagatgcttcaggagaaatgatcctatggcttgaaaaaatataagtccttttatcatatatttattgaaagcattttttttttttgagacagagttgctctgttacccaggctggacagcagtgacacgaccttggctcactgaaacctccaactcagtctcccaagtagctggggttacaggcgctcgccaccatgtccggctaatttttgtattttttagtagagacagggtttcaccatgttggccaggctggtctcgaactcctgacctcaagtgatccgcccgcctcggcctcccaaagtgctgggattacaggcatgagccaccgcgcctggcctgaaagcgatttttaacatggttgcaagaatacagtaaaatcctgtattcagaaggtgcagtgacaaccactgctagaaaatgacacgtggatagttgctgtgatgtttactgttgctacattctgccactggagggcagcatcgcccactgttttgcacgtcggtcattgtttccatctctaacggggtgcgttcgctacagggtcctcttggaacatatttgtttatttgacaagaggtgaaaatatgttatccttagcagatatgcaagtcccctttgtatgcctcgtgagatccttggcgtgtgccccaccccgcccccggcaggcactccaattttcctgcaggcggatcacttacttgtccagttcatccacgggggtgcctgagccccccaagccacagtagcagccgtagttgttgtattccaagaaggggtcactccccgggatcacgcacttgatcattttgcggaactgccacacggcccgagggctgatgccgctgtcggcggcggccactgcaagaagacatagccagagttcaaatcggtctgccagcaccccggggacacactgccttcctgctccctcgggtcccacgctgcctccctgacccctgccagctgcctcctctgaagaccgttggacccaggaacctggtaaagtgaaagtgggtagaggtttttttttttttttaatgaaaactttatatatataaagtttatatctttgtgtgtgtgtatatatatatatatcttcttctttttcttcttcttcttcttctgggaccctaccgcctcagctaggattacaggcatgtgccacccagctaggcctgatagttttttttttttttttgagatggagtcttgctctgttgcccaggttggagtgcagtgacacgatttcagctcactgcaaactctgcttcccgggttcacgccattctcctgcctcagcctccctaggtcagatagttttaaactatctgcactgtttatccagtgaatatttattgagcacttactatgtgccaggctctgtcctaggagctagagatacagcagtgaacagatataataataataataataataataataataataataataataataatctctaacctcatggagcttacaacctagtgggagagaaaaacaataaataataaatgtgataaggccgggcacggtggctcatgcctgtaatcccagcactttgggaggccgaggcaggcggatcacaaggtcatgagatcgagaccatcctggctaacacgatgaaaccccgtctttattaaaaatacaaaaaaattagcggggcgtggtggcaggcgcctttagtcccagctactggggaggctgaggcgggagaatggcgtgaacccagcaggtggagcttgcagtgagccgagatcgcaccactgtactccagccttggcgacaaagcaagactctgtctcaataataataagaataataataaatgtgataagtaaggaaactggatactgcattagaaaggggaagaatagagcaggatgaggagaatctaaaagggaggtcacccagcctggccaacatggtgaaaacctgtctctaccaaaaaaaacacacaaaaaattagctgggcatggtggtgtgtgccagctacttgagagctacaagtcccagctacttgagaggctgaggcaagagaattatttgaacccaggagatggaggttgtagtgatctgagatcacgccaccgcactccagcctgggcgacagagtgagccccgtctcaaaaataaaataaagtaaaataaaaataaaaattaaaataaaataaaataaatgggagattggcctaactacttagttgagtaaggtgggaggatcacttgagcccacgagttggaagctgtggtgagctatgatcatgccactgaactccagcctgggtgatagagcaagaccctgtctggaaaaaagaaaataaaggcaagctttcttagctcaggcaatctgagttcagacttgcaggttgaaaaagtgccagccttgagggaaccccaatagaggagcccttaagccccactgggaacctcgaattgagactgcggggctggccatccctgtttgctgtggcctgtggcccccattccagaggagtgagatcttagctcacttgggagagaaaggcgggtggagccggggagacttgcctacctgtgagcagcacagctagcacaaggagtttcatcttgcagtcaaggtgagaaaagaactgagatgaccagtctcaggtatagtcttatagtcagtctccacacaaccctgcccagataaggctggagtgtttgctttgctcttggctgagtttggggctggccttgaatctgtctgttgcaggaatgaccctgacgatttgccagcatgggatcactggaaaatatgttatgcatttgtccttagcaactgttaaccaaagggatggtttctggagttttcagatcttacaatcttgaccctcatacccaccactttgtactcagcccagcttcacgggctggttggggaaagcaaagccgtcagttcagtcggacgctgggataagggagacaagaaggaagtgcagcctgggcaacatagagagacctcatctctaaaaaaaaaaatgttaaccaggtgtggtggtggattgcacctgtgatcccagcaactcaggaggctgagatgggaggatctcttgagccagggaggtcaaggctgcaatgaacagtgattgagcctctgcagcagagtgagaccctatttcaaaaaaaaaaaaaaaaaaagaaagaaagaaaaaagatcgctgcctgcagcctcaatgtcttatcaagtgcctgaatctgtgcactgggtctggttgaatagtcccatcagtcgtgcaccttgcagataaagagacaggttcagagagttgcggtaacttgcccaaggtcacacagttggcaaatgacaaaatagggctccagtttagatctgtctgattccaaggcagaggttttatttttttccaccactccgctctgcagtgtgggtttgtgagaaaaacctgggctttggattccaaaggcctgagtctgaattatagaatactaaagggcattagaactgtcatatcagaggccaggcacggtggctcatgcctgtaatcccagcactttgggaggctgaggctggcagatcacctgaggtggagagttcgagaccagcctgaccaacatggaataaccctgtctctactaaaaacacaaaattagccaggcatggtggcttatgcctgtaatcccagctactccggaggccgaggcaggagaatggcttgaaccctggaggcggaggttgcggtgagctgagatcacgccattgcactccagcctagggaacaagagcaaaactccatctcaaaaaaaaacctgtcacatcacatatctatttatttatatatattttttgagacggagtcttgctctgttgcctaggctggagtgcaatggcgcgatcttggctcactgcaagctctgcctcccaggttcatgccattctcctgcctcagcctcccaagtagctgggactacaggcacccaccaccacgcccggttaatttttttttttgtatttttagtagagatggggtttcaccgcattagccaggatggtctcgatctcctgacctcgtgatccacctgcctcggcctcccaaaatgctgggattacaggcgtgagccaccgcgcccggccaaatatctacataacattgtttagctgaaattcacataacattaaccacgtttaagtaaacaattcgggggcatttagtaccttcacagtgttgtgcaaccatcacctctatggggttccagaacatttttatcactccagaaggaaaccctgtacccattagcagtcacactccctcagcccctggtaactgctaatctgcttctctctctctctctcttttttttttgagacagagtttcgctcttgtcgcccaggctggagtgcaatggcacgatctcggcttactgcaacctccgcctcccaggttcaagcgattctcctgcctcagcctctcgtgtagctgggaattacaggcgcctgccagcatgcctggataatttttgtatttttagtagagacaaggtttcaccatgttggtcaggctggtctcaaactcttgacctcaggtgatccactcctcagcctcccaaaatgctgggattataggcatgagccactgtgcctggcctctgatctgcttctctctatatagatttataattggttaacttggtgctcttctgttcctatgtcacctctacaacaaccctgtgggataaggagggcctggttatttaatttatttatctgttttttttttttgagacaaagtgtcgctctgtttcccagactgatgtgcagtgacacgatcatagttcactgcagcctcaacctcctgggctcaagcaatcctcccaccttagcctcccgattagtggggactacagacatgtgtcaccacacctggctaatttaaaaaaattttttgggccaggcacggtggctcatacctgtaatcccagcacttggggagaccgaggcaggcggatcacgaggtcaggtgatggagaccatcctggctaacacagtgaaaccttgtctctactaaagatacaaaaaataagctgggcatggtggcgggtgcctgtaatctcagcaacttgggaggctgaggcagaagaatggcgtgaacccaggaggcagagtttgcagtgagccgagatcacgccactgtactccggcctgggcgacacagcgagactctgtctcaaaaaaatttttggagacacggcgtctccctatgttgcccaggctggtcttgaactcctggcctcaagtgatcctcccatctaagcctcccaaagcattgggatcacaggcgtgagccactgtgcccagcaaccttgatagttttgaggagtattggtcaggatgaccctctcttggaatttgtgtgtgtgtgtgtgtgggtgtgtgtgtgtgtgtttgttgtagtctcactctgtcgcccaggctggagtgcagtggcacaatctcggctcactgcaatctctgtctcccaggttcaagtgattcttgtgcctcagcctctgagtagctgggattacaggcacgtgccaccacgcccagctaatttttatttatttatttttatttatttttgagacggagtctcactctgtcaccaggctggagtgcagtggcgcgatctcagctcactgcaacctctgcctcccgggttcaaatgattctcctgcctcagcctcccgagtagctgggactacaggtgcacaccactgcgtccagctaatttttgtatttttagtagagacggggtttcaccatgttggccaggatggtcttgatttcttgacctcatgatctgcccgcctcagcctcccaaagtgctgggattacaggcgtgaaccactgcacctggctctctattggaattgtcctgtgtttttctcataattagattacagttatgggtttgggggaggaagaccacagaggcaaagtgccatttcatcacatggctgctttatgtttaatcatctcttttctgggccgggcgtggtggctcatgcctgcagtcccagcacttcgggaggccgaagcgggtggatcacctgaggtcaggagatcgagaccatggtgaaaccccatctctactaaaaatacaaaaaattagccgggcgtggtggcgggtgcctgttgtcccaggtactcccgaggctgaggcaggagaatggcgtgaacccgggaggcggagcttgcagtgagccgagtgccactgcactccagcccgggtgacagagtgagactctgcctcaaaataaataaaaaaaaaataaaaataaaaatgaaataccattaaaagttcagtttctcagtcacaatggccacatttcaaggctcatagacacatgtggcgagtggctgccagattggcagccacagaatgtttccatgatcacagaaggttctgttggacagggctgctgtggattgtcacagagcctgtctcagggctgccccatgggaggtgggggctatgaggactaatggagggggacttggttaggtcagaatcccacatcagcttgactgaatggtcctgcctctgcagccccagaatgagtggagtctgcccaagcaaagggaagccttgcccagcaaaatgttcagtccctcttatgtgggttccttggggtcataacaagacagaggaccaggcactgctcctaggtttaggcctgaaggatgctaagtgggtgattgggggtggctcaaagaaggagaagcagctatggttgcaagtaaagttattaattaccctttttttccaggctggagtgcagtggtgcaatcttggctcactgcaacctccacctcccaggttcaagtgattcttctgccccagcctcctgtgtagctgggactataggcaagtgccaccacacctggctaatttttgtatttttattagagatagtgttttgccatgttggccaggctggtctcaaactcctgctctcaagtgatccacccaactcggtctcccaaagtgctgggaatacagacatgagccaccgcacctggctaatgagttactattaactgagcgctaactccatcccaggtcccatatgctaagaacctggcacaaaggtcgaggtaggtccagtacaaacttcattttacagagaagacagctgaggctgagagaggttaagtgactgccccagagtcacacatcaggaccaagatatgagttcgatctggttctcatgctaccatctcaggctagggagtactgaaagtcccttgaggaaggaagagattcagtccaacctacgacttccctccttccccagcccatgaaagccttcctaagaacaatctggacaaactccacgtgctggagtttaggcaaagcacctggtggggagggggtccggccgctgccacaaccctctccccctggaaagagacatgctcactgtgacagcccagacctctgtggctcctgccacaaaggtgacagtataagggacctggaagggcactaggtagctccccaagcccctacactctttgtaccttgaccttccaccaccccagatccctgcacaggtgtgcgaagcacagcctctcccagcctgggaaaaacacactcttcagtggaaagaacagctaagcatagctgcttggccccttcaggtgagggcgtacccacgcttcagcaaggccacatctacttggcttctttttttttttttttttttttttgagatggagtttcgctcttgttgcccaggctggagtacaatggcgtgatctcagctcaccgcaacctccgcctcccaggttcaagcaattctcctgcctcagcctcctgagtagctgggattacaggaaggcaccaccacacccagcaaattttgtatttttagtagagatggggtttctccatgttgaggctggtctcgaactcctgacctcaggtgatccgcccgcctcggcctcccaaagtgctgggattacaggcgtgagccaccgcacccggccaggtctatttggcttctaaaggatagggctcctgtttctaggaagtgcttaacagcagctaccagctaccatctgctgagtgtttctatacgcttggcactgtgctagcactgtgctttacatatgttgtctttcagcctaacaacactcttctgatatagttattattactgtgatagttgtcatcatcttccccatcttatagatagatgatgaagcagtttcagagagtgtaagtaacttgctcaaagtcacatggctagaaagtggagaaaaaatttgaacctgtgtctacctgcctctgattcctgctctctccaatgataacaacagcagcaattaacatgctgtgaggctgtgctaggaaggatactaagagccttgtataggctagcccaccatcaggtgccaatgagcaaaatgaggcagtataccggtgtaactaaaccttttccactcccaaagccaccatcttcagtgtcaggatcttcctgacagcctcctaactgctataatggcactgtctacctccatctctccggagaagggatagtgtagccagtggctcccaaacttgactgatccctggactcccctggaaaacttaaagagtgatatagtccaggcatgatggctcaagcttataatcccagctattctggaagctgaggcaggaggattgcttgagtcaggaattcaaggccacattgtgctatgattgtatcactctactccagcctgggcaacagagggagaccctgtttcaaaaaaaaaaaaaaaaggtaatacagattattggaatgtaagatgtgcaggttgggtataaggatctgaaatctgtggtctctctctcttttttttttttgagacgatgtctggttctgtcacccaggctggagtgcagtggtgcaatctcggctcactgcaacccctgcctcccaggttcaagtgattctccagcctcagcctcccaagtagctgggattacaggcatgcgccatcacgcttggctaatttttttgtatttttagtagaaatggggtttcgccatgttggccaggttggtcttaaacgtttgacctcaggtgatctgcccgccttggcctcccaaagtgctgggattacaggcatgagccaccgtgcccagccgctcttttttatttaaattttttttcagcaggccaggcatggtggctcacgcctgtaatcccagcattttgggaggccgaggccagcggatcacccgaggttgggagtttgagaccagcctgaccaacatggagaaaccccgtctctactaaaaatataaaaattagccgggtgtggtggtgcatgcctgtaatcccagctacttgggaagctgagtcaggagaaccgcttgaacccgggaggcagaggttgccgtgaaccaagatcgcatcattgcactccagcctgggcaaccagagtgaaactccatctcgaaaaaaaaaaatttttttttctaggtgattctgatagttatgtagttttaaaccactgtttttttgtttttttgtttttttttttgaaatgactattgggttggatagaggttactgggtgttattatgctttaaaactcaaatatactatatattttttctcttctttttttttttttttgagaacaccatgggggaaaacgcccccataatccaatcaccttccaccaggtcctttcttccacacttggggaatacaatttgagatgagattttggtgggaaaacagagccaaaccatatcattcctccttggctcctcccaaatcttatgtccttttcacatttcaaaatcaatcatgccttccccacagtcctccaaagtcttaattcattccagcaataacccaaaagtccaagtttaaagtctcatctgagacaaggtaagtccctccacctatgagtctgtaaaataagaaacaagttggttacttccaagaaacaacgcagatacaggcattgggtaaatgttcccattccaaatgagagaaattggccaaaacaaaggggtcacaggccccatgcaagtccgaaacccagcagtgcggtcattaaaccttaaagctctgaaatgatctcctttgactgcatgtctcacatccagggcacactgtgtgggcgacaagccacccaggcgccgaggcaagagactgaggacatgagctgttccagtataataaaatataaaacaagaatagttatactagatatagatcttagatatgattatatatgaatatcaataatcattagttggtagcaatgactctttattccaatattataataatcctcgctctataatcataacttaggaaaaaccagaccatgcagagatgggagctgaggggacatagtgaggtgtgaccggaagacaagagtgcgagtcttctgttatgcccggacagggccaccagagggctccttggtctagcggtaacgccagtgtctgtgaagacgcccgttgccaggtggaccgtggtctagtggtagcataagtgtcaagggaaaacacccactgcttagcagaccgggaaagggagtctccctttccctgggggagtttagagaagactctactcctccacctcttgtggagggcctgacattagtcaggctcgcccatggttatctggaggcctaaccgtctccctgtgatgctgtgcttcagtggtcacgctcctagtccgccttcatgttccatcctgtacacctggctctgccttctagatagcagtagcaaattagtgaaagtactaaaagtctctaataagcagaaacaatggcgtaagctgtctctctctctccctctctctctctgcctcggctgccaggcagggaagggccccctgtccagtggacacgtgacccacgtgaccttacgtatcattggagatgactcgcactctttaccctgccccttttgctttgtatccaataaataacagtgcagccagacattcagggccactaccggtctccgtgacttggtggtagtggttccccgggcccagctgtcttttcttttatctctttgtcttgtgtctttatttctacactctctcgtctctgcacatggggagagacccactgaccctgtggggctggaccctacacactgatgtaaggggtgggttcctaaggcctaaggcagctccatcctgtggctttgcagggtacagcccccatggctgctttcaggggctatgtacctgtggcttttccaggcacatggtgtgagctgtcagtggatctacctttctggggtctggaagatgatggccctcttctcagctgcactaggcaatgccccagtggggattttgtgtgggggctccaaccccacgtttcccttctgcactgccctagcagaggttttccatgagggctctgcccctgcagcagacttctgcctggacatccaggcattttcatatgtattagtccattttcatgctgctgataaagacacttctgaggctgggaagaaaaaaagatttaacggacttacacttccacatggctgaggatgcttcacaatcatggcagaaagtgaaaggcatgtctcacatggtggcaggtaagagaagagaccttgtgtagggaaactcccccttatagaatcatcagatcttatgagacttattcactatcatgagaacagcacaggaaagacctgcccccattattcaattacctcacaccaggtccctcccacaacacgtgggaattcaagatgagatttgggtggggacacagccaaaccatatcaccatacatcctctaaaacctagacagaggttcccaaacctcaactcttttcttctgcacacctgcaggcctatcaccacatggaagctgacaatgcttgtggcttgcaccctctgaagcaatggcccgagctgtaccttggctccttttagccacagctggagctggagtggctgggatgcagggcaccatgtctgggggctacacagagcaatggagccctggatctgacccacgaaaccatttttctgtcctaggcctctgtgcctgtgatggtaggggctgtcatgaagatttctgatgtgccttggagacattttcccccatggtcttggccattaacacatttggctttttgttacttatgcaaatttctgcagctggcttgaatccccagaaaatgggtttttcttttctaccacatggtcaggctgcaagttttccaaacctttatgctctgcttcccttttaaacataagtcccaatttcaaaccatctctttgtgaatgcacatgatagaatgctttcagaaaaggccactcacctcttgaatgcttttttgcttagaatttttcttctgccagataacctaaataatctctctcaagttcaaagttccacagatctctagggcaggagcaaaatgccaccagtccctttgctaaagcatagcaagaatgacctttgctccaggaccaagtaaattcctcatctccatctgagaccatctcagcctggacttcattatccatatcactatcaacattttggtcaataccattcaacaagtctctaagaagttccaagctttcccacatcttcctgtcttcttctgagccccccctaaactgttccgacctctgcctgttatccaattccaaagtcacatctacaagtttcaggttatctgtatagcagtacacctagcagaggttccccatgagggctctgcccctgcagctgacttctgcctggacatccaggcattttcacatgtattagtcagttttcatgctgctgataaagacgtacctgagactgggaagaaaaaaagatttaatggatttatagttacacctggctggggaggcctcacaatcatggcaaaagttgaaaggcatgtctcacatggtggcaagacaagagaagagaccttgtgtaggaaaactcccccttatataatcatcggatctcatgagagctggtaccaattctctgtattagtctgttctcacactgctataaagatactacctgagactgggtaatttataaagaaaggaggtttgatagttccacatggctgggaagcctcaggaaacttacaatcatggcagaaggcaaaggggaagcaaagcacatcttacatggcagcaggagagagagagcagagtggggagtgttacttttaaaccactggatcttgtgagaactcactatcatgagaacagcatggggggaaccacccccataatccaatcacctcccaccagatccctccctggggatttcaattccagatgagatttgggtggggacacagagccaaaccatatcacccacatacttcttttttattggctattttaaagcaaatcatagctctcaagtcattttattcataagcacttctgtatgcatttcaaactttaagtattttttaattctggtaaaaaatatataaagtttaccatcttaaccatatttgaataggcagttcagtagtgttcagtatattcacactgataacatttttcatcttgcaaatccaaaactgcacccattaaacaactctccttctcccttgccccaggctctggtaaccaccattctacttcttgtttctgtgaatttgactaatctcagtaccttgtataagtggaatcatatagtatttcatccacagtcttatttcatataacacgatgtaagctgatgtcctcaaggttcatccatgttgtagtatatgacagtattcccttcctttttttttttttttttttgagacagagtcttgctctgtcacccagggtggaggctggagtacagtggcactatcttggctcactgcaacctccacctcctgggttcaagcgattcttctgcctcagcctcccaagtagctgggattacaggtgcccaccaccacgtctggctaatttttgtatttttagtagagacagggtttcaccatgttggccaggctggtctcaaactcctgacctcaggtaatccacctgctttggtctcccaaagtgctggggattacaggtgtgagccaccacattcagcccaatttccttcctttttaaggctgaataaatagtccattgtatggatagatcacattttacgtatccatttatccattgatggacttttgggttgtttctaccttttggctatcatgaatattgctgctgtgaacactggcgtacacatatctgtttgaagggctgggtgcggtggtgcacgcctgtaatcccagcaatgagtgtgaagtggcatctcattgtcaacactaagctctgggtcaagtggaaagtaaagaccttcccaggaggaaagcaggagggagaaagtgcagagaatatttaaaaatatccactctgattatttaagttaaaggcacttgaaaaacagcaggaacaagatgatcactctcacctttgtgctgtttcttaaaagcagaagatgatgaaattcctgagtgaaagacccccaacctgtactggaaggaaaggcaacatccttatcttcgagggcgggaagtcggcaccgagatgattctgtgcaggcccttgttaaagtaattctttttttttttgagacagggtcttgctctgtcacccaggctggagtacagtggtgcaatctcagctcactgcagcctctgtctccctggctcaagaaatcctcccatctcagcctcccaagtagctgagactacaggcctgcaccaccacacaaccggctaatttttgtatttttttgtagagatggggttttaccatatcacccaggcaagtctcgaactgctggactcaagggatccgccttcctcagcctcccaaagtgtttcgattacagttgtgagccaacgtgcccagccaaaatagctttttttttttttctttgagacagtctcactccgtcacccaggctggagtgcagtggcgcgaccttggctcactgcaacctctgcctcctgggctcaaacgattcttatgcctcagcctcccaagtagctgggactacaggtgcgtgccaccacacccagctaattttttgtattttagtagagacggggtttcatgttgcacagggtggtttcgaacacctgagctcaggcgatccgcccgccttggcctcccaaagtgctgggagtataggcgtgagccaccatgcctggcccaaaatagctgttatcttttaagcttctccacataattgagtggctttttcataatttactattctttgtccaatccagtatatcagtaactctaactgcttctttaggtcttcatttctccctctctctctcttctttttttttgagaatgagagcatcttgctctgtcctccaggctggaatgcagtgtcaagaacatggctcactgcagcctccaactcccagggctcaagcaatcttcccacctctgtcccctgagtagctgggaccacaggcttgtgccaccatacctaaataatttaatattttatatagatgaaggtctcactaagttgcccaggctggtcttgaacccctggcctcaagcactccttttgcctcagcctccccaagtactgggattacaggtgtgagcaaccacactctgccttcatttctttatggaggctcccatgccatgcacaacttttaataaataaatgtgtacgcttttctcctattctttttttttttttttttttgagacagagtctcactctcacccaggctagagtgcggtggcatgatctcagctcaccgcagcctccagctccagggttcaagagactttcctgcctcagcctcctgagtagctgggaccacaggcacccaccaccacactcggctaatttttgtatttttagtagagatggggtttcgccatgttgaccagcctggtctcgaactcctgacctcaattgatctgcccacctctgcctcccacagtgctgggattacaggcatgagccactgtgactgactggccctgttcatctatcttgtgtcaatttaattcttggatcctgccaggaccctaagaggatggaggtgagtcctgccatccctaaaacaggaaaatgaggtatccctgaatgcacagagacacaagacattcacaagcccagcaacgttttcaaataatttattaggaatttaaaactgaaaataaaacctggaaaaagaagttacagatgtggagagaagagacaccggaggatggtaacttgctggcttcgaaacaccatgtaacatcttaaaaaaaaaaaaaatcccaaagcaaatcagaaaacggaattccagggtcctgagcccatggttgggcccagtggggtggaagggtccgggaatgagggagagggaagctaagtgtctcaggactcagctcaaacgtgtagaaaattaaaaataaaaaccaataaaatgcagcttctcttttattaggaaacattaaaaaaaaaaaaaacccaaaacacgaacagccgcgcatctcagtaacaaagattattgctttgtgttctcagggctgataggttaagcacctcacacagacaattaactctccaaaggtggggtttccgggtgggggcaatgctggggaagagagctcaggccctgggcctcataactgggggagagggacacacagaagggggatggcagtgggtgggccttggccctgccacgccagccaggccactgttcatgaaggtccaacgctctgaacctctctttttccttagaaggggggtctggggtgaggggctgccaagggactctggctgtggggtcatcctggtgggaaacttcagtgagagaatgtgggggttccctgagacgccctttgctttcccctggggtctgccctcgccagagcgtcccctggtgcccactcattgcgggggtcgagggggaagggggacagactgagcagaaaccatgaagccccaacctaggtagggagcaggggagacctttggagagttaattcctgtccagcagtgtcgctgggcaagccctgctcttcccacgccctttgcccccacactgggtttttggagtgggcaggtccaaccaaggccttgaccctgagggcctgagagagcgggcctgccgtggccacagctgaggcctgcaagcttacagtaacggtgtctgaggggacagaaacaggggaggggggagcccctcacccccgaggggtcttagagaggggtgggcacatcacctcacagtatttacatatgatacaggacgggatggttccaggggctcggcctggcctccccgcagccctgccctcctctccagggctggagggaggcggccaggggcccacacccagatagacactttgttctcagctggtggggggcacctggccccttgccccctgcggcctggggcttcacattcacaaacctagaaatagtttaaaaaaggtttctttaaaaaaaaaaaaaaaaaaaaaaagggaaagggtaaaggaggggaaatctgaataaaaaacaggggttgggctgcggcctgtagcaggctccctccgccttcactccagctatgcacaaatccaaaagccttttggggagggggcggtcctaggggggcgcggcacggagggagggatggaccagagggctggggtgggcaaccggctaatccaaaataaataaaagcagggccgggagaggggcgggtggggatgggggcaagggcgaagagggggacgttagtaggggagccagacgctgttgggggcagcagggcaggggccgggcccggggagttgggggcaggcagtagcgggtccgagtcgctgcaggggagggggcggcggctgcggctgaggtctcccgccccctcgctggctcactcgtggtcctcagtcagctgcaggctggggcgctgggaacacagccaggaggttatgggggctcccggagcacacgcagccctccccagttctctcccagaagagctttgttcgtaaactacctactttcttcttcttatttttttagagacagagtccagctctgttgcccaggctggagtgcagtgacagcgatcatagttcactgcagcctcaacctccctaggctcaagtgatcctcctgcctcagcctcctgagactctgggattacaggtagtatctgggactacaggtgaaagcaaacacactctgctcatttttgttgttgtagcagagatggggattcactatattgcccaggctagtctcaaactcttgtcctcaagccatcctcctgccttggcctcccaaagatctgggattacgaatgtgagccaccacacccagccagactttgcactttctgttccctggttggatgcctctttccccagatttcgaatggctggatttatttaaatgtccccttctcagagataccttctctaaaccccacatctaaaatagccctgtcatgcacagtctggaattatctcatatgttcacttgatttttgtcctgtgaaatgagagaggactttgtctgtcttgttcatcctctttcctggaatggggctcataaatgaatgggtgaatgaacagaatgtcatgggctcacagtctcccaccatctggatagacactgtgatggccgtgtacacagtcccacaagtcgaggtatcctgttgttttttgtttgttgaggtggagtcttgctctgttgcccaggctggagtgcagtggcctgatctcggctcactgcagccttcgctttctgggttcaagcgattcttgtccctcagcctcccgagtagctgagattacaagtgcgcaccatcacgccagccaagttttgtatttttagtagagatggggttttaccatgttgtccaggctggtctagaactcctgacctcaggtgatccgcctgccttggccccgcaaagtgctgggattataggcgtgagccactgcgcccggccaaggtatcctgttttgatagctgtgtactataccactgtacacacactaatttgtttaaccactttccttttgatggatatttcagttatttgcagttttaaaaataaatgcctagaagtggaattgttgggtccaagggcatgaatgtttgaaactgggacaaacactgccagactgccccgggaacccctgagccactgtacttacttgcttctcccatatcttgatcaatgctgggcagtgttcaacttaaaaaatctttgtggctgggcccggtggctcatgcctgaaatcccagcactttgggaggccaaggcagaggaagatcgtttgagccaggagttcaagaccaacctgggccacataatgagaccccatctctacaaaaaaattttttaaaaacttagccaggcatggtggcatgctcttgtggtccccgctacttgggaggctgaggtggaggatggcttgagcctaggagttccaggctgcagcgagctgtgattgcacactgcactccagcctgggtggcagtgagaccacatctctattaaaaataataataatagggctgggcacggtggctcacccctgtaatcccagcactttgggaggccgaggcagatggatcacttgaggccaggagtttgagaccagcctggccaacatggcaaaactcgtctctgctaaaaacaaaaaaaataccaaaattagctgggtgcggtagcacatgcctgtaatcccagctactcgggaggctgagacacgagaattgcttgaacccaggggacgagtttgcagtgagccaagattgcgccactgcactccagcctgggtgacagagcgagactccatctacaaaaataaaataaaataatagtaataataataaacgatcttaaaaaatctttgtggcctgcgctggtggctcacacctgtaatcccagcactttgggggaccagggcaggaggatcccttgagcccaggagtttgagaccagcctgggcaacacagtgaaaccctgtctctacaaaaaaagtaaaaaaattagccaggcatggtggcaggtgcttgcagtcccagctactcgggaggagtctgaggtgggaggatcccttgagcccaggaggtgtgggtgacagaacgatatcttgtctcaaaaataataataataataatctttgccaacctgataggtgggatgtgaagccttactgttgctttgatttctgtgtttaaatggagtagggtgagcagcttttcatctttattgaccacagctggtataaagatctgtctcccctgggactgtggttcttgagggcagggatggggtctgtgtcccagattcgatggcccaggacaggcttccccagtgccaccccaccacctgcccacccccacatcctcacctcctgccaccgtcccctgcttcagtggtacccattggtgaaggctgtggcaatcaaagggccctgaaaaggaaagaatttgactcctagattcctgggaaatagaggaagatcaggggctccttctctctctgcaggacatctgaagtgaggcgctgacctctctctacctgtccggatcgcccccctactgcaggtctgcctacccggatcaccccccactgcaggtctgctcaaagattctccaacagagggccagggaatctgcacaaaccgtaccctggataaaaccagggcacccctggaatcaaacctccatgtgagcagagatgccatgtgtctcatttgcacctagagcccactatgcctggcattcagaggcgataactaagtgcccactgaatgaatgataacccccacaactcttccttagtgatctttctccattcatcctccctcaccctccttttgcccccagagacaaagaagttctctcccttccccaacttgggggtctctcaaggtgtggggggtgaggtgggggccgctaggcctggccactcaccccaagactgtggccgaagccggtgctgggggcagggctggcggcgctgatgtaactgctgacccccgagtcctggttggccgccccgtagagctcggccatggggccggggctggtggtccccaggaagccccctgtgcggctgggagtcgaacctggagggggagccatcgtccaggggtgagagcctggcaacccagaaagaagacggtgatagccctggtgccctctgccaccccacggcaccccctcaagcctgtcccacccaccctaacctggacccccacatttcagaaagtcctgtgggcccacctcctggagatctccccatgcccatccacccagtcacccctagccctgacccccatcatctcgtctgaccactcagcagcctcacctcctgagccccttcccaacctctccccacctagcagctgaatgcatgttctaaaccctgacccgcgtccctctgctacttgcaatttccactgtctccccaccacccgggctcctcctgcctccgttctccactccccacttccgcactttccccacccactggcctccaagcctttgcatatgctattccctcaaccagaaacacttttcctcctctttgcctttgaatgcaaagttaagaggcccttcctcttggaagccttccctcgcctttcctagaggccccagctgggagctcctctggtactggactccccctagtgcagcagcatcagccatcagcattattgcctttttaatacctgatgccaccaccaggctgcaagccctggaaggcagagaccctgtcagtcttttttttttttcttttgagacagacggagtctcactctgttgcccaggctggagtgcagtgacgtgatctcagctcactgcaacctccgcctcccgggttcaagcgattctcctgccttggcctcccgagtagctgggattacaggcgcgcaccaccacgcccagctaatttttgtatttttagtagagacggggtctcaccatgttggccaggctgctctggaactcctgacctcaggtgatctgcccaccttggcctcccaaagtgccaggattataggcaggagccaccgcgcccagccgaccctgtcagtcttgctgagggctggctcgcccatgctggcacgatgcccagcacagagcaggtaatcaggtgatacttgagtgaatgaacaagtgtccctctgcaaaggggtggcagtggccttctcccctcccctggacttctctgctccctgtgctccctcatctctcttcctgcacctcagaagagctcacctgtccctcgaaccacagccgctgccgccgctgccgccgccattggtccgtaggcagtgagaggaatggctgaaaggaaagggatgggcacatcagcatggcggtgaggggcagagatgggtgaaggaggcccctaccttttaggcagagcctgtccagcctggccctacctcagagggttccatgtagccccagggtcaaggcagaaaaggctaccttgggccacaccatctgtgtcctgacctgtggcatggatggaaaaaggtgggagagaggacagcttcccagtgagtagctgagcctcaatttctcccctggtctggggggacatgcttgaataacccaaagctcatggagggtggaggcagggcacccaaccctgagaagctgcgaaggttgcccgcagctgcccccttctccaggatgcccttggcaaaacagggatcacttggcccagaggtgcctgggagctcacgtccttcttcgcagcccacgacacctggcgatagacagacatgggacaggcccccaggcctgctgcccccaggtagagcgctctaggggtcaggctgaggctgggctcacaccgaggccatagcgttgcaccgcaccttctgctgcctgtcctgctcccctcgcccctgtctcctgagagcaccctaagggcctccctgaccacccagaaatgaccactgcctcccccaaatccccccagcctctttgtctgccatctcctcttcagacacaggcacctatccccttgtttgctgtctgccatcatcgccacctctgcagcacctagcaccttgccttgtacacggcaggtgcttaatacctgctgaaagagtagaaagggaatctgcttaaaacacccagtggcttgaatggcttgagcctggggctccctggggctgagagatgagcacctcctactgtgaatctttcctaaaaacttcatacagtgggctccttctcactcagatgccacctcctctaagaagctttccctgaatacccccactcaggcggccccttgtccccaaccataacgccttagcacatttccctgctttaatttcctcatggaacttctcaccctccaaaaatatctttttttttttaaattaatttttttgtaaagatagggtcttggaaaggctgggtgcggtggctcatgcctgtgatcccagcactttgggaggccgaggcgggcggatcacctgaagtcgggagttcaagtccagcctgaccaacatggagaaaccccgtctctactaaacaaaaaacaaaaaacaaaattagccaggtgtggtggtgcatgcctgtaatcccagctacatgggaggctgagacaggagaatcgcttgcacccaggaggtggaggttgcggtgagccaagaccgcgccattgcactccagcctgggcaacaagagcacaacttcatctcaaaaaaaataaataaataaaataaaataaaagatagggtcttggtatgttgcccaagctggtctcgaactcctgacttcaagctatcctcctgtgttggcctctcaaagtgttgggattacaggcatgagccacaacacccagcccaaaaatatcttatttgctttggggatactcaggtaagcctttcttgttttacttgattttttttttttttttttgagacagagtctagctctgttgcccagtctggagtgcagtggcatgatctcagctcactgcgacctctgcctcctggattcaagtgattctcctggctcagcctcctaagtagctgggactacaggtgtgcaccatcatgcctggctaattttttttgtatttttagtagagatggggtttcaccatgttggccaggctggtctcaaactcttgacctcaggtgatctgcctgcctcaggttcccaaagtgctgggattacaggcatgcaccaccacgcccagctaatttttgtatttttaatagagatggggtttcaacatgttggccaagctggtcttgaactcctgacttcaagtaatccacctgctgcagcctcccaaagtgctgggattacaggcatgagccaccacccccggcctgtttacttgtttactgctgtctccttcctctggaatttcagttccaggaagacaggaaccttgtctgtgtcactcactgttgtggccccagtgcctggagtggtgtctggtacaatgaatatttatcgaatgcatgaaaaaaccacccaagtctccttttctccaaggctagaggaaagttcagatcctaggtgcccaagcactgttgatcttgtacctactcccttgcctgccaagatatctctaaaagggacatttcttctgtcatttctttaaggccagggactgggctctgaggtctgttgtttggctcatttaggcatttccataaagtcagaggagccaaccccagcatgtgcttaccacactgtaaagaatgacttatttatataataagtatttgctcccctctctaaactgcgagttctgtgagatcagggcctgcctctgtcttatccccgctctgtccccagggtctgggagggcatcctgtgcacagtaggtccgtaacacatggtgctctgttgcccaggctggagtgcagtgatgcaatcatggctcaccgcagccttcacctcttgggctcaaacgatcctcccacctcagcctcccaagtagctgggactacaggcatgcaccaccaccacacctggctagttttttattttttttagtagagatggggtttcaccatgttgcccaggctagtcttgaacttctggcctcaagggatactcctgctttggcctctcagagtgctgggattataggcgtgaaccaccacgcccagcacacacagttcttaaatgagtaacaaggacctccttccagccctccaccctgacaactagtggccaaactctccctcttttcagggaagagcctctgttacctgcatctctagggttctcctccccaccccttccttcactccaggtttctcttcctctcccccattttgggggaaccctgagcaccccttggaaggaaggtcttatctaaagcagggtccatgctcacgtcttccacacatggccaggttgaggggagagtctgggggtggggtgggggagaagcagcttggacagagaaaccccctgcagcccaccccacgtgcttgcagtctcctcggctcaaggctggctccgcagctgagctggctggcccgagtgaaggtgccagccaggaaaccggccccctgtcaccttcaccccacttgtccagaagtcaccaaagggctggattcggcccttggcaatatttcatttggctcacagtgttttaaacatttagaatctgttgccaacattgaaaaataatggaaaaattcatacgaaagcaaaagccaggtttctggcatctctggaaaaacatgagatctgagcatagtgagtctgtgtcccctcccggcaagagtcagctggcaccgagggcaggtatgcccacgctggtgtgcagacgtccccacccagcccactttgcaatgagtttgagaccctggcttgttcactgcgggatcccagagcctccatggagcctggcacacgagaggtgctagataaatatttgccaaatggatgaatgagtgactttgcctccatctgcttggcttggccctatgccccacccttaagggccatgtagccgcccagactggccagtgcccaggcacagtctgctgtgtccccacagccggagggctggcgggcaggagaaaaggatcccgctagctttccccaggaaactccctgggccccttctgtttctccccatgtggcctgagaggtatacaaaatccgagcgactgacctgtaagctcggggaggactggggcgctcgggagaggggtccgctctacacggaattctaaaatgaaacgtaaaacagcttaggaagaagcaggggaggccccttggacatggcccagggaggacaaatgcacccacagggacactgggtgaggagacaggccatgcacaggacccaagagctggggagggggagagcacagttcccagaaggcaggggagggcaaggagacagacacagaggagagacagagagagggagcagagttgccacctataccctgggcacggggcagggctggagctacgattccaggtgttggcttgtttccttcttttctgtttcttttctttttctttctttctctctttttttttttttttgaaatggagtctcgctctgtcgcccggtctggagtgcagtggcgcgatctcggctcactgcaagctccgccttccgggttcacgccattctcctgcctcagcctcccaagaagctgagactacaggcgcccgccaccacgcccggataattttttgtatttttagtagagacggggtttcactgtattagccaggatggtctcgatctcctgacctcgtgatccgcccgtcttggcctcccaaagtgctgggattacaggcatgaaccaccgcgcctggccctttttatttaaaaaaaaaaaaaaaaaaaagacagggtctcactctgctgcccaggctggaatgcagtggcatgaacacagctcactacacactcgacctcctgggctcaagcgatcctcccacctcagcctcctcagtagctgggaccacaggcacacaacatcatgcctggctaacttgtagagacaaggcctcactatgttgcccaggctgatctcaaactcatgggctcaagccatcctcccatctcaggctcttaaagtgctgggattacaggcgtgagtcaccatgtccaggctcgggtgtctctaaaaggcttacaatttgactattaccaaaaacatctcccagaatcctcttcttcttgtgtgtgtgtgtgtgtgttgggggaaggcagcctgatgaaaagcgacggccctagaataggtagaataggtcaggcttgggttcaagtcccagctctgccacttcctagttggctcatcttagctttgtcattcttcctctgagcctatgtcctcatctctaaaatgaggataagcatccttcccccatgagattattgagagaattaggcaacgtcccgtacacaaagttctccaagctgaacagccctgaggcagaggatgtaagtgcttaggggccctccaaataaataagacccccaagtaaataaataaataaatggccttgcaaaagtttgtatttcttatttcaaagaaaactgcattgaatagtcatcatgggaagtccagaactgggcttcctgacatttactttcaggtctagtgttatctttatgttggcttacaaatgagcgtggtaatgataatgcttttcaactggttttcagcatttagggtctcagcataataccttgtctggacttgaaagagctcagcctagagcctggccattataggtgtctgtgatgatgcaaccaacaatggccctcggagaggcccccactacaagcccaatgccctctctggtggaagtggcaaccctggagtcgggtggggaggagagacaggcaggaggcaggcagaggatggcctgggagaaaacggtgccatgcagggccacgctgggagcccctgtccccagcttctggggaggggtttgggggggatgggtggggagaggccctctttcctcagacatgcccttccttccaagcctccagcaagcagacccccagccatgcacccctagacaccaccctgagaagtcagactgcccgggaaccaggggcatgctggcagcagagggatactgagcaggacttaccggggaactggtaggtgtagccaggggcgaggcctgtataactccggctggcgtaggttgtggcttggaaacctgggtaacctgatggggcaagggggcagtgtcagatggctcatccacagggcggatcctgatcatggagaaggacctgagccactcatgtcccctcaccttcctttatcatgaataatagctataccctccaaataccttcttcataccaagccctgtgccaagcacactgcacactattatcccgttaaactcgccttagaggtaggtactgttaggcaccccattttacagacaggaaactgaggctctgaaaggtgacactttttggctgagaataatccaatgctctttgagctctggctcctgcttccctcctgtcctcatctcctgcacactgctcctccctccctctgctccagccacattggcttccttgctgtttttcagctttgccaagctcattcccacctcagggcctttgcacatgctggtgcctttgcctggagcactctttccagatgactacatgcctgagtccctctcattgtacaagactccgaaacatcttcccataggtgtcctccttcccatcagctacaatttctatcatgtcaccttggcttttcttagtactgatgatcattatctgaacttatataatgatttttttttcttttttcttttttagagacaggatcttgctcttttgcccaggctggagtgcacagtggtacaattgtaggtcactgcagcctcaaacttctgggctcaagtgattctcctgcctcagcctccctagtagctgtgactacaaggtgtgtgctgctatgcctggctaatttttaatttttttgtagagatggggtcttgctgtattgcccaggctggtctcgaactactagcctcaagtgatcctcctgccttggtctggaattacaagcatgagccaccacacttggccagaaagtactcatgatttctttaagtgctgattttctgtcttctcaaagaaaaatccaatagttagcaataatggtgcaattaagattaaaattcagatctgacgggctccaagcctcttaaccaccgatctcactatttgttagataatttctttttccacttttttttttttgagatggagtttcactcttgttccccaggctggagtgcaatggcatgatctcggctcaccgccacctccgcctcccaggttcaagcaattctcctgcctaagcctcccgaggagctgggaataaaggcatgtgccactacccccagctaattttgtatttttagttgagacagggtttctccatgttggtcaggctggtctcgaactcccaacctcaggtgatccacccgcctcagcctcccaaagtgctgggattacaggcgtgagccaaggtgcctaacttctttttccacctcttaaatgaagggtgaaaacagctcatgaatcaccttagaataaaactttctcaatgttctaaataaaacaaagtgaaagagacaagacaactaactacaatacctgattctagcctggatcttattctgaaggacaaaaatattctataaagagcattactgggtctggctggccatggtggctcatgcctaccaccacaacactttgggaacctgaggtgagaagattgcttgaggccaggagttcgagaccagctgggcaacatagtgagaccccgtctctaccaaaaaaaaaaaaaaaaaaaaaaaaaagagcattattgggtcaattgataaaattggaaaatagaaagtagattagataaaaatattgtatcaaggccgggcgcggtggctcacgcctgtaatcccagcactttgggaggctgaggcgggcagatcacgaggtcaggagatcaagaccatcctggctaacacagtgaaaccccgtctctactaaaaatacaaaaaattagctgggcacggtggcgggcgcctgtagtcccagctactcgggagactgaggcaggagaatggcgtgaacccaggaggcggagcttccagtgagccaagatcccgccactgcagtccggcctgcgaaagagtgagactccgtctcaaaaaaaaaaaaaaaaagaaagaaaaaaatattgtatcaattataaacttaggaagttgataactaaactgtggttacatgaaagaatatccctaatcttaggaagcatcaaagggtaaagggccacgatgcatgtaactagccctcaaatgattcagtgaaaaatcacaagtctgtgtgtctatacatgtgtacatacatatttgcaaacacacatacacacacatatatacacatagagtaaaactgatcaaccaaaatgggggcaaaatgttaagaacaggtgaatctgataacagggtatatggatgttctttgtactgttttatttttgcagctcctctgagtttgggattacttccaaataacatgttaaagaaaaaagaaaagcttcaaggaagactgtgccctatttggaggctgctcgcctccccgacttctgaccctctagcccatgccgtgccccctcctctgaattcccagagtacctctctgtgtgccactcccccatgcctggcataaagacccccttgtactgttctctttctgtgtgtacacatctcatctccccagggagcctatgagcttcctggggggccaaactcagatttaccaccctcagtcttggacccaaagcacagctgactcctgctcagctttcaaggctcatggcagccttcacctcttccaggaagtctcctcaacctccaggtgggtttaggggcctcccacagcctccagtcactctgtagtggcagtgcccatttactcctgtctccaacttgaaggagagccccatgagagcaggctctccttctcagaagttgctcaataaatattacctgaatgaataagaccaggcagccttccttttgccccctccaaaggcctttggcctttgcaaatgctgttccctccgcctggaacacttttccccttcccgtctctccagcctccccatcactggctcctactccacccgcagactcaacttaaatgtaacttcttttcccacttctccaagtcacggtcaagttccctgtgaccacactccctcggcaccctacacttctgcatctgaaatctattttatcttcttacttgttttccctgccagattgtaaagaaagtcattgttgcagttcctggcataatgtctggcatatagagttgctcaataactgtgtactggatggatgaatggatagaggaatggacagatggagggatggatggacgagagaatggacagattgacaggaccaatgaatatggttggacctttctgctggctaccaccagagggcagcaccccccaaccaaaccaccccaccttgggtaggactgccagacccgacagatcccttgtccccactcctgctcaatgactcagacaggaggagggcagaccacaggggaggtgcaacacccacacagcccctgctagtcctgggagcagttctggcagaaagaagccgcaggcgcaggctcgcgcatacccagcatgccgatgcccagcatgaaggcgtccattccgtagggcatgactcgagacctcccccgggctgagcccgttggcgacatcacctcctttggctgagctttcttacattccacctgcaatgagacctggcggttagtctttcccacagagctagagtcattagccctcttgttccctggaaagcccctttattaattttattaatttcactgtccagctgaaaactatttcatggttaccactgatggagcactcactatgtgctggggagtgtgtaaacggctttgcatgcaatcgttcaatgaatgcttacaccaatactaccaatactatgatggaggagcttttccagtcccatttgacagatgtggaaactgaggctcagagaagggaggtcatctgcctgattaactaccgtgtgacactgcctccctgtctaggtttttaggggttggaagaactggctctgcctccactcactcgaagcccctctgcctgcctttagaacctcatagcttccctggcaggccccacaaggagccccagtcttctctgtgcctgcgctccatccaatcccaactcaccatgtttttgtttttgttttgttttgtttgagacggagtctcactcactctgttgcccaggctgaagtgcagtggcacaatctcagctcactgcaacctccacctcccgggttcaagcgattctcctgcctcagcctcccaagtagctgggattacaggcacgcaccaccatgcctggctaatttttgtatttttagtagagacagggtttcactgtgttggccaatctggtctcaaactcctgacctcatgtaatctgcccacctcaacctccccaaagtgcttggcttacaggcgtgagccactgcgcccggacccaactcaccattttgttgttgatttcatgaaaatgaatttcacacactttctccacgatgtcctcactctcaaacgtgacaaacccgaaccctagaggttggacaaaggataaaggcaaggtcagaaccagagcgcagggtcaaaactcaaccccaggtcgtaccaatatccccgctcctctctctctggcgagtgagagttaatgaaaggctctgctcacagcctggaatcctctcaactatccactgagacagggtttcaagtcccagaatacagatgaggaaaataaggttcaggtaagtgaagtaacttgcccaaggtcacacagcaagttagaaagtggtagagctgtgatgagaatacactcaacatgctttttctagtcctcaggtgttttccaaagagggaagaaggaacacacatgcacactcatttaaacttacacaaaggtgtacatgtccaaacatacaaatgtacatagacacacattcacgcatgcatacatctagatacctgcgtatcacgcagacacatgcagttaccctgacataccagatataaacagatatttaggcacagatacccccttttgcacagatacaaatacacacacacacagaacacataccccactcccaaaatggactaaaagtcctgaaacaactggagaaacaaccctgtctcctcctgggtgtgccccagggactggaaagggatttctcagaaggtaaggccctcgggagaaaaacagccaggtggcgcacacgcacacggtgtggcccagatgctcacaggttcagaggcaacggggctgggggctgggggctgggcaggaggtgactgcctggggctgtggagtcagcctgaccctgggcggcctggcctaagctctggttaccagggacaaggtaagcccgggcagaggcagacaccactagggtgggggtaggagactcagtgggttgcagggactgggggggtgggtactcctctgttcgtctcgtgtgtctgcaattcggcaagtttctagcacaggaaatggtgggacaaaagccttctgtaaggccaggcctgggagaggacgcagatcctgggggataggatgtcagaaggcgagatgaaagggcagctgtgacctgcagccccctggctgaccacggggcccagcctgggaagggggagggggccacactcacctcggtgccggttggtggttttgtcaaacatcagcatggcgtcgtccacctgaaacacagcccgccatggaggacccagcagataccagcggaacccactaccaccaaggaacaggggctctggcaacccactgccctcttgcccactccaggcttgaccttcaacctgctccctgcacaggggacaactttccttctgcaaccccactgaaaacccttttcaatcaccatcatctcaatgcaccagcctgcatttattaagctccattgtcctcccaacattccctgcatggtaagatccccatggtgtagataagaaagtaggctcagagaggtgaagttgcctgcccaagatcacacagcaagaccttgaccaaactggggaggcacagagaagatgctagagaaggaaatatgggagggaggaaaatgacaagatggggaagcaaaagcctcatccctttctgtaaaaggccaggaggacagcaaccagactggactcccctctccggctacagatcttttcctctaattgaggtttccttttgctagaggctgtaattaaagcaagtagagttcagtgcctgggctgctttgcctcccactgactgggggaagggaaggagactgggaaagggggaggatctacatcatccatcctctcttggaccccagtctactcttgttacttcctctaggtaccccttggatatacggtcaccaaaggccttggtgccaccttccatttgcctgcatctggtgcctcctccttgccctctttcttagttaaggtctgagtcacctttggtataaatcaggggctgcctctgatacccaacccaatcctactccaggccccaaccctcccccaaatgaccagacatccaaaggattaaaaaaaaacttttctcaagccatcaagccatgggtaaccagcctcttccctactctccttccctctacttccaggcccagcatccaccaccttctttttttttggagacagagtcttactctgtcacccaggctggagttctgtggcatgatctcggctaactgcagcccccgcctcccaggtttaaggaattctcctgcctcagcctcctgagtagctgggattacaggtgcatgccaccactcctggctaatttttgtattttagtagagatggggtttcaccatgttggccaggctggtctcgaactcctggcctcaagtgatccacccgcctcagcctcccaaagtgctgggattacaggcgtgagccaccaggcccgaccccatcatctaccttctaaaggccctcccctgcctcattaaacaccctgaactaccgtgatcctccagctctccttaggcatcaagctacagtgggcctctgactcccactgggagaaccaggaccccactgagccaggaggcaacaaggtccctggagaatctcatgacatctctcttctcaaagagctgcctgtactggggcccacgcaacagagtggcactctcactcccatcctatggacccactctgagtcccaatcccaaatcagctggaccacccgaatgggacaatcatttcaggttcagcacatcttgcccacccctcacttaaccaatgaaaaacagaaacccagaaagaaggattgtggtcatagcacaggctttgggtaggacgggcctgagctggaatcctggatcctgcatttgctggttgggtaaccttgggcaggtgacttgatgtttctctggctttggttcctcatctgtgaaataggcataacagtgtctatctcacaggttgaagttaaatgaaagacacctttttttttttttggaaaagggttctcgctatattgcccaggctagtcttgaactcccaggctcaagcaatcctcccatctcaccctccttggtagctgggactacaggtgtgcaccaccaagcctggctatgagaggatttagtgagatagtgcatgtaacactcttaactcacagacccaggatatagtaagtgcctaataaataatagctattattattatctttacaagggagggacttgcccatagttacacggggggaacgtggcaaagctggggagagagcagccagatactaatggcttgaaggttgcatgaggacatcgtctgtgtcatttagggccatgaccaccatcctattgagcaccttgactggaggtcaatcattttttgaatgaatgaatgaatgaatgaacgaaccagccacaccctcccccctaatcctacagctccgagtccctgcctgacccacaaatggattcagcccaaatccacaacttctcccaccttcctccacccaaccctgcaaggaaggccaccatccctggccccactacacccttcaacctgggccttggctggagaggcccctagtgggacggtggggttgaggccagggcagggggcaaggaagatggctgggggtccgggttagccccaccggtgtcccctcctggggcgagctgaggggagggaggctcccggcccagtgtccttaataggctttggtctccatgggaacccgagggcaggggggatcgggcggggggaggggaggcggccgaggcctgctgaccagtaggagccgagccgccaagttcggcggccgctaagcctgagtggcagccatggcggctgaccattgttcccccctcggcggcggcccctcgatccgggcggggggccccccgccgcggggcccttggcattcccggctgtccccctcgctccctggcagcctattctccggctccccctggcctccccgggccggtttcacatgccaacgccgatttaggcccgaacaaaagacgcggccgctgacggcttctcctggggcccggttgccatggcaacgccggccccgggggcaggcggcctccaatcacagctgctggatcagattagtgcgagctctaatgctcggcgctcagacacaaagacaccccgccgcagccgagccgggcctgctgcttcccaggagcgccctaccctctggggcccgggcccgcccgacctgccctctgtcccggacccaggtgcccaccgaggcacgaaagccgaggcctctggtcccccacaccaccagcctcagctggccaggggacacctcccccccccacacaatcccaggcccatttcccaggccacgtcccccttcgcttgcctgggggtgactcgaagtgtcttgatgggaaagtagagacccagcctctcgcctgtctcacctaaaagaagaaagaccagggaccccggccccaagcaaaacaaccctctttccctcctagacttcaaacgtaggaccctctctgccatctccccatgggactccaaagttcacattgtccacctttcagaggacaccctaatgtcggatgtcgccacaacatctacctcttcagaggcccagaaattaaagctccatgccccttacagctcacagccaatcctctgggcctgatcaggaattgggggatgctctcatcagttccccccaatacccaggggaccagcagccccccagctctggctccaagctccccacctgtgcaaatagggtgccgagtgcaattgggagtcatatttattgcctccttatcatcctcgcctggaaggagtggggaaaggttcaatagcctgtggcctggacaggtgcaaactcccaggaggccacgggctgacttgattgaactggctgtgggagcactgcctcccttgtgagaatgaagataagtaagagaaaaatacagtggaagggcaacaacagggccagctactgtgtggcttctctgtcccgagggatatcctgagtctgaagctcacagatgagccaggaggctgcaaggtggattggcctggtctgcccccacagcaggatccagccccactctcatcttttgcaggaatggaatgacctggctggattcggcttgctagtgccccattctacagtgtgttcacagccccagcagcaagcgcccccagtttaaacccaccttcccaaactgctcaaaatattgcttcacgtcctccaccgtggtgttcaccgacagcccccccacaaagatcttcttcgttcgagtcaccatctgttaggggagggaatgagaaagtgggcatctgagtcctgtggcctaccgccaccagcaggggctcgagcccccctgccaggatgccagctgacaagctctctgtggccccagcctctttaaaggccccccccccgcaagctccctcttggacccccgcctctaggcctgtcatgggcagctgtgcacccacaccctggctggctcgagtgtgcctccttcctgcctccctccctagggactatgtccagaaaatgccttccctaaggactaacacagggaagggggcgggccagtgacccagacccacagcctaacactaagacctcactggccctcctgggagaccccccaaggtccatcacagagtctccctgaactcagtgccgacattttcctcatcagcctcctcccaacacaacctctggcagccctgtggccccagccctgttttaggaagaacacatggtcctaattaccccaggagcgcatggctaatccgcggcaattcccagccccatcctaacactaaagcaccttctgtcaccaaactgcttaatggaattaacccagttccaaccatgtgctccctggtgcggcttccttcgaatacctgctccataattgctttcaggccctctactggacccttccagagatgcccctttcctgtctcccaaaactcttcctctccttcagccctggcaggagttgggggacttgatggaattcactggcccggaatcttaaagagctctagttccacctggcaaaggaggaaaccgaactctcctagagagggacctcgtcctaggacccatgataagtcagtaaactcaggggtcctgaccccatgttccgcaatcagtctctccttctgtcctctatattcaattgcttcaaaaggaagacctggctagttgccctgaggcctagaatagactcttaggcccctgccctgcaccaaaagttttttgagtgttgtatcactcaactgctcagaaatccattttctgcgcaccttgaccctctcactgggagaactcgccagagcagcagggtaagagagcattgagaaagcagccacagacatctaaactgaaagacaacaggtgacagagtctgtggtcccctctgcctctgcaaagggtgactggggggatccaagggtagctccctagcctgcctgtagcgcggccttagggtctaagtctgtcctgtatttcacttccagaggcctggacatcaaggctgtggtctatgatgttggaattagactcaggctccaaactctactgggttcaaatacaggacgatgaatcctctgagtagctcccctttctcccaacacacacaagcccctctccagtccaccccagagctcacgtggaaagacatatagtgtcttcaggccacagagcaaggacgtcaagaatcccctcttcccagcccagcccattccacaaacactccaagcagaggttccagaagcatcttccagagcaggaaatactgggaaaatcactgcccagcattgcccatagtaagagagctcctcccagacatagacacacctaccttgggctgtgctcgccgagggaaggccaccttagggtcaatctacaagaaaagggagaggtagaaggggtcttggttatcgcatttttagaagagcgaccacacagccttcagccctcaggacctctctcctcccaggacacaaaggtgacagaaatcacaaaagcctctaggaggagagaatagtggttaagcatttatttttattttttcttcagacagagtctcactctatcacccaggctggagtgcagtggcacgatctcagctcactgcaacctctgcctctcgggttcaagtgattctcctgcctcagcctccctagtagctgggattacaggtgcgcaccaccacacccagctaatttttgtatttttagtagagacggggtttcaccatgttggccagactggtttcaaactcctgacctcaggtgagccgcccgcctcagccttccaaagtcccgggattacaggcacgagtcaccacgcccagccagttaagcatttagaccctaacgtcccactgctgggttcaaatcccatttgcactgcttcccagctgtgagaccatggacaagttatttcccctctttgaacgtcagggtcaagttcacctgcaaaatgggcaaataataacacccacctcaaagggtcatcagcagattattggagataatgcatacaaagcatttggcatggtgtctagctcacagcaaaaacaaaaacaaaaaaaatgtaagccgtcttattccttcaagtatcaggtaaatcgagggccttccttgcgtaactgacttcacacagatgacctatctaggtaaggtatgcaattcaggctttggaaaccctgcaaatgggaatactctttgtctgcaaaaggctacaagctgagagttcataaccatcaggagtaggctcagttctgttttcgcagtactatcaacatcaaatagctctccttgaggctgtgagcaaacagctccttgataatgcagctaggcttggggcaaggcagagtgcagtcttcggtgacgtgaaagggcatgggacttgacctagaaactctgggcctcttgccaagcctgtgatcttggtaatgcactcgaactctgtgagcctcagttccttcatctgcaaagtggggacaatcacacccgcttttcccaggggcagctgcggggaatcagatgagataacgcgggtgaaagcggccctttgtgaactgcccttcattgcacaaacaaaggtgctattaccagcaggccacctttgcccttggctgtgaacaaccagagggaaaaatcaagatgcatctgggtgtactcctgggtactatagctgtacgacaaacagcaaaagacagggcatgagacgctgtgatccatgcagggcctacagggccaggtcaggccagagctttttgccacccacatgggtggacgtcattcataagttcaccagccaatcgcagggaagatctatcttttcccaaagttccttctgttcaaaactcagcctcgttctaggcagctggctctggcttctctctgaatggcacagaccaggaactagcctcctacaggctcccccactggaatctgtccacagagatggaacctccaaaatccacactggggcaatgcctcctctcctgccaagtcccactgggctccagggaaaaatcacaactgcccatttctcccgcctgaagtttcaattccacacctccacggacatgtccatccttctctttctcccagaagcagccgccccagccaccagcgcaccacacacagtccccctacacagaccccgatggggagatggtacccaagccacgatcccacagacccacgcacaccccatccctgacacaccccacctccactgtgactcacagctggcaacataaataaaacccaacaagtaaataaaaggtgaaagtcagagctcaaaatagactccccacagtaaacctccctcccaccccctttcccaggctggaggacgccaaacacagacaaagccctggcccttttcagccccatctcctaaggatgctcatctcaccctccttcctccctcattctcttcccctttatcaatcttccactcctccatcccccagcccctaaatctcagcttcctcagcactgcagaagccatcagtgcattctgaggacaggggatggtagcagaacaggcagcttgatggcagataatcaccaaaaacaataggccactgtctctccatttccaggcttgggtcactcaggctgcgccaagaagatcctttcagagccggcaaagttgaggcctggcctcatttgctcattactgcgagcgggagcgggagccactgggcagagataacaggagctggggacaggcggtaatttgacaaattcttgggcacaagcagctattgttgcaggtaaacgggagccagggactgacccaagcagagaggcccaaggctgggggacagcagggaagcatggagagaagagatccacactatccctgcccccagcagacagacacccccatcacatgggagtaaccccctcctctgacttttctacttttccatctgccctggagccagcgccccctgcagggtctaagacacgaaggagctgtgggacaacagcaaaatgttccatgagtttgaatgccaaccaagcagcttctcctaagatctagtcttccgaagggtcgtttccaggcaagctagagcctttctcataaatcccctccgtgggcaaagcaggtccctgtcttccacacaaagcaaggagctcattgaccaaaagtcgggggaggagggaaggagagagggagggggcttcaagggatgctttgccattggtctggatgaagagggggtgtcgcagagccaaatactagttagagttcacagaagccaccgggtgggtcagtgctaccctgactcacccaatttgggctgggggagggacctagccccaccccaagctctgctctgaggcatcatgattagtacttctagggagagggtggcggctgcctctcccctcaccaggactaggggaggggggatgtagcatctcatggcaggccagggatttttctcctccctctcccccccaactctagtgacaaagtttcagagcatggcagccctcttactcagaaaaactccctccttcctcatggaccccgtccagctgtcccctggggagagtcctgaccctctcctccggcagcctccctctcccaaaggacccccgaagccccgagggccactcactgttttggagtcgagctcgtgccgcgattgcgccagcactttatccacccccgcctggtccatgaaagtgacgaagccgaaacccctgcgcgccgtagtgagggagaggcagatggttacaaggcagtgagtggcgggtggaggggggcgagccgggagcaggaggagggggtgaggggctcacctggatctcttggtcagggggtcccgcatcaccagacactccttcacctccccgaactggccgaagtattcgcgcagcccttctgtaaccacacacccgccttcggaccagcccgggccccgcgcccttcccccccccccgtcctttgcccccggtgaccccggagcggcccggccgcccccgcgccaagctgcccgcgcgttctccactgccgccgccccccaccgccctcgccccgttcccgctgagcctcctggcgcccaccggggccccgggaagccgagggccgagctgggctggaagggggacggctccggccgggttcccgccgctccgggagcagcctcacaaaagtttgagccgcaggtgcgagcggagttggcgctgccgccggcgggtcccgggggcccagcccaccccccgataccccctgaacccctcatctgctcccctccacccgctgggccgggtgcgctcgcggatcgccctgcgctctcggggtctccgggcggggcgcgaaagagggcgcgagggcgcccggggtcagcagggcgcagggccgggctggggtgtccgggtccggggcgccggggggtccggggtgccctgccggaccggcgggcgctcccgggctcgctcaccctgcgtagtctgccaactgagtcccccgatgaacatcttgctgcgggaggaggagagacacaaagggcccgcgtgagcgccgggcgccagggcgcagggggcgcgggcccgggctccggggaggcccggccggacccggatcggccatgttggcggggccggggcgggcgcgggccaagcaggccgggccgggccgtaccaggggtcgtgcggcgagtccggggaggcgaggccgggctggggcgcgtcagtctccatcgggagccgcgggcggcgcgggcagcggagcggcggcggcggcggcggcggcggcgctcggcgcggggcagatgaggagcgcggcgaagggggccggacggacaggccatgctgccccctcccccgaccccgctcgggcgggcgggcggggacggccgaggggagggcccgccgggggccgacctgccggctcctccccccgccgccctgcgcgcataaagccccgcgctcgcccgcgagcccgggcgcccgcggaggcggcggcgccgggacccccttcccgcggggctcctgggtctccggggccgagcgagacccccgaatcccggtgcgggccgggaccagggcgcggccgcaccccccacccaccccggcgcgggggcccggccgcgggaacgccctcccggaatgaagcgcttcccggtgccttcaaggtagctcggttccggatcgggaacccccccggtcttccctctcaggtccctgctgtccagaattgaagagaaccccaatctcctcgggtcgggcgggagatagccctagtgctccccagtccccacatgctccatttccccagtcggagcgagaagccgccctcagagcccccagtttcctcccaacctaatttacagccccccacccccaccccagggctctaatttagagccctcgctccgttcccaggatcccatatccagtttgggggacccactcagtgcctcgcgtcccgagtggggaacctccatcagcaccccagtagaaaccgtatcctcttccccaatccgtcctcagcccttggtgtccaaagtgagagtcccccttagtttccccaaatccctgccgtccacattagtggaccctatggtctgttgagaaaatcccgcgccccaagcccgggttctcagtttgccgccacccccacctcccggtgtgaggagtctcccctggttctctccctccctggccggtttttgtgagatccattcagactcctgtcctgattcgggaaacccggttccagacactcaccacccccaccacaccgaggctggaggaaaaggcagtgcctcttagagcctcctgtttccagtttaggagcccaacgcctcagctgtgcaccgtcccctccgaatgacccccttcttttgcagaggtctaagctccaccccatcccattggaagagcctaaactacctacccactgcatttggaatgacttccctcagtccctcttattttgaggctactccccgtgaaggcaaacaccttcctttctacccccatcttctgggtctctgggatcccccagtacttgcacccaaggctccttggagtcaccttacgtacccctaaaattccctccctccagcctgggaacaaccctgagaaagtattctggttcaccaggggagctgcggggccactctccttatccccacctctccttatccccgcctctccatatccccacctctccatattcccacctctccatatccaagccttaggacccttcacttccccagctgaaaccagccaaaaaaggatcaaaccaggaagcttaggtggccaacaccccttctccccatccctgctgggggtctcagtgccacacaagcccctccctcccaactcaccttctactccttcccccatccctaccttaatccatccggtgtaatccagtgacaacccatgttgacaagccctttgctgttcaccttcacattccatcctgaattcaacaccttttattcctgggcatcataactctgacctctggaagggtgcccatccccctcttgatagccctccttccctctccccaccccaaccatcaggcagagaagaaagtgagagacttacagtaatggtttccttggggaccttctgggaatgctcagcaggtatatcctgccaccctgtgagcataacactagaaacaaacttgctttttcctgtttgtgtcccctactctgccccacagtttctcagcatcccctggactggggactggagggccacccacacaaggcatttcttaccattccgacacaaaagcattccagtttgtgttgtagcagagacacagatgagggtgagcaggtagcctctgcggtattagggaggtgactcttcttaggtctgaacttaaaaagggtcattggagaggtgcggggagtagggatcttccagtgttcctggactttggtttgtgtgctggtgctgctgggcagatgagcttgaaggataggaaatgggtcctttccggcagtggcgacctacccacgagaacatgcctctcgacagggatctccttcatccttctccagaagagaagaggaaacagaagaagaaacgcctggtgcagagtcccgattcctacttcatggatatgacatgcccaggatgctataaaatcaccatggtctgtagccatgcacaaacggtagttttgtgtgttgcctgctccactgttctctgccagcctacaggaggaaaaggaaggctacagaaggatgttccttcaggaggaagcagcacccaaagcactctgaatcaagatgagtgggaaaccatctcaataaacacattttggattaaaaaaaaaaaaggaaatgggtaaaggcatctgttcagagtcagccaatgctgtgtaagaagtagcttgagataggatccatgtattagcatattcattcagaatctgaggaggaagcgtctacctcttttggtcagtagcttgtttgtatcacagtaacatgggttagacttagacaaatcctctttcagtgcaggtgtatctcagctgcagcagcttcagtccactttgttcacaataggggcgacaagcccttctagaggtagccctcacaggacaatgcagttgtaaactcatgatcctcatagtaaattgaggatctcagtggtattaaggaaaaatgatctttagagcaacaggcccagacttcagaattaagagattagaggatgtggttccagctctttttctctggtactacacacacagaacatcactcaaagaataaaagaagaatttgctttatagtttttaaaaaatcctcttgagaaagacagtgggcaaatgatattatgcaacttggcacaggtatttaccgaacatcttctatgtactagacactgtcctaggtgttgtagtcccagcagctgcctttgtaaagcttgcattctagagatgagagtcatacaagtaaatgaatgaatgaatgagtcaatgaatgaatgagtgaatgaatgaataaacaatagataaataaatggtgtgttcagttagatgttgtaggtgccacagagaaggaagggtgatagggagggtgggtactattgggaagaaggtgagatgaaattttatatatatatatatttttgagatggagtcttgctctgtcacccaggctgcagtgcagtggcatgatctcggctcactgcaatctctgcctcttggattcaagtgattctcctgcctcagcctccccagtagctggggttacaggcatccaccatcactcctgactaattttttgtatttttagtagagatggggtttcgccgtgttggccaggctggtcttgaacgcctgacctcaggtgatctgcccacctctgcccttgaaagtgttgggattacaggcgtgagccaccacacctggcctgagatgcaattttaaatcaacaacattctcatggggagggagacgttttagcaaagacttgaaggagatgaggtaaatgagtctactctatgatacagaactctcatttaagcagaatgtctgcatctcttaagtacaatgataattaacgttcatattttgactttcactactctaaaactgtaggtcaagtggactaggggtggatgggggctcagaaaatggcagtttttgaacagacacctctatcagatgagaaggctgagagctgagggttttccttggccactcttggagaaacacagctttaagatatattgaagagcctttgagaatgacaacaacaaaattaaagattaaattatagtccatgtggttttagcgtgcagagtatttcacagtgttctcattctttgaaaatgcaatattggccgggcgcagtgattcacgcctgtaatcccagcactttgggaggccgaggtgggtagatcacgaggtcaggagttcgagaccacctggccaacatggtgaaacccggtctctactaaaaatacaaaaattagcctggcgtggtggcgcacgcctgtaatcccagctactggggagactgaggcaggagaattgcttgaactcaggagacggaggttgaagtgagctaagattgcaccactgcactccagcctgggtgacagaatgagactccgtctcagaaaaaaaaagaacaaaagaaaatgcaatatccaagcaaagccctgaattacctggaacttcccatttcttgtccatgcaagacaaggaaaaatttactgtaagctgattaagagccatgcatttataatcagcccattttacaaacttcccccacttaaaaaaatatatatatatacctatatatatatactttattttttctttctttttttgaggcagggtctcactctgttgcccaggctggagcgcggtggcacgatgagggttcactgtagcctcaacctcctgggctcaagcagtcttcccaatgcagcctcccaaatagctgggactacacatgcacgccaccatgcccagctaatttttgtttcgttttgttttgcagaacggggtctaactatgttgcccaggctggtctcaagctcctgcactcaagcaatcctctgccaccacggcctcccaaagtgctgggattacaaatataagccactatgcccagcctaaaaagtagactttatttttattgaggagaaagtacagagatttccccataccgcctgaccccacatgtgtgtaacctttcccactgtcaacatcccccaccagagtggtacatttgttacaattggtgaacctatactgacacattgttatcacccagagtccatagtttagagttcactcttggttttatacattctatgggtttgggcaaatgtataaggacatgtatctcccattatactgtcatacagagtagtttcactgtcctaaacattctctgtgctccacctatttgttctcccctcccccaacccctgacaacccctgatctttcactctccatagttttctcttttcaagaatgtcatataggccggacgcggtggctcacgcctgtaatcccagtactttgggaggccgaggcaggcggatcacgaggtcaggagatcgagcccatcctggctaacatgatgaaaccccgtctctactaaaaatacaaaaaattagctgggcatggtagcgggcgcttttagttccagctactcgggaggctgaggcaggagaatggcgtgaacccaggaggcagagcttgcagtgagccaagatcgccccgttgcgctccagcctgggcaacagagcaagacttcgtctcaaaaaaaaaagaacgtcgtatagcttgaatcatacagtagtagctgtttcagattggcttctttcacttagtaacacacagttaagattcctctatggtggctttttttgtgtgtgggttttatttttttgtttcctgggtttttttgctcgtttgtttcgtttgtttgtttgtttgtttgagacaaggtttcactctgtcgcccaggctagagtgcagtggcatgttcaggctcactgcagcctcaacctctcaggctcaagcaatcctcccacctcagcctccccaacagctgggactacagaatagctgggactacaggcacacaccaccgcccctggctaatttttgtattttttgtagagacagggttgcaccatgttgcccaggctggtctggaactcctagcttcaagtgatccacctgcctcagcctctcaaagtgctgggattacaggtgtgagccacctcgcctgaccccgtctatgtctttccatagcttgatagcttgtctgtttttagtgctgcataatagtctgtgctctagatgtaccacggtttatgcatcccttcacctcctgaaagacatcttggttgccttcaagttctggcaattatgattaaagctcaggtttttgtgtggacataggtcttcagtccctcacttttttgtcctaatttttctctctttttttttccttctctcagatttctggactcaaccagaaggctatgagctggagtaatgaaagcacttgactgagagtccaaagatccatatgctggtcttgggactaccactgtttctggtcgggtggttctagggatacaccacttagccttctgagcttccatttactttcggagttgctgcaagacttaagtgagatcatgtatttgaaagcaccttagacactctaaagcactatgggaaagtaaaggtagtccatcaaaagcactatgggggtgccgggtgtgctgactcacgcctgtaatcctagcattttgggaggctgaggtggacagatcacttgaggttaggagtttgagaccagcctggccaacatggcaaaaccccgtctctacgaaaaatacaaaaattgaccaggcgtggtggcacatgcctgtaatcccagctactggggaggctgaggtgggagaatcacttgaacccaggaggcagaggctgcagcgagccgagatcctgccactgcactcccgcctgggcaacagagtcagactctgagcaattattgtgtctcaggcactttgcgttgggaaactcattcaatccttgcaacagctctctgaggcaggtcgctattttacagatcaggaaatgaaagcattgagaggtcaacttgctaataaagataagacgggtggtaagtgagggggctgagatttgaattcaagtctgataccagaattcccatcatgcacttcatcatgaacataattttatgttatctacctatttaatgcacacacaatgcacctattattacagatggttctggaatgtctgttatgctggaatgggagctctctaagggaaagtcccttaaacctctttgcattctcctccaccaccccttatcctcaggaccataccttacactaagtactcaatagttggtttttgtttgtttgtttgtttgtttttgagacagggtctcactctgtcactcaggctggaatgcagtggcatgatctcggctcactgcaacctctgcctcctgggctcaaaggatcctcccacctcagccccccaaatagctgcgactacaggctcaagccaccacactcagctagtttttgtattttttatagagacagagttttgctatgttgcccaggctggtctcgaattcctgagctcaagtgatctgcctgcctcagcctccccaggtgctgggattacaggcatgagtcaccatgcccggcctcactagttgtgcttgcctagaaaccatcactgtgctagggctggaggatgagatggtgaatgagacagacagtgattcctactttcacagatgtgacaatctggagacacagtagttttacatacatcttttttgcctaggctggtcttgaactcctgagctcaagcgatattcccgcctcagcctcccagagtgctgggattacatgcatgcaccaccacgcctggctgatacacatctttttaaccaagtcatttgaatcactgcaataattaaatgtagtaggttctattaatgtgcttgccttacagatgacgaagctgaaactcaaacatctgaagtgacatgcccaaggtcatgcagctggccagtctaaaaatctagctctacctgacccaaacattatgctacactctgtctccattccccaccccccgactttccccactgccctggcagggagggaattaaataaactattctgcttgcccagctgagaacacccacagtctgtccagacctgctgactctcccactttctcactttctcactgtcgcttccaatgacagccagggctggtttgatgtgtcggtgaaaggggggatgcttcagagttctatggtttcagcatctgaagtcacctctctgctgtaattaactctgtgatttaatctgctcaactaatcattctacaattcaggggccaaagacaaagatgttaagaggatgcctcctttatgttttattgtttttaatgtttattttgggaaactgaaactgtggacctggagaagtgaaaccgcaggtctgtcagtgctgacggtgggaaaggggtgccaggctgcaggcaggggcttctcttacacttaggccagacctaaaggtgaagggctggctagaggggaggttctcatctctgagccccatctggagaacaaagcaccctccctagagcccaggttttcagggaccagggaaatagtttttggagtttgtgaacttagtggaaaaagtattagggagttaggagcctggggctccacctctgaccttgaaacaggctcttcccctctctgagcgctagtttattcatgtgcaaaatggaaagtggcatattattccagagatggaaaattggtttcagtttttctacttggcctctcaaattacctccaaaatgactggtagtggctagggctgggcaaggatagaaatcgggtgattgattagtgatgtctgccttggtgcaggtagtcatggaacagtagaaggtgtgctatagcgttgccttctctggactagatgatcactacatcctttccagttttggtcttctagagaccttacaacaagaagggcaaggattaagagctacgcagcacccccaggagtcagacaaccaagggaggaaccatcaaagtgacaattttattaataatgataatacatgattctatatgtggaggaaaagaatttacatcaaaccataagccatttgcatcaaaccattaatgtggtggggaggcgtgtgtgttagtatgagtatgaattttttctgtgagtatagatttatcttaacaaccagaaaacagtaaaaactgtttaacgtggtggggaggcgtgtgtgttagtatgagtatgaattttttctgtgagtatggatttatcttaacaaccagaaaacagtaaaaataatttaaatgagtctatttaaagactgttcaagaacactgatagcagcattattcataataagcagaaattggaagtaatccaaacgtccatcaacaggagaatggataaactatgatatattcgtacaatggaatactatgtaaaatgaaaagggccgggcgcccaacactttgggaggccaaggcgggtggatcacttgaggccaggagttcaggaccagccttgccaacatggtgaaaccccatctttactaaaaatacaaaaattagctgggtgtagtggcacaggcctgtaatcccagctacttgggaggctgagacaggagaatcacttgaacccgggaggtggaggttgcagtgtgccaagatcactccaagatcacgcaactgcactccagcctgggtgacagagattccatctcaaaaaaaaagaaaaaaaaaaaagaaaaagaaaaaaagaccatgcttggtggctcacgcttgtaatcccagcactttgggaggctgaggtggtcagattgcttgaggccaggagttcaagaccagcctggccaacatcgtgagactgtctctactaaaaatacaaaaattagccaggtgtggtggtgtgagcctgtggtcccagctactggggaggctgaggcaggagaattgcctgaatccaggaagcagagattggagtaagccaagatcgagatcgtgccactgcactccagcctgggcaacagaacaaaactccatctcaaaaaaaaaaaaaaaaaacacacaaatgacagatacatataacaatacaaatgaatttctttctttcttttttttttgaaacaaagtcttgctctgtcacccaggctggagtgcctcccaagttttatatataaatttttatatatagctaaaacccagattaagatacagatccataaaagtgaccactcaccacgtgtggctactgagcacttgagatgcagctggcccaaactaaccagtgctgtaagtgcaaaatatacattggatatcaaagaatgcagaaaatgaatgtaaaatacagtgataataattttacattgattacatgttgaaacgtaatttttgaatatattattaaaataaatttcacctgtttcattttatgtctttttatttttatttatttatttatttatttttatttttttgagatggagtcttactctttcacccaggctggagtgcagtggcgcaatcttggctcattgcaacctccacctccttcgttcaaatgattcttctgcctcagcctcccgagtagctgcgattacaagcacccaccaccacacccagctaatttttgtatttttagtagagacatggtttcaccctgttggccaggctggtctccaactcctgacctcaggtgatccacttgcctcggcctcccaaagtgctgggattacaggagtgagccaccgcgcccggcctttatgtctttttaatgtggttcctagaaaatttttaaattacatatatggtttacagctgtagctggcttttttttttttttttgagacggagtcttgctctgttgcccaagctggagtgcagtggcacgatcttgtctcactgcaagctccgcctcctgggttcatgccattctcctgcctcagcctcccaagtagctgggaccacaggcgcccgccaccacgcccggccaattttttgcatttttagtagagatggggtttcacagtgttagtcaggatggtctcaatctcctgacctcgtgatccgcctgccttggcctcccaaagtgctgggattacaggcgtgagtgtagctggcattttatttctattgggcagcactgatattgaagctttccttcctccagaaagttatctcctgcttccaagtcaatatctgcttcccaaagataaatgcgactatgacctgtcttcccatagattagttttgcctgttccataatttcatataaatggaatttttgtatgtatttttttgcatctggcttcttttgctcatacagtttgttgttgttgttgttgttgttttgaaacaaggtctcactttgtcacacaggctggagtgcagtggcatgatctcggctcacagcagccttgacctcaagcaagttcaagcgatcctcctgcctcagcctcctgagtagctgggactacaggcatgcaccaccatccccggctaatttttgtatttttcatagagatggggttttgccatgttgtccaggctggtctcaaactcctaggctcaagtgatctgccctccaccacctcctaaagtgctaggattacaggcatgagtcactgtgcccggcctcaacctacaatttttgaaattcatccaagccgagcatagtggctgacacctctaatcccagcactttgtgaggccaaggtgggaggatcacttgaggccaggagttcaagaccagcctgggcaacataacaaaaccccacctctacaaaaatataagaaaattagccagatatgttggtatgagcctgtagtcccagctacttgagaggctaaggcaggaggatctctttagcccgggagtttgaggaaacagtgaaccatgattgtgccactgcattccagcctgggtgacagaacaagaccctgtcaaaaaagaaaaaaagaagtgagagtgagagtgatactttacaaaaaaaaaaaaacagaaaaaattaaaaggggaataggatgagcgagtggagatagagtaacaaaggtaaagaaggattgagctacatctggccgggtgcggtggctcacacctgtaatcccagcactttgggaggccaaggcaggtggatcactagctcaggagatcgagaccatcctggctaacacagtgaaaccccgtctctactaaaaatacaaaaaattagcatggtggcgggcgcttgtagttccagctactcagaaggctgaggcaggagaatggcgtgaacccgggaggcggagcttgcagtgagccgagatcgcgccactgcactccagcctgggcaacagagtgagactgtatctcaaaaataaaataaaacaaaataagaaaggattgagctacatccgtgaatctatttccaccagcagagaaattcaccacggctcagcgtccccaagactgggtgagaaaatcacaaaagatcaaatttggcagaagctaatcaagagtttactttttggtctcagcatcatatcccaattttttagtgtgtcacatgtaacatgtaactaataacaacaaagtagatattgacaactttactgagcccttaccatgtacagcatggtgctaagagctttcctgtctgatcgcatttaatcccctctacagtcttctaaagttagttctatgatgatcctcccatgttgtagatggggaaactgaggctcagcaaacttacccaaggatactacactcagaaatggcaaagaggggattcaaaggcaagtgtctctggtttctggtctggtatttttaaccactacctctactgaagcttgagaatgctttctttgccttaaataaataaatgaagaagaaaaagaaataaacaaatgaggagaagtggagtcaaggttatgtctataaataacgtcactcttgctccctggcctttggacaagctctccagagggagagaggaagagctggggttacgcagaattcagactatcttatctgaacaccatggaagcatgagtcacgtgggaatgccattcatcaggagtgtcccaattttaaaaaggttgagaaaggctgccttggagagcctctgatgcccccctcttgctttatggataaacttagagatccaaagaaagaattatttttcccaaggtcacacagctagtactcagcggctacatctttgcctcttctcttctcagtgaatgaatcaaatgtgccttttccaccgtgtcaggtactctggaggtatccacacctgaataaggcttgctgacagttcttgaggcatttacgctccagtaaagggacaaattatatcccaaagcaaagtatgagagccttaagagagctttggaagctcaagggagggagggagtacagtgggttggagaggaaagggaaggctggcatctaagctgggtcggaaaagcagaaacagagaagtgggcactcctcaaaggagagccagtgggtacttgtgttggctgaactgtgtatttaccaccggcccaactattgcctctagtgtccaccatgatgttgagtcaacattaaattattggttaactgatgcagaatagaactcattcagggtggtttcgggggcagaaaaaaaattaaattaaaaaactcatttggccaggctaggtggctcacgcctgcaatctcagcacttcgggaggccaaggtgggcggatcacctgaggtcaggagttcgagaccagcctggctaacctcatctctactagaaatacaaaattactgggcatggtggcacatgcctgtaatcccagctgctcagctgctcgggaggctgagccacaagaatcagttgaaactgggaggcagaggttgcagtgagctgagattgcaccaccgcactccagcctgggcgacagagtgaaataccatctaaaaaaaaaaaaaaaaaaaaaaaaaaaaaaactcattcatcagaaatgcagagataaaattagctgagagtggtgtgcatgtccctgtaatcctagctagacaggagcccaagataggaggaccacttgaggtcaggagttcaagacagagcagcctaagcaaaagactgagaaccccacctctactaaaaataaaagattagcagagtatggtggctcatgccttgagtatggtggctcccagccacttgggaggctgaagtgggaggatcccttgagtccagaaggtagaggctgtagtgagttatgattgctccactgcataaatacagacaatgtgtatttgtgtgtgtatattgtaatgtctgtgtatcccgaggtcatatgcttctcaaaagaaaggactgttagccaggcaccgttacaaacacctaggcaacataacaagactctcacctctaaaaataaataaataaataaataaataaataaataaataaataaataataaggactgctttcttcttgttccccattatggctggcacatagcaggcattctttacatcttggctgaatgaacaaataggtaaattgtggggaagacacattggcccctttaagccttaagaaataataaccagctgggcgtggtggctcacgcctgtaatcccaacactttgggaggctgaggcgggcagatcacgaggtcaggagttcgagaccagcctggccaatatggtgaaatcctgtctctactaaaaatacaaaaattagccgggcgaggtggcatgcgcctgtaatcccagctactcgggaggctgagtcaggagaattgcttgaacctgggaggtggaggttgcagtgagccaagatcgagccattgtactccagttctgggcgacagagcaagattctgtcatgggaaaaaaaaaaattagcctggcatgggggcggatgcttgtaatctcagctgttcaggaggctgaagcaggaggattgcttgaacctgggaggcagaggttgcagtgagcagagattgcaccattgcactccagcctgagggacaagagtgaaactccgtctcaaaaaaaaaaaaaaaaaaaaaggctaagtgtaaggctcacacctataaacccaacactctggaaggccgaggtgggaggattgcttaaggccaggagttcgagaccagcctgagcaacaaagggagactctgtctctacaaaaatttaaaaattagccaggcatggtggcacttgcctgtaggcccagctacccggaaacctgaggtgggaggatcgcttgggcccgggagatcaagggtgcggtgagctatgatcgtgccactgcattccagcctggataccagaagaataccctgtctaaaaaaaaaaaaaaggctgttaagactttgctttttaatatagctatatggcttttattttgagacggtgtctcactttgttgcctaggctggagtgcagtggtgtgatcttggctcactgcaacctccaccttccaggttcaagcgattctcctgtctcagcctcccaagtatctgggattgtaggcccctgctagcacatctggctaatttttgtatttttagtacagacgggatttcatcatgttggccaggctggtctcgaactactaacctcaggtgatccacctgcctcagcctcccaaagtgctgcaattataggtgtgagccaccacacgcggccaaatacagcttaatatagtgacacacaactaggaaatagatggaaccaggattcaaacacccgtccttctgatgtgaaattttgtgactcagaagagggaagtcagacccaacctggagagcccactcccatgcctgcctgcagctgtcccagctgtgcctttagagggtgggctgacctcactctgtcatcagcagcaccagcaagcaccagaggggtgagtgtctctgggagcactcaaaatcatccaccaagaaaagatcaggccttctatagtatttttttctatttcatctcttttccccgctcttttttttttttttttttttttaagacagggtgtgcctctgttgcccaggctggagtgcagcagtgatgtaatcataactcaccgaagccttgaactcctgggttcaagccttcctcccactttagcctcctgagtagctaggacaacaggtgcgtgccactatatctggctaatttcttattttatttatttatttagacagaatctcactttgtcgcctaggctagagtgcagtggcccaatcttagctcactgcaatgcaatctctttttcccaggctcaagtgattcttttgcctcagcctactgagtatctgggattatatgcatgtgccaccacgcccagctttttttttttttttttttttgagatggagtctcactctgtggcccaggttggagggcagtggtgcaatctcggctcactgcaacctctgcctcctgggttcaagagattctcctgccccagcctcccaagtagctgggattacaggcacacgccaccatgcccagctaatttttgtatttttagtagagatggggttttgccatgttggccaggctggtctcgaatccctgacctcaggtgattcgcctgcctcagcatcccaaagtgcttggattgcaggtgcgtgccactgctcccggcctaatttttgtatttttaggagagactgggcttcaccgtattggccaggctgggcttgaactcctcgcctccagtgatccacccacctcagcctcccaaagtactgggattacaggcatgagacactgtgcccagcctatttcatctttttaaaatttcttttgcatagatgtttgtaacatagatattataacagtagagtatgtatatattttgtaaatatataaatgtatgtatgctagaaatatgagctcaaagattgtttcctcttagggatgtatcatcacaaaaatttggagatcatttcttaagacagcaaagacaaagattaaaaacaattattataggatatttacatgtgaaagaataaagttggacctggcaccatgtaaaaacaaaatgaactcaaaatggataaaagaaacacaggggtaaatctttatgaccttaaatttggcaattcttagttatgtcaccaaatgcacaaacaacacaagaaaacaatagatatattggacttcatttaaatttaaaacttttggctgggtgcagtggctcatgcctgtaatcccagcattttgtgaggctaagcaggagggttgcttaaactcaggagtttgagaccagcctgggcaacatagtaagacctcgtctctacataaaataacaaaatttagctgggtggtggcacgagcctggagtcctaggtacttggaaggctaaggctggaggatggcttgaactcaggagttcgaggctgtagtgagctatgattgtgccactgcactccagcatgggtgacagagcgagaccctgtctcaaaataaataaatgaatagataaataaaaataaaaacttgggcatcaaaaggcactatcaagaaagtgaggccaggtgtggtggctcacgcctataatcccaacattttgggacgccaaggcaggcgaatcacttgaggtcaggagttcgagaccagcctggccaacatggtaaaaccccatctctattaaaaatacaaaaaattagcttagagtggtggtgggcgcctgtagtcccagctactcgggaggctgaggtgggagaatcgctggaacctgggaagtggaggttgctgtgagctaagattgtgccactgcactccagtctgggcaacagagcgagactgtctcaaaaaaaaaaaaaaaaaaagtgaaaagggctgggtgcagtggctgacacctgtaacacctgtaatctcagcactttgggaggctgaggtgggcggatcacttgaggtcaggagtttgagaacagcctggccaacatggtgaaaccctatctctacaaaaaaaaaaaaaaatacaaaaattagccaggcatggtggcgtgtgcctgtagtcccagctacttgggaggctgaggcaggaggacttgagcccagggaggtcgaggctacagtgagctgtgatcaagccactatactccagcctgggcaataaagtgcgactctttctcaaaaaataaattaataaataagtacaaataggcaaaggacttgaatagatatttcttcaaagaaaatacataaatagccaataagctcgtgaaaagatattcatcttgagccattagtgaaatgcaaggcaaagccacaatgagatatcattccacacctactaccacagctatgaataaataaataaatggaaaatgacaagtgttggcaagaatgtggagaaattggagctttctgtacgttgctggtgtgagcgtaaaatggtgtggcactgtggaaaaccgttcgatggtatctcaaaaagtaaaacagaattatcatatgacccagatcctaggcatatacccaaaataattaaaaacaggtattcagacaaaaacatgcatgatcatagcagcaccattcacgactgccaaaagattgaaacaacccaaatgtccatcaagtgatgaatgggtaaacaagatgtagtatacccatgcaagggaatactatttagccgttaaaaggaatgaaataggacacatgctacaacatggataaacctgagggacatcatcctaaatgaaaaaaaccaggctgagctcaggggtgcattttgccggccttaatcccagcactttgggaggccaagccagatagatcgcttgaatccagtagtttgagatcagcctggacaacatggagaaaccctatctctatcaaaaatacaaaaaaattagttgggtgtggtggcggacacctgtggtctcagctacttgggaggctgaggcaggaggatcgcttgagcccgggaggtggaggttgcagtgagctgagatcgcgccactgcactccaacctgggtgacagagtgagagctcatctaaaaaaaaaaaaaaaaaagaaggaaaagaaaaaagccagatgaaaaaggtcacatactgattccatttctatgaaatgctataattccatttctatgaaatatctaaaataggtaaatctgtagagacagaaagcaggttagtgattgccaggggcggggggaataaggaaggagaagtaattgcttactggatatgatgttagaagtttgcctttagggtgatgaaaacgttgtaaatatactaaatgcaactgaaatgcaagctttaaaatagttaacttcaataaaacaaaaataattatcataaaataaatacatgatcatagtaagaaaatatcttttttcaaacagcacagaatggtactaagtgacttctctccatgctctatttccactcttcaaaggaaataaaggatactacaatttatgatgttttttccccaaatttattccatacagatagaaatgtgcgatatgtgtatacatgtttgtgtgtagatatttccttttcctcttatgcaaatgagatcatattccattcaatgtactgcctttttctcttggcaatgtgtcaattaccattccatatcaatacagttttcttaatggcttcgtaatatgggcttcccatactccctgtctcttcatcttcagacctgagggccccactgtttccctccaagttctgagtcccaacgccatcctgcctcggacttgtcagtgactttgacctcaatcgttgctccttcacgtggcattgtcaggagtctctaatatccagcaggtgcctggccccatgggctttataaaaatggcagctcccttcttctgcaccctgtgctatgctagggccagctgggggtaccatagaataatgcccgagggtgtagactccctgtcttaccagccgtatgacctcaggcaagtgccctaacctctctgagcctcagtttcctccgttgcattgaggctattcacagtcccgtacaatgatgctcacacagcgctgagcccagggcccagctcggagccagtcggcatcacgtgatctttcgggaagaaaaggtgggcagagccctgggtcggtggccacctgcttttgggtagggcactaatacagggtgctgaagcgggaaggtgaggccgagctgggcggccctgggaacccgggaaggaggcgaggctggagtggaaacgattagaatgagagcaaactggctcctgaatagaagcttttattcctgccggagagggctttgttccacaaacacgtgacacacaaaagcctctacttgaattcgggaaccctaattggttctcaggtgggggaggagaggggtgtccggatttagggattccttaaagggacaatactgtggggagctgagcccagggttcctccccattgtcagtgggagggggtggcgtggaggggaggggatggggtagaggggaggggaagagctggaccagtgggggtggggcggctgttagaagaggagggggaggggagaggaagggagaagggaagagggagagaagcacagagagactcagaggcctgcagccccctgggccagtgcttgagaaacagtaggcatggacggagggaaagaaggaaggacggagggaaggaaggaagagaggaaggaggggaggaaggaaggaggggagggaaggaaggaaggtaggaagggagagaggaaggagggagggagggaaggagaggaggaaggaagggagagaggaaggagggagggagggaaggagaggaggaaggaaggaagagagggaggaggggaggaaggaaggagagaaagaaggaaggaaggtaggaaggcagggaaaaaggggaggaaggggggaaggaagaaaggaaggagagagagaaaagaaggaagggaggaacggagggagggaagggaggaagaaaaagaggaaggaaagaaggaaggaaggaaggagcctggcgcggtggctcacacctgtaatcccagcactttgggaggctgaggtgggcagatcacttgaggtcaggagttcgagaccagcctggccaacatggtgaaaccccgtctctactaaaaacacaaaaattagccagatgtggtggtaggtgcttgtaatcccagctacttaggagactgaggcaggagaattgcttgaacccgggaggcagaggttagagtgagctgagatggtgccagaacaagactctgtctcttttttttttttttttttttttttgaggcggagtctcgctctgtcgcccaggctggagtgcagtggcatgatcttggctcactgcaactgctgcctcccaggttcaagtgattctcctgcttcagtctcccaagtaggtgggattacaggcacccaccaccacacccagctaatttttgtatttttactagagacagggtttcaccatgttggccaggttggtctcaaactctcctgacctcatctcaggtgatccacttgcctcggcctccccaagtactgggagtacaggcgtgagccactatgcctggctgagactctgtctcaaaaaaaaaaaaaaaaaaaaaggacagaggaaggagagaaggaaagggagggaagagggaagaaggagggaaggaaggaaaggagaggggggaggaaggaacaagagaaggaaggaaggagggaaggaaagtaggaagagagagagagattgagggaggaagtaagaaaaaaaggatgggagggaaggagaaggaaaggaaggaagggaagaaaaaagagaaggaaggcaggaagggagggagggaagaaaggaaggaggaggaggaagggaaggaaggaagggagggagagaagaaggaaaggaagagggaggaagggaaggaaggagttcttaggatgtcccttaaggcccttcctccctctccagcctggcccatcccactctcactctccctcccagtgctccagccacactggctgcctttcagttcctgagataccccaaactaagtcctacctcaggacctttgcacctgctctcccgcctacctggaatgcttcccacttacctgcccccctcttcccatggcaatcctgcagttcaagtatcacctatacagaagaagtcttcctagacccccaggcctctagcctatcaccctgttttactgtcctcaagcccttaacactcacagacattgatggaaaatggcgattgtgctcagctctatcccctgccctcagcacaatgcttaacacacagcagaagatcaaaagatacctgagactatctggctggctgagtggaaagggagcagtggctgcaataatgcccatcctttcctggctccagagccattgttcttagggttagctgagctcaagcctccctttgaaactttctagccgtgtggccttgggcaagtcactttgtctctgacttcattttcctttttaaaaaattattattatatttatttatttatttattttgagacagagtctcattcactctgtggcccagtctcattcactctgagtgcagtgggcttcccaggttcaagagattctcctgcctcagcctcccaactagctgggattacaggcgtgtgtcatcacacctaactaatttttttttttttgagatggcatttcgctattgttgccccagctagagggcaatggtgtgatcttggctcacggcaacctctgcctcctgggttccagtgatgctcctgcctcagcctcctgagcagctgggattacaggcatgcaccaccacgcttggctaatttttttttttgtatgtttagtagagatggggtttctccatgttggtcaggctggtctcgaactccttacctcaggtgatctgcctgcctcagcctcccaaagtgctgggattacaggcaggtgtgagtcactgcgcccggccttttttttttttaaacagagtctcgctctgtcgccaggctggagtgcagtggcacgatcttggctcactgcaacttctgacttcccggttcaagcgattctcctgcctcagcctcccgagtagctaggattacaggcatgtgccaccacgcccagctaatttttgtatttttagtagagacggggtttcaccatgttgaccaggatggtctcgatctcctgaccttgtgatcggcccgcctcggcctcccaaagttctggggttacaggtgtgagccactgtgcctggctctaattttttaatatttttagtagagatggggtttcaccatgttggccaggctggtcttgaactcctgacctcaagagatcagcttgccttgccctcccaaagttctgtgattacagtcatgagccaccaaatctggcctaaaaatcattattttttattttaaaaaattttgtttgtagagatgatgtctcaccatgttgcccaggctgatcttgcactcctgggcttaagccatcctcccacctcagcctcccaaagtgttggtattagagccgcaagccaccacgctcagccttaacattttgaatatataattttgttgaagaaacagggtcttgctacattgctcaggctgatctcaaactcctggcctcaagtgatcctcctgcctaggtcttccaaagtgctaggattattggccaggcgcagtgactcacacctgtaatcccagcactttgggaggccgaggtgggcagatgacctgaggtcaggagttcaagaccagtctggccaacgtggcgaaaccccatctctacaaaattacaaaaattagctgggcgtggtggcaggtgcctgtaatcccagctacttgggaggctgagataggagaatcacttgaacccgggaggcagaggttgcagtgagccgagattgtgccactgcactccagcctgggcgacagaacaagactctgcctcaaacaaacaaacaaacaaacaaacaaaaaagtgctgggattataggcatgagccactgcaccaccgggccccttttctttaaaaagcacagaactggcagggagcggtggctcaccccgtaatcccagcactttgggaagccgaggcgggtggatcacgaggtcaggagatcaagaccatcctggctaacacagtgaaatgctgtctctactaaaaaaatacaaaaaattagctgtgtgtgatggcaggtgcctgtagtcccagctacttgggaggctgaggcaggagaatggcatgaacccgggaggtggagcttgcagtgagccgagatcgcaccgctgcactccagcctgggcgacagagtgagactccatctcaaaaaaaaaaaaagaaagcacagaacttacctcacaagggcattgacaggatggcagagagaacaagcactgagcgggtgcatgatggggacctggggaacattagccacgcgggtagaaaggcagtgggtatttctacagaagaggaaggactcccattccctgagccccaactctgtggcagacgctctcatatgatattttaagaaatacctgtaaacaacttttgaagcaggttttgatcatccccatttacagaagagaaaacagcctcagagaggttaagagacttcctctggatcacacagctagtaagcagcagagccaggattcgaacccagctctaccctctatctcatcccaaagactatgttctgcctactctgatccaagtgccctcttggacttccagtgcaaggaggctgtgggaaggggaaggaagggcttaggaccctgagggacctgcaaggctggggctgcccctgtaccctccattagcattcagcctgggccctcattatatgagtaggtagagtcctgagttctggactatgggctccatgcttcagtgagttatcttattttatttattttcgtgacaagtttttgctctgtcacccagggtggaatgcggtggcaggatcgcagcttactgaagcctcagcctcccaggctcaagcgatcttcccacctcaacctcccaagtagctgggaccacaggcacgcaccaccacacctggataatttattttattttatttttatgttttgagacagagtcttgctctgttgcccgggatggaatgcggtggggcaatcttggctcactgcaacctccacctcccgagttcaagcgattctcatgcctcagcctcctgagttgctgggattacaggcgtgtgccaccacgcccagctcatttttgtattgttagtagagacaaggttttgccatgttggccaggctggtctgaaactcaagtgatcctcctgccttggcctcccaaagtgctaggattacaggcatgagccactgcgcctggcccagttacttattttagaagttatatttgagcacctattctgtgccgagccctggcatgagctgtgaacaggccatatctatcctagatgtgcactaatggggctttggagggtggcaacaggaggcccggtgaaatccccggtgagagcagccttttcgccgtggcctgccgtgaagcactatggcagcacccacacctgccaggactgaaggtattgtcgggccctctcctgctcccagctgcagccaaggccgtgtgtacagggccctttaagtagtctgtgccctccctaattaaccagctaaagaaagagctggcttgaaatgggattgtgcagacccagctttgggacccgaggacgccggatcggggattgttatgctaatcgcctgagatcagcagttcccgtgcccttcagatggcaggtagcgaggccgggctctgcccagcggctgtggctacaggaggccaggcttttcctccagcttccggcttcctctgttcccctccttaccccgtcagacttgccctgcctgtcctcccacctgcccgttggctggaaggcttggcgtctcctagaaatgtccaggccagctcctcccaccctccaaagagaaacctgcttgccttcaagctgggcgctaattggggatgcagaggcaggaaggagaaggtacccagctcctcctcctgtataacccattctcatctccaggcatgagagcctcattggtccctcctgcccccttgggctctggaaaacacactaggtggtgcctttgccgcttactaactataccattttgggcaagtgactgcctctcagagcctcagtttcctaatctgtaaaataggttgataataacagtagctacctcaaagggttgaaatgagaatagaatgagaacaggcatctaacatagccagttcaattgctactgcccatccagcactggataatagctccctgtgtagagcacccactatgtgtcagccctatgctgtatcctttttttttttttttttgagacggggtctcactatgttgcccaggctgatcttgaactcctgggctcaagcaactctcctgtgtgccaccatggctggcccttttataaggtgttaccccattttgccttgcctgcccgcctgcctgcctgccttccttcctttcttccttcctccttctttcctttctttcttttttgagacagtctcactttcttgcccaggctggagtgcagtggcaccatctcggctcactgcaacctctgctgcccgggttcaagcaattctcctgcctcagcctcccaagtagctgggattaaggtgcctgccaccgtgcctggctaatttttgtggtttgagcagagacagggttttgtcatcttggccaggctagtcttgaactcctgacctcatgatccacccacctcagcctccaaaagtgctgggattacaggtgtgagccaccgtgcccggcccattttgccttttcaaccactctgtgagataattaacattatcaccccccattgcacagatgaagaaaccgaggcccagagggactgacgcacttgctcgagacctaccccaagccagtctgttctcttaacgtctattctgcagtttgatatgtgaccattcacagtgagcttggtcaatacaaagatgttcccagaaacatgtgtcatcgttatatatttaatgtgcaggagaaaaaaaattaaagtagcattttaagcctgtgagttcacaaatagtattgcttaggttaaatatatttaagttcatacagtgaccagtgcaagtatggtcatagcggctttattcataatagcaaaaactggaaacaatcaagacacccatcaacaagaaaatagaggaacaaaccgtggaacagccatataatggaatactcagccagcagcgaaagggaacaaacaactggtcaatctacaatggggacaaatgtcacagactttttttgtttgtttgttttgttttttgtttttttgaaatgaaatctcactctgtagcccaggctggagtgcagtggtgcaattttggctcactgcaacctccgcctcccggattcaagtgattctcctatctcagcctcccaagtagctgggattacagtcacctgccaccatgcccagctaatttttgcatttttgtagagatggggtttcgctgtgttggccagctggtctcgaactcctgacctcaggtgatactgatccacccacctgggcctctcaaagtgctgggattacaggcgtgagccaccatgcccatcctcacaaacataatactgagcgaaagaagctagacttgagtgtacacattatactatacgattccactgatacgaagttcaagaatagctaaagcaaatctatggctgccaatggggaggtggatactgctcaactgctcagggacgccagggaaccttctggggtgatgggaatattctatatctttttttttttttttttgagatggagtctcgctctgtcgcccaggccagagtgcagtggcaccacttcggttcactgcaacctccgcttctcgggttcaagtaattctcctgcctcagcctcctgagtagctggaattacaggcgtgcaccaccacccctggctaatttttgtatttttagtagagaggggatttcaccttgttggccaggctggtctcgaactcctgacttcaagtgattcgcccacctcggcctcccaaagtgctgagattacaggcgtcagccaccactgctggccgggaatattctatatcttgatgtgggtgcggtcacatgagtgttcttgtaggcaaaaatgcatcaacaggtacatttcatatttgttcaagttaatgtatttgcactatgcatcaataaatcacggttaataggttaagggagttttttgttttgttttgtagagatgggatctcactttgttgctcaagctgatcttgaactcctggcttcaagtgatcctccccccctcagcctcccaaagtgctgggattacaggcttgagccacggagctcggccaggttaagatttttaaaaaataaatttatttaaagaaaaattctatctaaatagcagttcggggtgtgcagatatggccaaaaaataaaaataaaaaacaaaaagcaagcaaacaaacaaaacttcaaccactgaagttgggggtaatataagtgctaggcaatgcagatgtattcagcttccccttcaaagggtgccagacaaaatacaggacgcctagttaagttgaaatttcagataatcaaccaatactttttgagtgtaagtatgtcccatgcaatatttgggacatacttatactttgttttttgtctgcttttgttatttatcagaaattcacatttaactggaagtcctgtatttttatttgctaaatctggccaccctgccctcctgggatcccaccccgtctcgcagcccggtgcccaccgcaggcgggtacaccctgcgcggtgcagtcactccgggcgcagcctggcaacgcggccacaaagggagcccgggaggcggaatctttccacatgcctgatcaatgggggcgcggagacggcggcgcaaacaggcctgagacagccgcacaaagaggaggcccctcggtcgctcccgccttccattgatcctggtcctttgtggctcggacaacgggggcgcgggaggcgccttgcggggacttggccgtttctcattagagggagaaggcctgtgagcacccccgtcccgccagccctccccaccgttcctcctcccgtgggctccaggcctcaggtctggggctgtccaaacctatcaggggaactgggcagggcacagggtggggtcggaccaggctaggaaggtctggagcctgcctgtgggggccagccacccagcccccgcctcctgaggaccccccagtctcctctggcgggccctctctgtccccttggttacaggcaggttttgcacagtctctgtttttttatttattgagcaaatatttattgagcgtttgttccaagctgttcccactccctcctgcccccatggccacttaaactagccaattcctcctccaagcatcacctctctgggaaagcacctctcagtcctctctcacctcaggttgggtagtgaaaccccactacacatacacacaccccgtgtgcctctccccacctccctgctcttcattcatgataaaaatgactaacaattatgaagtacttactatgcctgccatgctaaacattttattgctgtctcctttaattctcataacacccctctagattggagctactatgatctccattttccagaggtggaaactgaggtttggcatgctaaaatggtcacccaaagtcatacagcaagcggtagagtggagatttgaatgcaggtgatgaattgcagtttgagatcttcacatcccaagttccagactctatgcaggattcattgctgtggcccagtaatgaactgtttactccatcagcacatttacccactgtactgtgtctatttggccttttccgtctgtgttccccactagactgattggtctgtgaccgcagcacccagcacagagaaggtgcccagggtatatttgctaatctgaactattgggtttaagaattttggttgggcgcgatggctcacgcctgtcatcccaacactttgggaggccaaggcgggcagatcacctgaggtcaggagttcaagaccagcctggccaacatggtgaaaccccgtctttactaaaaatacaaaaattagccagatgtggtggcagtcgcctgtaatcccagctacttgggaggctgaggcaagagaatctcttgaacccgggaggcagaggttgcagtgagccaacattgtgctgccacactccaacctgggcaacatagtcagagtccatctcaaaaaaaaaaaacaaaaaaaagaattttgctaggccctcaggctgggaagtgaggggaggacctaaagatgaatctattacagtctctgcccacaaatgagcttgaaatcagacactcaaataatataggaagggttgcagagctctggagtctggtataccttccccacccccttgaaaagatcagcttcattgaggtataatttacatgcaggaaaatacacccattttaagtgtccagttcgatgaacattgacaaatgcatacacccatgtaactagtatcaatgtcagatgtaaaacatttccatcttctcaaataggttcctcaggctctttgcagtgaatgccccgcccaccctgtcccacgcaacccctgatctgctttctgtcactataagttagtttgcattttctagagtttcatataaatgaaatcatacaatgtgtactcgtttgcatctggcttttttcgctcaccatgctaatgtggtgattcatccatactgtggagtgacctttcagttctaaatcctctctctgcttgtgacctctttgagtttcaccctcttcatctgtaagacaggggtggattctgtgaaatttcgttaagagaatgtctgccaagtgcacaggacctgcacacagttggcatgcaataaacgctcttgattagtataaccttcctgctagactgtaagctccatgaggacagggaccttggtcattttgttcaccactctccactaactgcagtggctaccgtttattacagacagtgaataggagctcggagacctacagcaaacctgtccaagatcacacaactagtaagaggcagagctgggatttgaacccaggcaaactagtgctggagtccttactttttaaatttttttgaaacagggtctcactgtgtcgcccagactggagagcagcagcacgatcttggctcactgcagcctccacctcccaggctcaagtgatcctcccacctcagcctcccaagtagttgggactacatgtacccaccaccacgcccagctaatttttgtactttttgtagagacagggtctcactatgttgcccaggctggtcttgaactcctgaactcaagcaatccactcccctcagcttcccaaagtgctggattataggcgtgagccaccacaccacacctggcctcttttttattttatttatttattttttttggacagagtcacgctctgttgcccatcttggctcactgaaactttcacctcctgggttcaagcaattctcatgcctcactttcccaagtagctgggactacaggcaccctccaccatgcctggctaatttttgtagttttagtagagacagggtttcaccatgttgcccaggctggtcttgaactcctgaactcaagcgatctgcccacctcagcctcccaaagtgctgggattacggtcatgagccaccgcagctgacctcttttattattattattacggtattatgtatggggtcctcatcttaatcactatactaaactacctcacaatcattgttctctctaacaatctccccaaatcttctcttcttgtcaccttcaccctttactgaccactctatggagggagcataatataaaaaaaaaaactctacaactactaatatatatttttagtttatgtgtgaggcagtattctaagcacttgacatttatttacttgtgtaactcctcaataatgctgtaaggtagcattattgggcatctccccattttacagatgaatgagtaaattgtagtgtaactgagaggctgtggtgttggagtcaagaaatcttccttttttaaaaaagtgacacatgggccgggcgcggtggctcatgcctgcaatcccagcactttgggaggccaaggcaggcggatcacgaggtcaggagattgagaccatcctggctaacatggtgaaaccccgtctctactaaaaatacaaaacatcagccgggcgtgatggcgggcgcctgtagtcccagctactggggaggctgaggcaggagaatggcgtgaacccggggggcggagcttgcagtgagctgagatggcgccactgcactcaggactgggcgacagagcgatactccatctcaaaaaaaaaaaaagttatacataataatggtacatattttgggggcacatgtggtattttgatacatacatgcaatgtgtgatgatcaaatcaggataactgggacatccatcaacccaaatattcaccccttcttcatgttgggaaacatctccgttcctctcctccagcaaatttttttttttttttttttttttttgagacggaatctcattctgtggcccaggccagagtgcagtggcgtgatctcggcttacggcaacctccgcctcccaggttcatgtgattctcctgcctcagcctcccaagtagctgggattacaggcacccgctacaacatccagctaatttttgtatttttttagtagagacgggttctttcgccatgttggacaggctggtctcgaactcctgacctcaggtgatctgcctgcctcggcctcccaaagtgttgggattacaggcgtgagccaccgctcccagccaagcaattttgaactctatgacaaattattaactctagtctccctactgtatggtagaacgctagatcttattctttctcaatgtattttcgaaggacagcttccttttgaagcccggctttgtcatgctttccacgggactcgagcaaatctcctcccctgacagcttgtgtattcctcttgccaggacgtccccagagccccttctttgacctgacatttttttctgggcgcttctctctgacccctcggcagggttttctcttcctcttctaagtttctttccccagtcccttcctgggccttagcaggccaaggttacaatttcaaaaggagttgagtttcttctggaaaggagctgggaccgaacccctcccctccatggtctcttcccataaatgccccctgtgtgcagcgcccaggggccccggggagcctggccggctgatctgtaattagaaacttttctgccttcacgacaggaggagggagggcccaggtctggcccagtcattttgttcgtcatgaattattcaggagatgggaagtggcgtgaagccggcccctctgctgaccaaagccatgcccaaggcagcccgacctactcagctctgcctctttcaccgtttcagatccagagaataaacaaaccatgtgccaggcacgtttatggagggcgttttcatcagactcgatgagggagcatgttcttcagctgagaggggtgacagggacttatccaaggtcacaagcctaggaagaggacggctgagctgggagtcaaacccaggaacatgatgcgaggttccgtgctcatttggtgctattacagatgctgggcagaggaggaggggaggagaccccaccaggccggctaggagaagataaaagatgctttcctttctccgcttgccttgctcttgctaagtctgggggatggagaagggggataatatggaaaggagacaactaacctcatggagaccagctgggtgacaagcaagaattattattgttattgttactattacagacaggatcttgctctgttgcccgggctggcgtgatctcggctcaatgcagccttgacttccctggctcaagagatcctcccatctcggcctcctgagtacctgggactacaggtgcacgccaccacacccagctaatttttcatattttttgtagagatgaggtctttctatgttgcccaggttgatcttgaactcctgagctcaagcgatcctcctgcctcagcctcccgaagtgctgggattacaggcatgagccaccgcacccagccaagcaggtattattttgcctgcagtatttaatagaatcctcgctaacctctgaggaaggtgttattatgcccattttatggatgtagaaacaaagatcttgtttgtttttttgagatggagtttcgctcttgttgcccaggctggagtgcaatggcgcaatcttggctcactgcaacctccacctcctgggttcaagcgattctcttgcctcagcctcccaagtagctgggattacaggcaagcaccaccacacctggctaatttttgtatttctagtagagacgaggttttgccatgttggccaggctggtctcaaactcctgacctcaggtgatccgcccactttggcctcccaaagtgctgggattacaggcgtgagccaccgtgcctggccacagagatcttaaaggagtttattcaagacacataacagctggttagcggcaggttaggggctcaatcttggcacttctctgtgcgttgcactctttctcctccactcctgtgggtagggaagcagggctaccgaggaatctcagctcctgagtccacaatggtccttggatcagacttgccttgttgtcacacctctcagtgtccaggcactgctccaggataaaccctcatgagtgtgtggatgatatctgccatcccacattggttaaccttgcaaggtggtcctttagaaggctcagggcttcctcattggcacggagctggcaattctgagagatagatcagctctaactgtagttcctggagaaactaaagcacagaatttggaaaggatgccctggctccactccttactctctgtataaacttgggccaattccttaacctctctgtcaatttgcccattgatgaagtgagatgaagataagaaataaacatggccaggcgtggtggccatgcctgtaatcccagcactttaggaagccgaggtgggcagttgcctcagcttaggagttggagaccagcctgggcaacatggtgaagccccagctctagtaaaaatacaagaaaattactcctgatgacagcttctcattaaatttggttaacagagaggcagcaactaccagatggtgaacatgtgtcttctggaaacagccccccagttttccctggggaactctccctctcccaatatcagttcctgtatcttggatggaacttactctgcccacctgtgcctccagggttggccctgggatccagcctggccacaggattggttgaagaacaggcatatgacccaatgggagccaatcagtgggagacttgagatttttgctggagagaggcactgttttttaaccaacaggaaaaagcatgggtggagctcctgagagccttcttgtcaccctggggaggagcgtgtctgtctgagattgaaaccacagaagaaagcagagtcaagacatggcaaggacatgaattggaatctttgaactccttgatccagttgtaaatcagtaaataataataattattatgattctttgctttgtttgcatcagtgagttttctgtcatttacaactaggaatgctgaggaaacttgccaacaatgtgccaatgtgtgtgctctctctctctctctctgtctatatatatgtacatatatatatatatatatatattttttttttttttttgagacggagtcttgctctgttgcccaggccacagttcagtggccgatctcagctcactgaaacctccatctcctgggttcaagcaattctcccgtccagcctcctgagtagctgagactacagggcacagcatcacgcccagctaatttttgtatttctagtagagatggggtttcaccatattggtcaggctggtctcgaacacctgacctcaggtgatctacctgcctcagcctcccggagtgctgggattataggattacaggcgtgtgctatatatgggccagacgcggtggctcacgtctgtaatcccagcactttgggaggctgagatgggtggatcatgaggtcagtagttcgagaccagcctggccaatatggtgaaaccctgactctactaaaaatacaaaaattagctaggtgcggtggcgtgagcctgtagtcccagctactcaggaggctgaggcaagagaatcgcttgaacccggaaggtggaggttgcagtgagccaagatcacgccaccgcactccagcctgagtgacatagtgagactccgtatctacgaaacaaaacaaacaatatatgtatatttgttttgttttgttttgtagagacagggtctcgctatgttgcccaggctgatcttcaacacctgacctcaagcgatcctcccacctcggcctcccaaagtacagatgtgagccactgtgcccagccacacatctttctctctctccatatatatatatggtggtgcacacctgtaatttcagcactttgggaggctgagggaggaggatcacttgagcccaggagtttgaggccagcttgggcaacatagtgagagcccatctctatttattgaaaataaaacaagaaataaaacaaaatggggccaggtgtggtggctcatgtctgttatatatatatacacacacacacacacacacacatatatatagtgtatatatatgtatatgtgtatatagagtataaatatatatactctatatacatatatacatatatacacatatacgtatatatagataaatatatatacatatatatttataatatatatgtatatagaggatatatactatagatcctctatatacatatatacacacacatatatagtgtgtgtgtatatctatctttgattaaaataacagtatatgctgaagagtcacttctaattattacttttgttttacaaacttaggtcaagagagaatgtggagtaaggccttaagattcataacaacgcctaggtgcaaatgaagggcctttactcactggacttatgctgtcatggagtcatagacttagagtcatggattggctttaactatggttttcctttctgctttcaggaaaacatttaatttccaccctgggcgtagtctatgcccagcttccttgtggtgcgctgtttctgtctgccttttgtctgtgtgctggtggtgtcagagccagtaactatctgtttacagtttcagacagtagcattaattgccttttgaacctcccattttcctccaagaactccctgcctaactgtctcaactgtctccctggagtttcttttctgtgtggaaatgtctattttttttcccataaaatctgaccacctgcaaatccctacatattctcttgtgagtaggcaacatgagagaaagacatgtaggtggcagataatctgcgcaaatcagagcttacaggatgaagcttctaggccaaacaacaaggcagctgttgggtggcagaaagagccctggaattggaggcagaccagcaagtgaaatctggttttgttacttacttgctctgtgacctgggacaagttactgcatactgctgagcctcagtctcctcatccataaaatgggcacagactgggtgcagtggtgcacacctgtaattccagcactttgggaggctgaggcaggaggatcacttgagcccaggactttgagactagcctgggcaacatagcgagatcccatctctatttctttaaaacaaaacaaaaaataaaataaaatggggccaagcgtggtggcttatgcctgtaatcccagcactttgggaggctgaggtgggtggattgcctgaggtcaggagttcgagaccagtgaaactccgtctctactaaacatacaaacatgtctacaacatggtgaatctccgtctctactaaaaatacaaaaattaactgggcatggtggcacacacctgtaatcccagctacttgggaggctgaggcaggagactcgcttgaacctgggaggcgtaggttgcagtgaggcaagatcatgccattgcactccagcctgggcgacaagagtgaaactctgtctcaaaaaaaagaaaagaaaataatacctgtttcacaaggttggataatttacccgtatgacaaaggcactgtcttctggaaaagcacatttctctgccctttacttgtctagtatgggttcaaaatagtaataaaactaacatttattgaacactgagtttgagctcagcattatttcagccttacgacaaatccttcagggggccagccactgtggctcacacctgtaatcccaatactttgggaggccgaggtggcaggatcacttgagcccaggggctcgagaccagcctaggcaacatagggagaccctgtctctattaaaaaaataaataaaataaaaaataaaaataaatttaaaataccaaacccttcaaagttgttgctattataatactcccacttcacagggatggaagtagaggatccgagagtaagttgctgaaatcacacagctaagtggcaaagctgggatttgaacccaacagtttcactttacagcttactcttaaccaggaccatatggcctccactgtggtagtagatatcagccacccacagtggaggccagatagggctaaaagctgtgggtgctgcctcctggggaaaaccacattgttctccgacttccctggcccatatgccaactctacttcataaagagctgattttttttttttttgagatggaatctcgctctgtcacccagactggagtgcaatggcgtgatcttggcctactgcaacctctgtctgctgggttcaagcaattctcctgcctcagcctcctgagtaactgggatcacaggtgtgccaccatgcccggctaattttttgtaattttagtagagacggggtttcaccatgctggcaatgctggtctccaaatcctgaccttgtgatccgcctgcctcagcctcccaaagtgctgggattacaggcgtgagccaccgcgccctgcaagagctaatgttttattttgttattttttatagagacaaggtcttgctctgtcaccccggctagagtgtagtggtgtgatcatagctcactgcagcctcaaacttttgggcttaagtgatcctcctgcctcagcctctcaaagtgctgggattacaagtgtaagccattgtgcctggccagcttgatgaggtttttttgtttgtttgagacagaatctggctctgttgcccatactagagtgcaatggcatgatgtcagctcactgcaacctccgcctccggggttcaagcaattctcctgcctcagcctcccaagtagctgggaccacaggcgtgtgccaccatgcccagctaatttttgtatttttagtagagacggagttttgccttgttggccaggttggtcccgaactcctgaccttaagtgatccacccacctcggcctcccaaagtgctgggattaagggtgtgagccaccgcctcccacccagcttgatgttttaagagtccagaccctaactactcttgggagacatggtgggaataaggaagtggcagctgggctttggaatccaaaccctggcccctcctggacactcatgcctcctgtgtaccaaggggaaggtggagaaaccaaggagataggtcctgtgggagcctggacaggggaatccatgggcacatacatctctacgtgcttgggcaccatgatgtcagcagagcactggttaacacatgcatgcacccacgccgtcagactcacggtgaacacgtgagtacacatgtgcatatctgtggctccacaagtacgcatatccctcactcacacactcacaggtccgcccaccctgcactgaattcctggattttgtcagaaccccattagggccgggcgcggtggctcacgcctggtaatcccagcactttgggaggccaaggcaggcagatcacttgaggtcaggagtttgagaccagcctggccaacatggtgaaaccccatctctactaaaaatacaaaaattagccgggtgtggtggtgcacacctgtaatcccagctactcaagaggctgaggcaggagaattgcttgaactcaggagctggaggttgcagtgagccgagatcgcaccactgcattccagcctgggcaacagagtgagactctgtctcaaaaaataaaaaaaaatttaaaaaaaagaaaagaaaagaaaaaagaacctcattaggcagaatagcagaatagctaggtcaagtgtacaactctgctcttgcctgttgggtttgaatcctggttctgccaaataccagccaagtctttgggcaaatcctctcatctttctgtgcctctacttacccatctgcaaatgggagtaataataatatctgttcctttgagttgttgggagtttaaagaattgtagggtgtcgccgggcacggtgtctcatgcctgtaatcccagcactttgggaggccgaggcgggtggatcacgaggtcaggagatcgagaccatcctggctaacatggtgaaacccctgtctctactaaaaatataaaaattagctgggcatggtggtgtgtgcctatagtcccagctacttgggaggctgaggcaagagaattgcttgaacccgggaggaagaggttgtggtgagccaagatcatgccactgcactccagcctgggtgacagagcaagactttgtctcaaaaaaaaaaaaaaaaaaaaaaaaaggtcctggtgcggtggctgacgcccgtaatcccagcactttgagaggccaaggtgggtggatcatgagatcaggagttcaagaccagcctacccaatatagtgaaactccgtctctactaaaaacacaaaacttagttgggcatggtggcgtgtgcctgtagtcccagctgctccagaggctgaggtaagagaatcacttgaacccaggaggcagaggttgcagtgagctaagactgcaccactgcactccagcctgggcaacagggcaaaactctgtctcaaaaaaaaatttgtaaaatattaaaaatgtataaatatatatatagagaaaactagaaggaaataaattaaaatgttaatatggttgccttgaataatatgggggattatattttatttaatcaacactatttctttaagaaactgtgtttatttaatggacattttttgtttttttggtttttttttgagatggagtcttgctctgttgccaaactggagtgcagtggcgagatctctgctcactgcaacctccgcctccaaagttcaagcgattctcctgcctcagcctcctgagtagctgggactacaggtgcgcctcaccatgcccagctaatttttatatttttagtagagacagggtttcaccatgttggattacaggtgtgagcctccgtgcccggcctgtattttctttaataaatatatattagaattatatatagcaaaaccacatttcttttgttttgttttgtttttgagacagagtcttgctctgtcacccaggctgatatgcagtggcatgatctctgctcactgcaacctctgccttccgggttcaaacaattctcctgcctcagcctcccaagcagctgggatgacaggcgcctgccaccacccccggctaatttttgtatttttagtagagatagagtttcaccatgttggccaggcttgtcctgaactcctgaccttaggtgatccacccacctcagcctcccaatgtgtagggattacaggcatgagccactgcatccagccctaaaccacatttctattagctagtttttaaaaattacaaatgtaacatgtgctcacattaaaagaaaaaaatgcgtcagtacacaaaggtataagatgaaaaagtaaaagttctttaccccttagactccttccctaaatgtaactgttaccaatttcatgtatatccttccaaaaatgttccatgcctatatacttagatatgattattatattttaaaaaatagatataggctacttgggaggctgagatgggaggatcacttgagcccaagaggtcgaggctgcagtgaggtataatcacgccattgcactctagtctgggcaacagagtgagaccgtctcaaacaaaacaaaacaaaaatagatatagaatcacacaatccaaatgattttggaacttgcttagttatttactatagtacagatttttggatatctttgcatgtatgatatactcttttttttttttttttgagacggagtctcactgtcacccaggctggaatgcagtgacgtgatcttggctcactgcaacctctgcctcccagattcaagcaattctcatgcctcagcctcccgagtaactgggattatgggtgagggccaccatgcccggctaatttttgtatttttagtagagacagggtttcactatgttggccaggctggtctccaactcctggcctcaagtgatacacccgcctcagcctcccaaatggctgggattacaggcgtgagtcgctgcacctggcctgatatactctttttttctttttctttctttcttttttttttttttttttgagatggagccttgctctgtcgcccaggctggagtgcagtggcacgatcttggctcactgcaacctctgcctcccgggttcgagtgattctcctgcctcagcctccctagtagctgggattacaggtgcgcaccaccacgcctggctaatttttgtatttttagtagaggcagggtttcaccatattggctaggctgatcctgaactcctgacctcgtgatccacccgcctcggcttcccaaagtgctgggattacaggcctgagccaccacgcccagccgatatactcttataatgactacaaaacatttcactgtaaagttacatgatgatttacttacttaatttcctactgatgaccatcaagtttgttgctagcctttgcttttataaacaccttcaaaatgaacaaatttgtttctactatttacctactcctactcacatgaatagaattttagatgtggaattgctggaccccaagggcttgtgtatttcatatttcaaaataatgccatccagtaacatacatatatataggtggtcctctgtatttattcattccacatccctggactccaccaaccttgatggaaaatatttgggaaaaaaccctgcatctgtattgaacatagacagacttttttccttatcattattccctaaaaaacacagtataacaatgatttaccgggcattgacattgtattagggatcataagtaatctagaaatgacttagagtatacaggagggtatgcatagataatatgcaaatactatgccattttatatcagggacttgaacatctgtggattttggtatctgagggaggtgccagaactaatcccccagggacactgaatgacgactgtatataaagcacaagaagagaaaagatgaatggaagaaaaaaacctcagtgtgaggccagatgccatggctcacgcctgtgatcccagcagcactttgggaggctaaggcgggtggatcaccaggtcaggagttcgagaccagcgtggccaacatggtgaaacccggtctctactaaaaatacaaaaattagccaggtgtggtggcgcgtgcttgtaatcccagctactcaggaggttgaggcaggagaatcgcttgaacccaggaggcagaggaggcagtgagccaaggtcacaccactgcaccccgactcaaaataaataaataaataaaaagaataaaagaaaaaaaaagaaaacctcagtgtgttaagttgtacccaaagtgtttgtgcagtataagtatgcaaaatgaacataaaataaaaatgaactacttagccaagaaataaatcatctatggccatatacttaaatattaaaagtgtttttctttgatttcctttaatgcagaatcaaggaagaaaaaaaatgatattctttcatggagccacagatagtttttatactttattttctcaatgtcttatatcaaatattaatttcttttctgtaatcagaaaacagtaccatggatactatgaaaaataacgttgtgctttttaattaaaaagcaatacatagtcattgtaataagtttaaaaataaaaaatgtataaaaatgttaataatgtccctttctttacctctaaatttacccgctggccaggcacagtagctcacacctgtaatcccagcacttgggaggccgaggtgggcggaacacctgaggtgagaccagcctggccaacagggtgaaaccccctctctactaaaaatacaaaaattagccaggcatggtggcgcgcacctgttatcccacctactcgggaggctgaggacacgagaatcacttgaacccgggaggcagaggttgcaggaagctgaaattgccccactgcactccagcctggatgacagagtgagactccgtctcaaaaataaataaacaaacaaacttacccctcgaaataaacaatgttaacggcctggataggaatcttttcaaacatttttctataatagagtgtgtgatttttacatcagaaatgaattttaaaaccttaaaaattttgtttaattacccctgcctggcacttcagcagatcacccttgctatctccaaccctgtcaagctgtgtgccctctttctgtgtccaaacaacttgccctcaaagaaacctacttggggccctgctccctggaggcacctgcgcctctgccttggctcaggttcagcagaaatcaaggccagacccaggaagtgttggccccagctctagcctgatcccggccctggagagccagcgctccccagcctggggagcgaggggcccggcgccaggcgaggccctgggctcccagagaggcctccttcccgcccgctttctctaggagtaattaagagtgaaatcctcctcctggtgaccccgtgctccaggcccgggctgatttacacatgaaaggtctacggagggcctgggctttctccttttcacattcacaatgaggcacagcctataaataaaacctctctgggaaacaagaggcttcaaaatgtgtgtgtgtgtgtgtgtgtgtgtctgtcccccagagggagtgtgtgtgtgtgtgtgtccctgtgtgtgtcccagagtgtgtgtgtgtgtcccagagggagtgtgtttgtgtgtgtgtctgtgagagggagagacagacccagaaggagagagaccagagggagagggggagtttgaaagggctagaaaagggaaggagtgtgaataaaagctggtgttaattgagcgcttactgtgtgccaggcaaccatcctcacagcaatcctgtaagggtggttttatggttcccattttaaagatgaagaaactgaggttcaaagagggcaagagttgcccaagataacacagtgaattaaggggaaggcttggactcaggaagtgggatgaacataagattcaaatgatgggccgggcgcggtggcttacacctataatcccagcactttgggaggctgaggtgggtggatcacctgaggtcaggagttcaagaccagtctgtccaacatggtgaaaccctgtctccactaaaaatacaaaaattagctgagcgtggtggtgcgtgcctgtggtccctgctactccggaggctgaggcaggataattgcttgaacctgggaagcagaggttgcagtgagccaagatcacgccactgcactccagcctcggtaaaagggcaaggttccgactcaaaaaaaaaaaaaaagattcaaatgatgacctgtgtctttgtgtcttgattgtgatgatgattacaggactatgcatttgccacatatgtactaaaaagggagaattttactgtatgtatactgcaataaccatgacttttatcatttttaattttatttatgtatttatttttgagaaagagtctcgctctgttgcccaggctagactacagtggcacggtctgagctcactacaacctccacctcccaggttcaagcaattctcctacctcagcctcctgagtagctgggactacaggtgtgcaccaccatgcccagctaatttttgtattttttagtagagatggggttttgccatattgggcaggctggtctcaatctcctgacctcaggtgattcacctgcctcggcctcccagagtactgggattacaggtgtgagccaccgtgcccggccaatcctgacttttaaaaaggtaaaataaaataggccaggtgtggtggctcacgtctgtaatcccagcactttggaagccgaggtgggaggagctcttgatctcaggagttcaagaccagcctgggcaacatggcaagatcctatctctaccaaaaaaaaaaaaaaaattaactgggcacagtggcacatgcctgtagtccttgctagtggggaggctgagatgggaggattgcttgaggctagggaattgaggctgcagtgagttatatttccaccactgcactccagcctggacaacggagtgagaccatgtctcaaaatttacaaaataataataataaaataaaatacatacaaaaaaacagaggccaatgggcagtgattggtgaggtatcctggatacttgaggcctctctataccattccctctagcaggcctgttaaccttattcacctctgtatccccaggctcagggctcaataatggggaatgtagatattagggaaatgtttgctcaattgattgaatacatgggctaagtcattctctctggactcattttgccatctataaaatgagaaaatgatgaaacactatggcaaacacctcctaatcagcctcagaggtcaccacctgcaggaagtcttcatggattcccttccacccgcagattgatcaagggcctcttctggcctcttacagagccaggttgtgttcccatccctgcactgactatagtgtacaatatttgtctggttctgctctgtggaggcacctgtgcctctgccttggcccgggttcagcaaaaatcaaggctaggcctagaaagtgatgggaaatactccacgtgaatattcaggttctttgcagtagggccaatgtccattttgctcctctctgtaccccaagtacctatcccatagcatgtagaatgtttgagaaattaatgaattaatgcatttatgagctctggtctcaggttcaaatgtgaatcatggctgggcgcggtggctcacacctgtaatcccagcactttgggagaccgaggagggtgcatcacctgaggtcaggagttggagaccagcctggacaacatggcgaaaccctgtctctactaaaagtaccaaaattagccaggtgtggtggtgcactcctgtagtcccagctatttgggaggctgaggtaggagaattgcttgaatctgggaggcagaggttgcagtgagccgagattacgtcactgcactccagcctgggcaacgagagggaaactccatctcaaaaaaacagaaagtgaatcatgctggtgttggctggggctgggcaagggtctcaggcagcagaaaccggccaatggagaaatccctgtgcagtaaagatgagctgaaaggcctgacttctagagccccaagaaaacaatcagaggggcagatggtttggggaaggggggaggctctggtgagtgggcaatctgcctgcatctgtttgaggctgagagtgaggtggggcacatggatatggttaggtcccagctctgctacttcttagctatcattcagccccaccaaccctcagtctccatatctgtgaaatgggcagggaatataatgatacctgcttctactttaacatgtttattcggagggtgaaggtacataataaggtcaaagtgcctagtcagaaatagtttgtaatttatttatttagagactgagtctcattctgttgcccaggctggagtgcagtggtgcgatctctgctcactgcagactccacctcctgggttcaagtgattctcctgtctcagcctcccgagtagctgggattacaggtgcccaccaccacacccgggtaatttttatatttttagtagagacggggtttcacaatgttggccaggctggacttgaactcctgacctcaagtgattcgcccacctcagcctcccaaagtactgggattataggtacttatttatttttatagagatggggtcctactatgttgcccaggctggtcttgaactcctggactcaagcaatcctcctgcctcaggcctcccagagtgctgtgattacaggcatgagccactgttccccaccagaaatattttaaactccataacatcttttcctcttttctcccaaatgtttttctttcttccttttttttttcctttgagacaaagtctcactcagttgcccaagctggagtacagtggcacaatcacggctcactacggcttcaatctcctgagctcaagccatcctcccagctcagcctcctgagtagctggaactacaggcacatactaccacatgcagctaatttaaaattttttgtggagacaggagtttcactatattccccagactggtctccaactcctggactcaagtgatgctcccacctcagtctcccaaagtgctgggattacaggtgtgagctaccacaccctactcccatgtttttcaccctaattagagctgccactcatgaattcctaaaaataatattagctttcctaacatttagtgagtgtcttctgtgtgtcaggcactgtgcctacacatattatttaatttaaccttcacaatcattctgtaaggtaggtctgctattattcttatcagagaagaaataggttcagagaggtgcagtgacttgtctgagatcacacagcctctgagtggtaaacctgtgaggtgagccatctgttaatttgagggaacaccagaatcctttggagggcttgttcaaacacagatttctgaaccccatcccaaagtatctgatgcagcagttctggggcggctcccaagaatttacatttctagcaagttcccaggcgatgttgctgctgccagtcctggggcacactttgagaaacatggcctaataccaagatttttccactgtcattatcccaattaggcatgttatgtcaagtccagccttttacaatacgctcgattcaaggaatttgaagtctagtatagttcattcagccctaggcatatatgaccctatagtcttaattaagtcttcaaaacacacacacacacacacatcccaactttcatctacattaaaggtacaaaaagctggaaaatataaatgagtaaaaaggacagaatcaaccctggtcacttcaattactccagtgagatcactttttgttatactttttgtttatggttgtatagggaaagctttctggataaaccaactcactggattaaaaattcatgggaggccagacgtggtggctcattcctgtaatcccagcgacttgagaggccaaggtaggaggattgcttgaggccaagagttcagaagcagcctgggcaacttggcaagaccccgtctctaccaaaaaaaaaaaaaaaaaaatccctggaattggctcactagcttaacaaatgctcgctttgcctgctataaaatctagaacaatgtgaggcccacagcagctggtgggttcatttctagtgtgacaagccactaactcctgttgagtgaagatgtgaccatgtggttatcaagagtcaggggggttggttctcccatcagttactcctttttttgagacggagtctcactccgttgccaagggtggagtacagtggcataatctcggctcactgcaaccttcacctcccagcttcaagcgattcttgtgcctcagcctccggagtagctgggattacgggcacataccaccatgcctggctaatttttgtatttttagtagagacaatgtttcaccatgttggccaggctggtctcgaactcctgacttcaagtaatctgcctgcctcggcctcccaaagcgctgggattacaggcatgagccgctgcgcccggccatcagttactcttgtaattaaatcttataattatataggacaaactgataaaatatgagtcggaaaagaagacggatgtttctatgaatgcagttgaatgctttggaaagactccaaaaagttagttggtacatatcattatacatctgtccaaacccacagaatgtgcagcatcaagagtgagccatagctgggcgcggtggctcacgcctgtaatcccaacattttgagaggccgaggcgggcgcatcatgacatcagaagatagagaccatcctggccaaaatggtgaaaccccgtctctactaaaaatacaagctgggtgcggtggctcacgcctgtaatcccaacactctgagaggccaaggagggcggatcatgaggtcagaagatagagaccatcctggccaaaatggtgaaactctgtctctactaaaaatacaggctgggcgcggtggctcatgcgtataatcccagcactttaggaggtcgaggcaggtggatcacctgaggtcagaagttcaagtgcctgtaatcccagctactcgggaggctgaggcaggagaattgcttgaacctgggaggcagaggtttcagggagctgagatcgcaccgttgcactctagcctgggagacaagagcgaaactctgtctcaaaaaacaaaaaaagaaaaaatataaaaattagctgagtgtggtggcacgtgcctgtagtcccagctacttgtgaggctgaggcaggagaagcgcttaaacccgggagtcggaggttgcggtgagccgagatcacgccactgcactccagcctgggcaacaggagcagaactctgcctcaaaaacaaacaaacaaacaaaacaccactcatgtagggtacgttgataatgggggaagctgtgcctgtgtctggagaggagagagatatataggaaatctctgtaccttctgcttaatattgctgtgaacctaaaactgctccaaaaaataaagtttttgtttgcttgtttgtttattaagacagggtctcggctgggcatggtggctcacgcctgtaatcccagtactttgggagactgaggtgggcggatcccaaggtcaggagatggagaccatcctggctaacacggtgaaaccccatctctactaaaaatacaaaaacaaaattagtcaggcgtggtggcgggcgcctgtagtcccagctactcgggaggctgaggcaggagaatggtgtgaacccggaaggcggagcttgcagtgagccgagatcgcgccactgcactcaagcctcggcaacagagcgagactccgtctcaaaaaaaaaaaaaaaaaaaaaagacagggtctcactctgttgtccaggctggagtgcagtgacgcaatcatggcttattcagcattgacctcctgagctcctgtgatcctcctgcctccaccttccgagtagctgagactacaggtgtgcaccaccatgcctggctaacttttgtattttttgtagagacgtgggtctcactatgttgcccaggctgatcttgacctcccgggctcaagcaatcctcctgccttggcctcccaaagtgctaggattacaggcatgagccaccatgcctggccaataaagcttaattaaaaagaaaagaagccaggtgcggtggttcctgcctgtaatcccagcactttgggaggctgaggtgggtgcatcacctgaggtcaggagtttgagaccagcctggccaacatagtgaaacctcatctctactaaaaatacaaaacttggccgggcatggtggcgggtgcctgtaatcccagctactcgggatgctgagacaggagaattgcttgaacctgggaggcggaggttgcagtgagccaagatctgccactgctctccagcctgggcaacacagtgagactctgtctcaaaaaataaactactgggagccgtgactcatgcctgtaatcccagcactttgggaggctgaggcgggcggatc

SEQ ID NO: 695 - DNA, 171065 bp, Homo sapiens
  misc_feature (1)...(171065): n = A,T,C or G
agtccagtccgggagacagagtgagattccgtctcaaaaaaaaaggaaaaagaaataaaaaaggcacattcactgagaaattgccccggagaaataaagaggaaaaaaatattgctttgacgtgttgttttagtcgtggcagttatgaagaaggaaaccacacagtgaaccatggctggaacattggttccatggtggtacatggctctgtacacatgacagagaagaaaagccttgtatcatggctgcaaagccccactggtactgacatgctcacagcgtctgtgggaggaaagatggaacaccagccacgtagagaagagagtgaggtgtcgtcatcagttgagtaacttcaaagagtgtccagttttctttgtttgcactttctacctttcatgcaaaatgtgtgcaacacaaacatatgggtaacttgcacgtcccattttgtgtagctgattttgctcacttttggagactctgctcctggggcagtcctggagaaacagccgagagagcaaaccagctgaacactcattattttcttaagcagtagatagctgcaaaagctccatttcgtttcttaaacagtttctttcagtctctttacctgtaggtatgctagtttacaaggactccagatggcctgggagcttcagaaccttttgccaattatcagaggaaggtaaagcctgctggaaaccagagcaacgcagaatcagggactccttgctatctttagaccattaatatatcattataatactaaaattcccacccagagaagaaaattgctattttcttttttctttttttcgtttttctttttttgagacagagtctcgctctgtcgcccaggctggagtgcagtggtgcaatcttggctcactgcaacctccacctcctgggttcaagtcattctcctgtctcagcctcccgagtagctgggattacaggagtgcgctgccacacctggctaatctttgtagaaaattgccattttctaaacatgcatcctgtgaagagacatgtttatgatttgcacctgcacatctaaagtgctccctgcacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtggtggtgcgcacctgtaatcccactactcaggaggctgaggcacgagaattgcttgaacccgggagatagaagttgcagtgagccaagatcatgccactgcgctccagcccgggtgacagaataagaccctgtctcaaaaacagaacaaagactaaaacgttttggaactagacagaggtgatgattgcacaacattatgaatgtactaaatgccacagaattgtccagtttaaaatggttaattttatgttatgtgaatttcatctcaatttctctaaaaaggtgagttgatcttaaagtattacatgtgaggtacacaggtgtgtgtgtgggtgttacggtacaggaaatgacaaaaacttgaacacccctgttgtaagccatccctcttgagggagtggggactttgaagacctgagagaagtccaggcacagtggcccatgcctgtaatcccagcactttgggagaccgaggtgggtggatcatctgaggtcaggagtttgagaccagcctgaccaacatggtgaaaccccatctctactaaaaatatgaaaaaattagccaggcgtggtggtgcacgcctgtaaccccagctactcgggaggctgaggcaggagaatcacttgaacccagaggttgcagtgagccgagattgcggcattgcactccagcctgagcaacaggagcaagactccatctcaaaaaaaaaaaaaacctgagagaagccccttggtcccagcctttctctgacagcagtggtgacaggctcagctctcctccgagtgcagccctgtcactggccttgctcctgtctcagggctgggaagactgttgatgttgtcattccaaagatcccacctggatcaggggaacatcccccacagaagggttagccatacagtgccagattctccaggagaaattcaccaaagaaatggagtccccttggggacagattcaacttgtattgtcagccaggagctgacgtggcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggtgggtggatccccaggtcaggagtttgagatcattttggcccatatggtgaaaccctgccttttctaaaaaaatacaaaaattagcccggcatggtggcatgcatctgtaaatccctggctactccaaaggcttaggcaacaaaatccctggaacccgggaggcggaggttggaattaacttaaattgggcccctgccctccagcctgggggacagacttaaactccatttttccaaaaaaaaaaaaaaaaaaaaagattaatttaaaaaattttaataccccgaggtatttgaattatatctccccaaaaaaaaaaaaaaaaaaaaaaaaaaaaaaggccagagcacaggagggctcatcatggagaccagtttcttgctgacctctttccttctcctataggcagccttggcttttagcacttttagttgctggtagctcctgtgtgtggtcagatgataggctgcaggtgagagtatcagaggctgcttcaacataagctccctgccagcattgctgggcaaaatgtcagcttgggccaaaaagagaaattagataagaacaaacagccaggcatggtggctcatgcctgtaatcccagcactttgggaggccgaggcgggtggatcacgaggtcaggagttcaagatcagcctggtcaagatggtgaaaccctgtctctactaaatatacaaaaaagtagccaggcatggtgggtgcctgtaatcccagctactcgggaggctgaggcagagaattgcttgaacctgggaagcagaggttacactgagccgagatcgcgccactgcactccagcctaggcgacagagcgagactccatctcaaaaaaaaaaaaaaacccatcctaacagtaggaccctggtttatcctgcttatccaaacgctgcaccaggtcataatcctcacgtcactattatcaatttttgacatctgcttctggcttcttccagtgacaatagaggatttcgcttgcttaaacactccttcttacctcttgtcttaacaaaataacaaatggtgtcctgtaacaacgtacgagagactgggtggcttaacctaaccgatatttatttctcacacttctggaggctggttcatagttagcaccatctcaggccgggagcggtggctcacgccagcactttgggaggcagtggtgggcaaatcacttgagcccaggagtttgagaccagtgtgggcaatgtagtgagacccctgtctctaccaaaaatttaaaaattagctgggcatggtggtgtgcacctgtagtcctagctactcgggaggctgaggcgggaggatcccttgagcctgggagttcaaggctgcagtgattcttgattgcgccactgcactccagtctggtagacagaccctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggatttcttagtcttgtgagtgtgtgggtgtgtttacaatttacagaaaatcaagtgacattcttcagcagaaaagggagtttttttttttgaggaaacacttatctcacagactgcaagtgcaggaaatgtgcccaacctcatgagaacctattaatagaatcagaaaccaaactgtcctgtgctgaggttgctctttcagtttgtctgaagcccgcctctgtttgtctctgtgtgcccattgcgagtctctctaaacactggcttcctctgtttctcccagggcacgtggttcagcaatgctctccaagttaggttccacagttcaaatgcaagcccagatcccctgcccagttccagaactcaaggggaatgaatctgattggcctaattctttatccctggtccaatcagctatggctgtgggcggggccataatcacacagggcgtcaagggccaacctccgttgggggagaagggagggaggaaagaaaggaagatggcgggagagagagagagagagaaggggggtgggaagagagagagagagagggagagagagaatgagaatgtgactctcagagaatagaggctccaaggctgagggactgctggttaaatacccgttcctcccccaggtgggacaactctgagacaagtctaggcagtctccagagggcctgagggggtctgagcccagatgcccacagccgtgacctgctctttaattaattaattagttttatttatttccagtgtcttgctctgtcgcccaggctggagtgcagtggcacgatctcggctcactgcaacctccgcctcccgggttcaagcgattctcctgcctcagcctcgctagtagctaagactacaggcgcgtgccaccactcccggctaatttttgtatttttagtagagttggagtttcactatgttgccctagctggtctagaactgccgacctcaggtgatccgcccgcctcagcctcccaaagggctgggattagaggtgtgagccactgcgtccggcctcctgacctactctttaatgcttcctgtgttgactgccttccctttcctgtctcacttccccactcctcttcctgggtcgcctcccaaacaaactacttggacctgaatctcgtccagccttatgttctggtgttaaagagtctgtctggaatttaccctgagaacaataggtgggtttataaacgggtgtgcatggtctcatttgcagctcagtcagagcactctagctgcaccatggaaaatgggcggaaggggcaagagtggagccaggggtctgcccagggagagggtagagtgacatggagggggaccgaagacagatccctgaaggacaccaacaccaaggagactaagctgaggcagagtagggaggagaggaaagccgaaagacagtgagtccccagaggccatgcgctgcacacttcacaaataaaccggtgaccacggagatattaagagcgatggtaaatctgtgtaattaaagcagctctagtaagggaactgacagacacattattggaacagggtggagtcacgtattaaacacaaagtttgtgtgcagcccccgcccggtggctcatacctgtagtctcagcacttgagaggccaaagcaggaggattgcttgagcccagaagtttgggaccagcctgggcaacatggcaaaaccctgtctctacaaaaaataaaaaaattagccagttgcgggagtgcacacctgtagttccagcttctcgaaaggctgaaatgggaggatcccttgaccctggaaggtcaaggctgcagtgagccaagattatgtcactgtactccagcctgggccacagagtgagactctgtatgcaataatgaaaaaaaaaaaaaaaagagtaggaacttagtgtgcaataaaagcatttaaatcaggggagaaagaaatttctccaaataggatctttaaacaattggctgctcgttcaggggaggtcagaggagacaggaaaatgtactcaaactttacagatttgcaaaggtgtgtaactatttaaaatgtgatagaactgccatgggtaaactgagtcctttccctactttgtgtcagttgcaaagaaagaacacaaattggagggttgcggggaggaaggcaagcaggatttattctttggccagagaaggagaaggaatgacctcttgctccagagacgcctcctcctccccaagatgtgggtagatggggaattttaagcagttacatatggggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggcgtgcaccaccataccgggctaattttttaaattttttgtagagacaaggtttcaccatgttgctcaggctggtctcaaactgctgtcctcaggtgatcctcccacctcacctcccaaagtgctgggattataggcgtgagccatcgtgcccagcctattgtttttaaataattaatagtttaaattttctcagttttaaattataatgtggtagatattaataaatataactcatataagtgaaagtgcttttgggtcttcaaaaaaagtttttttttttagagacagagtttcactcttgttgcccaggctggagtgcaatggcgtgatctcagctcactgcaacctctgcctccccagttcaagcgattctcctgcctcagcctcctgaagtggctgggattacaggcacccgccaccacgcccagcttatttttttgtatttttaatcgagtacaaaggcatcctgagaccaaaaagtatgagaacggctgatctagagcaggggctggcaaactacagcatgtgggccaaattcagccctctgtctggtttgtttgtttgtttgttttgtatttttagtaaagacagggtttcaccatgttggccaggctggtctcaaactcctgatctcaagtgatctgtccaccttggcctcccagagtgctgtcattataagcgcgagccagtgcacccggacttgtttttgtaaataaagttttactagaacacagccatgccatttgtttacatcatgtgtgtggctgcttttgcgctatgactacccatatgtgtaagtagaaagagaaccagcttcaaagagacagaaatgggtgaagggatccctctgagcctcaattcctttgtccgtaaaatgagagtaataaatatctgacagaaaaacaaagcaggcaaaagaaagaagagaaaaaatagttaatgtgagtaacaaatactcttagggagcagtaaatacaactcagccctgcagtgagcggtctggtgtgacctggctctccctggaaaccagtggcggggtgtttgggtattaacaaagccagggcctccctccctcctgggcgcctccacccttttacctccaccagcttcaccacattggggtggtccagcttcttgaggatggcaatttcctggtacacctgctcaatggggcccctgggctggatgcagcctccaggagctggccgggtgcctcggggtggagggcgacctgaaggaaacaaaaacagacccagggtcagggcaaagagactttcctccgcagagggcagctgcaggtgggatgccaaaaggtgggatgccaaaaagccactctgcagggctggagtggctgctgccaccaggggctttaactaaccctctactcctctgtctcctctgctgctggaagtgagtgagggcggagccctcggccgtcctgtgaattccctccttcccgtcacatccccagtccatgccctggtccacagtgaaaggcaggagtgctgaggcaactgcagtctagctcagcaatctcaacacccagggtgagtcaatcacttcccctctctgggctcagtttttgcagtccataaaatggacataaacattaactcttatctccttaactcatagcacagatggctggctgggcgctatggctcatgcctgtgatcccagcactttggaaggctgaggcgggtggatttcttgagcccaggagttcaagaccagcctgggcaacacggcgaaaccctgactctataaaaatcacaaaaaattagggccgggcacagtgcctcatgcctgtaatcccagcactttgggaggccgaggcgggtggatcacgaggtcaggagattgagaccatcctgactaacacagtgaaaccctgtctcgactaaaaatacaaaaaattagccgggcgtggtggtgggcgcctgtagtcccagctactggggaggctgaggcaggagaatggcgtgaacctgggaggcggagcttgcagtgagccaagatagcgccactgcactcgagcctgggtgacacagcaagactcagtctcaaaaataataataataataataataataataataataataataatcacaaaaaattagtcaggtaaggtggcacgtgcctgtggtcccagttactcaagaggctggggtgggaggatcacctgcgcccaggaagatcaagcctgcagtgagaagtgatcatgccactgcactcagcctgggtgacagagcgagaccctatcaaaacaaaaaacaaaaaaaacaaaaactaaatagcactgatgtaaaatgaagccagggagaagaaaagaagcaagcatcgggagagaaaaacaaaaggctatctagaaaggagaggcactcaggccaccgcttgatcctgcagtaaacaataggcagtcacaaggatgtacagacccacagtgaaaaccctcacgatggcacacatcccatgtaagtaaggctctgagtgtgactaacagaatagaacagggatgtgatcggccttggaaaagcaaaggcagaagtacaggtgtcagagggaggatgtgaaaggaggaaagctgagtccaaaggaaaagggagggtgtggggaggtgggagacacgcgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccaggcatggtggcatgcacctgtagtcccagctactcaggaggctgaggcaggagaatcgcttgaacccgtgaggcagaggttgcgatgagccaagatcgcaccactaaaccaacagagggagacttcggctccaaaaaaaaaaaaaaaaaaaaaaaaaagactgtaatctcaccactttgggaggccgaggggggtggattatgaggtcaggagattgagaccatcctggctattgagaccatcctggctaacacagggaaaccccatctgtactaaaaatacaaaaaattagccgggcgtgggggcacgtacctgtagttccagctacttgggagactgaggcaggaaaattgcttgaacccgggaggcggaggttgcagtgagccgagattgcgccactgtactccagcctgggtgatagagcgagactctgtctcaaaaaaaataaatacataaaaataaaaagcttacagtgatctgaatcccactcaagctgtgtatttgtatctgttacagacggaagcaaggaaggtaagtccttggctgatcagccctctgatttacctgggactgagaggtttcctggacaagggactttctgtgctaaaaccgggaaggtcgaggccaaacaggatgagtcggtcaccttcagaaggattaagtcaatggacttcaggaaggctgatgacaggctgtattaggccagaactctataagccattgacaccctctcctccttcccttgtccacaccaggcttcactctggagagaatggctaaacctgtactagttaaactcaaactttccttgaaagacagttttacagggcagtggggcggcgggggtggggggtcggggaaccaaggaaacaaagaaccctgaaacagatctgttagaaaagaaggggctattacaagaagcagggaggctttccaggaaatgtggcttccaaaaccctatttctggccggacgcagtggctcatatctgtaatcccagcactttgggaggccgaggcaggcagatcccttgagtccaagagttcaagaccagcctgggcaacatggcaagaccccatctctacaaaaagtacaaaaaattagccaggcgtggtggcacatgtctgtagttccagctactcaggagtctgaggtgggaggatcccttgagcccaggaggtggagagctaagatcatacaactgcactccagcctgggtgacagagcaagaccctgtttcaaaaaaacccaaaccagccgggcacagtggctcacacctgtaatcccagcattttgggaggctaaggtgggtggatcacctgaggtcaggagtttgacaccagcctgaccaatatggtgaaaccccatctctactaaaaatacaaaaattagccaggcatggtggtgggcacctgtaatcccagctacgtgggaggctgagacaggagaattgcttgaacccaggagacagaggtttcagtgagccgagatcgcgctactgcacttgctgtgggtgacagagtgagactgtgtctcaaaaacaaaacaaaacaaaaaccgtggggaatttttttttaaagtgtgaaaaaaaatagaaaactacatttcttgtgatcttgtatcagacaccttcaagcttacctgaaagtttgaatcaaaacaaaataacaaagtgtgccttttatataacttgtctcgttgtgaagacccatctgcttttttctctggtgaagacaggttttctgaaacacacagtgttgagtctttcccatccctcaacaattactggattattagctaaataagcattctccagcagatctaaatctgacacaacaagaatgcacgtttctttggctctgaacagcattttatcttttgaaaaccaccttcacgtgagtgatactcagaatcccattttacagttgagtaaaagctcaaactcatttgtttctgataaaacattctggaggtctccttgcaaatttttctggttcattatgcctccctttatcctccataagataatagttcatagcctatagtcccagctactcaggaggcttgagcccaggagttcaaagccagtctgggcaacatggtgagactatgtctctaaaaaataatttaaaaaaagatagccaggcggggtggctcatgcctgtaatcccagaactttgggaggctgaggtgggcagatcacgaggtcaggagttcgagaccagcctgaccaacatggtgaaaccctgtctctactaaaaatacaaaaattagctgggaatggtggtgggtgcctgtaatcccagctactcaggaggctgaggcaggataattgcttgaacccgggaggcggaggttgcagtgagccgagattgtgctgctgcactgcagcctgggcaacagagcgagactccatctaaaaaaataaaataaaataaagagataataattggtcgctaagagggaaggaaggaaagcaggactcctcagactccaaaactatcaacgtgttataacattttgcattttcagttgttttagaggtggataagaataacctttaagtccacataagaatcacaaaatgttctgttgagatttccccaattatttatttatttatttatttttgagatggattttcgctcttgttgtctaaggcgttaggtgtgtgagctacacaccgagtcatgagatacatggcatgcagtgatgtcagcacagccaacaggaagtgtttgtggagagtagcgccctatccctttcttcacttgcttccctttttctcgtttttctatctcatgagttccattctctgggcaataggaaattgagagggaagtggggtgactcagtacagttagtttcttttggctttctttgaagccgccctgcttcttgcaatagccccttcttttctaacagatctgggtcaagtttaactagcacaggtttagctactgtctccagagtgaagcttgggatggacaaggggagggggaatgggcatcaaagtaggaaattgagtgggaagtgggggacaaagtacagtcaatttctttgggtcagtggaggataaaagttgcttctttcctgccctaagaaatatccagaatgcttatctcttgcctttagtcattttaccctaacccaattagggttagcattagggctaaggttagggttagccttagggtcagccttagccttccatttggacaaaatctgccatttggccgggcgcagtggctcatgccggtagtcccagcactttgggaggtgaggagggcagatttcttgaggccaggagttcgagaacagactggccaacatggcgaaaccccatctctacgaaaatacaaaaattatctgcgtgtggtggtgcacacctgtaatcccagttacttgggaggctgaggcaggagaatcacttgaacctggtaggcggagtttgcagtgagccaagatcacgccactgtactccagtctgcacgacagagtgagactacagctcaaataataataataatgataataataataataataataataataaaaaaaatagtgtgaacccgggaggtggagcttgcagtcagccaagatcgtgccactgcactccagcctgggcaacagagtgagactccgtctcaaaaataaataaataaataaaataaaaataaaaataaaaataaaaataatataaatatgaaaataaagttctgctttagctgtgtgccaccgattttgacatatattacattcattatccagttctattgagtcatttagcaatatttcttacaatatttcaatcagcttccaaatattttaaaaatctacctcttaaaaattaatttctggctggcatggtggctcacgcttataatcccaacactttgggaagctgaggcaggcagatcacctaaggtcaagagttcgagtccagcctggccaacatggcgaaaccctgtctctactaaaaatacaaaaattagccgggcatggtggcaggcgtctgtaatcccaactactcgggaggctgaggtagggagaattgcttgaacccaggaggtggaggtttcagcgagccgagattgcaccactgcactccagccctggcgacagagcgagactctgtctccaatgaaaaaaaaaaaaaaagaaaaaaaagaaaatgaatttctaatttccttgaaatgtggttagagaacctggtctgtatcatattgctgttgggaatgtattgaggaaaatacatgatttaatgcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatgggtgggaaggaggaggaacagtgttggaaatgatggtgaaggagtgtgggattccttttgagtcgattaaaatattctaaaattgattgtggggatggttgcacaactctgggaataatctgaaaatcattaaatggtaccctttaaatgggtcaattgtatggtgtataaattatatctcagtaagtttcttttagaagaaacaaaaaccaaaaagcagggccttcctgacgttggtgaggacctaaagttataacacattttcaagcctggtcctattcctcccaagcatggtgactcagatgccagcatgatcaccaggcgtgccctgagatcctcgcctcctccctggggatccagggtgttgccctgcgctttcctaccttccccaggcacgccctgccctgcgcgccctggcgggcctgaagtagagcagaaaggaatcccgcttgtcctgtggcttctctctgctgcagcctggcaccgtttcctcttgcctgctgctgcttcctccctcccgcccagctggctgtgagagcacgtctcagattcgaaaaccatgtgagattcagaatgtgcacctgaagctgcccgctggggctttctgtgctgtcggccactgcagagatctgggtcctccccagatcccacttaccaaacgtaggaaaagatgatcacgtggaagaaccacttaatggtgccataattcatgctctggatccgagtgactttgttcgtctcatactggaaaacatcactgcagctgcagcaggccggcatggtgacagcctccctccctgcgcggagctggaccagagctctactcttcctgacagggccacagcaagccccctcccagtaactgcaaaatgaaacgtactggtttttagcaggagtctttaacttcaagctcctccaatgactgcagagttggggcgggccctggcagtggccccacatgtggctgtgataaacaagaagcgccaagtcctacgggcctggctggcagatgacctcaccccagctggcctcccccagatgcctacacaaagatggtgttcagaggatgggcatttttagaattctcccttttcccccctttcctttcacttttttggtctcatgtctcttgggagaaaggggcagccttgcaaatgtcacaagactgggagcttccattatgcctcagaaaaggactgagatctttccattgcctgaagccccactcagagattgattcattcatttctacaaccctttattcagcccctgatgtataggagctctgggtaaatgaagatctccccctcttcttccaccgccccttataatactctggtctgcagttggtgggggaaatcagatttgcaggggtaggggtggtgggggtggaggggctttatttttctgccagatctttcatgcttgaccctctgagttactctccaccctcctctgcaccccggcaggtcgatctatgacctagaccaatcagccaaagatcaccagggacacagtggcagtccaacaaagttaggtttgttgacctattcagtgagggacaccacccaccagaagagctacgcacatcaccaaacaaaggaaaacagcaatttattataggattccgaggaaagtggagttgagataaaatctaaatgaagtcatgttttgatggactcaaagcaaaacaggtttgtacaaagcagtcaacttcagtctggattgcaaagaggacccagggccctgtttcctaggaagcaacatagctaagatacatgtcaaatgtgtccagaaaatctttatctgaagctctgctcctgagttgtaaattgaggctgcttctctgtgtcaagatgacttaaatcttccaggcaaaattggaatatttcagtcttagtcatgtaatttcaaacagcaaagtttctgaaggtctctgattttaaaggacaatgtttcagcagtcactcaaagatgcagggttgtattatcactttacagctacagagaattattgttccctgttatctttacagctggcttgatccctttctgttattccagcctgctaagtggccgggtagattttcagtttttcagtctaaactaattgtactttctcacacatacaaactgcatcagggttcccctcaccttctggcttccagttcaggagactggagagcagtgaggatggacgtgactccctggccctgcccttctcagttgcatataggcagggcttctgggcaccactccctcctttagtcctgggagtggtaagggctccccactcttaccagccccaggaagctcactatctcctattgctttttcttaactctgtccacacctttgtaaatggttccatcattagttaccccacttgagtatgccattgctttcctgccgggaatctgagtgatacggtcatcttcatctgtaaaaagaggagattcacaggtaaagcctgatgcttagaacataggctctaggggactaatggcctggcttccgatcctggcttcacatcttaccagctctgtgaccctggacagctctgtttatgctattcattcactcattcccaagagcaccaggaatagtagatatggcagtgaacaggcagacaagtcaaatgtccatcagctgatggatggatacacaaaagcacgaaagcccatacaagggaatattattcagccataaaaaggaatgaaacactgacccatgctccaacatggatgaaccttgaaaacactacgcttaagtgaaagaggccagacacaaaaggatacatcttttacgactccatttataggaaatgtccagaataggcaaatcacttcagtgttgctcttgctaccactcaaagacatctattttcttgtctttctttctttctcttttctttctttctttttttttttttttttttttttttgtttttttgagatggagtctccccctgttgcccaggctgtagtgcagtggcaagactttgggtcactgcaacccctgcctcctgggttcaagcgattcttgtgcctcagcctcatgagtatctgcaattacagccatgcgcacgctcagctgatttttgtgtttttagtagagatggggtttcaccatgttggctaggttggtctcgaactcctggtcacaagcgatctgcccgccttagcctaccaaagtgttgggattacaggcgtgagccactacacccggcctgtttgttgtctttctgctgcactcttgcactggtccctcatgctctcccctctccactccttcagcccttgtccgctatttcatcactgctacctcctccactccatggattctgttctcaaagaggttaccaaagacttctcagttgccagactgggtggatatattttattccttatgttacttgatctcttggatgcattcaacatcactggctactttctgcatcttggaccagtattttcccttggtttccatgactttcctgggtcccatgttctcctggtttctcatttgtacttctatgactctttatcttatctttctttttaaaaaattaatttaattaatttattttagagactgggtcttgctctgtcgtccaggctggagtgcagtggcgcaatcatggctcactgcagcttcaaacttctgggctccagtgatccccctaccacagcctcctgagtagctgggaccacaggcacatgccaccaagcctcgttaattttttttttaattttgtagagatagggtcttgctatgctgcccaggctggtctcgaactcctggcttcaagtgatcctcctgactcagccttccaaagtgctggggttacaggcataagccactgcatccaatctttgtcttatctttctctggctctcttctccctgtaaatatcagttccagcaaattgtctctcagcacttcttatgattctatcaggataggacaggttatgctgcaataacaaagcactctcagtgtctcatggcttatagcagtgatgaattaattctcactcacactatatgtccatcatgggtctcccagatggctcagctctctgtaatcactcagagatcgaggctaacggaacagcccattgtcttgaactctttaatgagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaattttcgtgcatttctgagtgatttcatggaatctctccgtgtcttggtgtcctgtgaacacagcggcctcaccggctttggctccacaatggactcgcacttcttcctgtagtagtattcgttgaccacacagggctgacagcacttgcaccagggataaatatgggagcgacagcagttactggagtaagtgtcgatgaggaagtcgatgaacacagtggcctggggagaatgcagacaagcgctgcgttagtcacttccttctccaaaccattttcctaaagcatggaaaagagaatctcttaccagaccgaagtaggagagggttgagccgatgtacacaaccagctggataatgtcaaattttcctccctaaaaacagagtgggagagtttactcaggtgaaattcagagcaacgctcttttgcttcaacgtgcaattgttggttctatcagggagcggagcctcatgctgtgacttggatagatgcgttcaagtgctggctgaggcagagactacgcagactgaaactgactctcaggcatcctgcttcagccgtgcagggtgtgcttggacccataaaggttttacatgagcaagcactggggcccacacattaaggggagacccactgaagggctatcatttctccatacaaggtgagggtttcagacaagcttctcctccaaaaggtttgacattacttcagaagcagagggaaggaatgtctgggtggcctcgtgggtttttttttttttttttttttgagacagagtctcgcactttcgcccaggctggagtgcagtggcgcaatctcggctcactgcaagctccgcctcctgggttcaagagatactcctgcctcagcctcccaagtagctgggattacaagtacccaccgccacgcccagctaattttttgcatttttagtagagacagggtttcaccatgttggccaggctggtctcgagctcctgaccttgtgatccacctgcctcagcctcccaaagagctgggattacaggcatgagccaccgtgcccggcccagccttgtggtttttattcccagcggtctttgcattctctcagctatatcttattgcttctagtcctgcttatcactgtgttacatagataacatgctcttggacaggatgtcgtgggatatgttgatttttgcatagctggcatcttttccttccatcttcagaaggcaacactccaattttcttttcagtccatgtagtgtgtgtgtgtgtgtgtgtgtgtgtgtgttgaaggggctggggtgttggcctctctgctggcccctgggctaggttagggctggttcgacactaaccactgggagtatggcatgaccctggtcacagtgattagttcagcagtgggcatgtcatccatagtgggccaatcagagccaatgacatttgtctgagacctttgctgaaccttctggcaaagaggtgttttcttttcactgaggttgctaaactggtcagatcgaaggtgctgcctgataccttcatagagagatggctgccaagaccaaggaggacgtatataagacacggaaggtggcaagttcttgatgatgatgttgttgtttgagcacctggatccaaccatgcttgtagcttaaaaataacccctggattttttcagttacgtgaacccaaaaaagcccactcaaaacttttttttttccccttaagccaatttgaattggattctgttacttacaaactattttacagagagatttctttctctctcttgttaagtatcagagtatttttaaagccgaatgttagaattgctttccaggcccactcctgtactcgtcagatgactcattcagggacagcagcccgagaacatcttcttcctcttttatcccatgtgcgaaatgcccagtgctagctgaaggctgagaccaaaacccttccctccatggaggccccacagcagtaattaggacacagtcataggatgccggtgcccggagctgggaaacgagacttacggtgccaaaaaccaggatgtcaaaacggatcccgaagacttttatcagagtccgtttctcaacattgttttccttgtagtacttggcgtatctgtaggaagaaaaggatctgtatttgtaagatccctttgaaagtgctgggttttggggttttttttttttttttttttttttttttttttgagacagggtctcacgctgtcacccaggctggagtgcagtagcaggattaccactcactgcagccttgacttgctaggctcagatgattctcccacctcagtctcccaggtagctgggactacaggcatgcaccaccgtgctcggctaattttttgtattttttgtagagacgggcttttgccatgttgcccaggctggtctcgaactcctgagctcaagtgatttgcctgcctcaggctcccaaagttttggggttacaggcatgagccactgcatctggcaaaaaatgctggtattttatggaaggaaaagccaaaacagtggcctgtctagtcctcctggtctgtcccctggctctgtgacaggtggcaggggaaggaacacaatccaaagccctgggtctctctccaaccacctggaaccaaagagcagtcccccctccccatgtcaccacctgtacctgcatcatctcagagtgacggaaaatcagcttgtcgcttaagattaaaatgcacattttaaaccaacacaggattaacaacaagcagagaaattaaaaaaaaaaaacttcaagcaatatgactattccttaagggggaagaagaggtttggcatctagaacaaagtgggagtgggcggtggtaaatcttgcatactaattactggactggagacaggcacacctcagcaaactgtattttcttagattctgtgtatgcctatttggcaatcattaatcacagggccaaactaaaggctgaagttgtgttttttgttttgttttgttttgaggtggggtcttgttctgtcacccaggttggagagcactggcatgatcagagctcactgcagcctccacctcctgggcccaagtgatactcccacctcagcctcccaagtagctgggtgggactacaagcgtgcaccactacaggtggctaatttttatttttaaattttttggtcgggcaccgtggctcacacctgtaatcccagcactttgggaggccgaggcgggtggatcacttgaggtcaggagttcaagaccagcccggacaacatggtgaaaccccatctctactaaaaatacaaaaattagccgtgcatggtggcaggcacctgtaatcccagctactcaggacgctgaggcacgagaatcacttgaacccaggagatggaggtcgcagtgagccgagatcgtatcactgcgctctagcctgggtgacagagcaagactgtctcaaaaaaaaaaaaaaaaaaaaggaaaagaaaaaataaaaaagtttttttcaaaaatgttttgtagaatcaggatctcattccttcaaccaggctggagtgcagtggtgtaatcatagcttgttgcagccttgaactcctggcttcaagccatcctttcatcttggcctcccaaggctgaagttgtttacatctcctctgcaatccagcttttgtgagggtgtgaaaatcatatcacaaaccctccaaccaatccctcaaccacctccttttctaactctccagtatttctccttagggacaggtagggtgagggccagacatttagagaccattcctgtaactcagaacctactggcattattcaaagtagttaaccctaagctgtttccctagtcctgccttgcccttccactgagtaacacaataaagctctggaccattctttaccctttattctgcctcttgagcggatctggtacttcctcctgtggccctgtctagcatggcatggcctggtgtggcctggtatggtgtggtgtggccccatctcttgggaaaagtatgtaataaattcttcttggccaggcgcaatggctcacgcctgtaatcccagcactttgggaggccaaggtaggcagatcacctcaggtcaggagtttgagaccagcctggccaacatgatgaaaccccatctctactaaaaatacaaaaattagctggatgtggtggcagacgcctgtaatcccagctactcaggaagctgaggcaggagaatcacttgaacccaggaggcagaggttgcagtgagccgagatcacaccactgcactccggcctgagtgagagagtaagactgcctctcaaacaaacaaacaaacaaacaaacaaacaaaatattctttgagtggcattgacctctctctgtcatcactcagtactaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcaatcctcccacctcagggtcccaagtagctaggctacaagcacacaccaccatgcctaattaaaaaaaatttttttttgtagagacagggtctcgctatgttgcccaggctggtcttgaactcttggcctcaagtgatcctcctgccttggcctcccaaattgctgggattacaggcatgagccgctacacatggctcatattctcaatagagcagtcccaattggccactgaccagccaatagtcttgctctcctgggcagatgttcaccctggtccaataagccacagctatggatatgaaggtctgtgatctcaaattgagctagagggggaagatgggcatggcagaaaaatctatcaatctctgctacaattaaatatctgaggtcagacatggtggttcacgcctagaaacctagcactttgggaggctgaggtgggtggatcacgaggtcaggagttcaagaccagcctgaacaagatggtgaaaccctgtctctactaaaaatacaaaaattagctgggcatggtggcaggcacctgtaatcccagctactcgggaggctgaggcagagaattgcttgaacccaggagatggaggttgcagtgagccgaaatcgtgccattgcactccagcctgagcgacagagcgagattctgtctcaaaaaaaaaaaaaattgaatattggattattgaaacttggcatagagcagccactgtccttgtcttctaagagcttatatcatattattattttattattattaataacatatcattattaattaatagctgcagttcactgaacagtattagataccaggcatggtgcttgtaattagtcatctcattgaattcccttaatgaaaattaggtagtcagagacctttcttcatggatcgcaaccccaggggcatgtgggatttcagagatgtgttttggggaaagaggtataattattcaactttcagttaattagccacttagagaaattaagtggtaggtggagttgtaaaggaaggcaaagtactgggcaggcagatgctaagtgggcgactgttctaggcataagagaaatgggggtgggtatgaaaaaaagcaagagaaagagagagagagagagagagacaagggaaatttggtttgactggataaaaaggccagtgaaaagagggagttttggtaagagctatgccatgggcagggagaagtacagagatcttcaatcatggactctatcgccatcccctcttctcttcctgcaggtgggcagaaccaaggtgccctccctacaccttcctggggcctccagcgatcctgagctcagcctcctgacctgcagacccctcagctctggccctcacgtcctgcttgctgtacctgctttatcccatatcaccatctccattcctcagcatagtgacaatcccagttcctacccattccactggcttctccatttggcttggagctctttagctggattgagacgactactctgatgagtgccatgtcactggctcaacaaaatgggcccaagtgagtcaatgtcattgacatgaaggtgctgtcagtttggtgggaaccaagggaatgagactgtgttttagctgcgttcgtttgaacagttacacacttagggcttcttatgcggatgctcagagagaaatatggaagacgagatctcgtagaaaacaagaagacatgttgtaaatgagtcaggcctcctggagtccaggactagggaggaactctttattgaggatcactcgagggagtcttggggctggtggtcttcacgccacagccccataactcagctcctctcttccttctctcagtctctctgcttctgttttttgtctcatgtcctaaatgtccaactattcagcataactttattctgcttcccctctctatcctctgtagcaaaatgcactgttggaattacatttttatttttatttttatttttatttttttaagacggagtctcactcattgcctaggctggaatgcagcggtgtgatctcggctcactgcaacctccacctccaaggttcaagtgatccccttgcctcagcctcctgagtagctggaactacagatgcctaacaccatgcccagttaatttttatatttttagtagagatgggatttcaccatgttggccaaggtggtctcgaacccctgacctcagatgatctgtctgccttggcctcccaaaatgctgggattacaggcatgagccaatgtgcccagctggaattaaattaataatttttatttctgctttagcgagagaggcggtgactcactgatacaaggaagatatttccccttccaagggtgatgtattcagcttttgggtttaaaaggagatgctatcaggcacgcgtggctatcctggcagattacataaaaatacagaagaaatgttctttgtgttaaaagaataaaaaagaaaaaacaaaacgtgtttcctcaaaaacttaaatacagaattaccacatgacccagcaattctactactggctatatccccccaaagaattgaaggcaggaacatgaataggaatttgtagaaccatgtttataccagcattatccacagtagccaaaaagtggaaagaaactaaatgttcatctacggattaacagacaaacaaaatgtggaatatctgtacaacagacttattattcagcctttaaaagaaatgaaattctgggccaggcgcagtggctcacacctataatcccagcactttgggaggtcgaagcggcagatttcttgagcccagcaacatgacgaaaccccatctctccaaaaaatacaaaaattagcccagtgtggtgatgcatgcctgtagttccagctactgggaggctgtggtgggaggattgcttgagccctggaggtcgagggtgcagtgagctatgatggtgccactgcactctaacctggatgacaaagcaagatcttgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacttcatgatttgcccgcctcggcctcccaaagtgctgggattacagacgtgagccactgcaccctgccgaatgtactttttttttttttaaactctatcttacttccttctcatcacctaattcagaattcctataatcgttggtcgagagtctattgcctagtgatgtcagagggttcgcagaaaccccagtgccttggtatccacaaatgtttttcttttagttatgctgaactggtgctgcctaatagggcagccactcacacatacttcaatttaaattaattaaaatgacgtaaaatttaaaattcttgttttcagctgtacaagccatattttgatagccccctgtagctaatggctaccatattgaacagcaaagatatacggtacttacccagcagtatagaaagctcaaccggacagtgctacaacagttgcaggtaagcaagcaaggtaaggatagtcccaatcagatagatggcatctattttgtgtgaagccttgtgaggtggctcacacctgtagtcccagctacttgggaagctgaggtgggaggatcacttgaggtcaggagtttgagaccagcctgggcaacataatgaaacgaaaataaaaaaattttttttttctgtgtgaaataggaggcacagtagtcccagctacttgggaggctaaggagggaggatcacctgagcccaggaggtcaaggctgcagtgagccatgattgcaccactgcacctcagtctgggcaacagagcaagactctgaaaaaaaaaaaagaaagaaatagagaaagagagaaaggaaagaaagagagagagaaagaaataggaagcagagttgcttaagagtgagagggaaggcaggtgggtgggatggtgggatgagtatagagaagattcgaaggaaggaaggagggagggagggaggaaggaaagaaagagagagagaaaggagaaagaaagaaagaaaaagaaagaaaagaaagaaagaaagagaacgaaagaaagaaagagaaagagagaaggagggagggagggaggaaggaaggaaggaagcaaggaaggaaggggaggcagaggtgcctgagagtgagagggaaggcaggcaggtgggaggtgggatgagtgtagagaagattcaaaatagttgctatggtgaatgggaggagagagccaacagggaaaacaggaattccagagtagtggtaagaattagagaccatgaatttgttattgccaacagtctaggtgactgagattatggtagaggcctgggccttcccaccaataggaaccgcctcctacctccacactcagtaaccaccaggacttgccaactggttcacatagttttaagatgtgtcatcattggtatctactatgtttgttatggtgttgacatgtgttactgggacagtagctagtcaggtccaagatacaggagcaaaaggctgattcagttgctctgcccataggtcaccctcccctggggcttgcacccctgccaggcaggaagcttctctttgtcccctaactcaactcagccactgggaatgacttcgttcattcaacttaatctgagtataactaccctacctccttatgaatgctggatttcttttaacctcaagatctcccctctgttcccctctacccaagccaaatacccatgctatccttgggaactttaaaaaatatctatttcctagtcaagacagctggccacttcacataacaacgcaggtcttctgcaaccctaaacaaaggctggagatggatggggaaacgctctcctaatggtggatgggtagagagacgtctgaggtttctggaagactgaggacctattgttttctccaccagtctaagcagaacaggtataaaaacagaatggaaggaaatttacattgatccaggactgggcttttgctgcaagttgcaaattaagttatttagggtgcttttgtctgaaagtagcagaatgcctgactcaagctggcttaaatatgaaataaattattatttcatgtattgggatatcctgggggaagatacttcagatggggttgatttagtggtttgacaacatcatcaaagatctgggttcttcctgtctctatgcactgccacccttgttgctgggttcatcctcaggaggaaagatcatcagttcttttgtctctttcatgggaaaatctttcccagagtcctctttaccccacctcactctaccctctagaactagaagtgagtcacatgactgtttctctcctgataagagacagggaatgaccatgaccaacttggaccaaccgtctgggttggaatggatgttggggagtcattcacaacatccatgactgggtatagcaaagatcatggaatctaggctggatgggaaaggaattggaggaaggagggtcctgagagggagaaagtggaagggccaagggatcctggagttcgaagaactgctaagctggaatgatcaaaagaacagaaggtacaagtctgtgatcagagaaatgtgagactttagaggaagattcgttccaggagaaactgagggccagtacatggtccagggagatggtggctaaagtagagtggaggtgaaggtcattggaataagaagggacaggagctgaagggccaggagttcggccaggtcctgggtcattaaagtcaccaatatggcggtaggaactggggcgagaagggtaagccagttgccaaagccctctgagaataacagttgattgattgattgatgagtaggcatcatcaatgagaaggcacagaaggtggtacagctagatgtcaggagcctcagtgcttactcaagatggaggactatggatctggaaatagaggtgtggagcatagaggacaccatgggggtgggagacggactaccatcccctgggaagggcttcgaggactgtcagggaagagccaggtcttactcaggtcaggaagtagagggaactttgtatgcagaggtcaggaccttaaaaataaagagcacaccccactcttccctttcaccatctcacaggctggaatgagaatctgtaggtgagccaccatttacccagagtgtgggccatatccctacccggtaattggtaatagaagcgtgcttgaaacagtccttcccacgtgtccgttaatccttagagctcgtccgtatcaggggtgtagcagacactcctagttgcccattcaaaatccattttaggtagggcacagtggctaatgcctgtaatcccagcactttgggaggctgaggcaggaggatcccttgggcccaggagttcgagaccagcctgggcaacatagcgagaccccttttctctacaaaaaaatagaaaaaataaccaggtgtggtgggcatgcgcctatagtcccagctactctggaagctgggtggcaattgtgggggatcatttgagcccaggaggtcgaggtgagccgtgatcatgccactgcactccagccttgagtgctcagtgagaccctgtctcaataaataaataaataaataaataaataaataaataaataaagcattctattttccttattaacagaatccccaattttgttcgggtttgaaacccttgagaaagacagcttcatccccaattcaggagtatcacgttagtctcattctgcttgtggttgactcgtgtaggaatggatatgaaaatgagtatatggctatgaaacgtgagaggaaacttgttggggggcttctaaagaaagatgtaggggctgggcacagtggctcacacctgtaatctcagcactttgggaggctgagatgggaggattgcttcagatcaggagttcaagaccagcctgggcaacatagtgaagcccgtctacagaaatgttaaaaattagccaggcgtgggtggtgcacacgtacagtcccagctacttgggaggctgaggtgggagggtcacttgagctcaggagtcaaggttgcacatcgctgcactccagcctgggtgacagagtgagagcccatcaaggaaggaagggagggagggacagaggaaaccaaggaaagtaggaaagaagccaggaaaggaaggagggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattacttgtttgatttaaaatttactttttaaaagtaggaacaaccttctttaaaaaatgggttttacaagagtccacagtgtgtggttacattttgacaaagtacaacgagcaaaatcagcgttgttagaagtcaagagagtggccacctgggggagggcagaggtgcgagtggcttctgggagctggggatgttctctttcttgatttgggttctggttacctgtatgtgtttaatttggagaaatgtatctagttgcaaactttttttttttttttttgagacacagttttactcttttgcccaggctggagtgcaatggtgcaatctccgctcaagcaacctccacctcctgggctcacgcgattctcgtgcctcagcctcctgagtagctgggattacaggtgcccaccaccacgcctggctaatttttatattattaatagagatgggatttcaccatgttggccaggctggtctggaactcctgaactcaagtgatcctcccaccttggtctcctgaagggcttgtaggtgtgagccaccgtgcctggcctctagttgcaaacttaaaattcattttgcacgtgtctctccttactctctaggactgtgtgcagctgaatcagtataccctgaaggatgaaattggaaaggtaaatatccctggggctaggctggctttctgcattcaccaggggcgttcagatactgtggagggaacggggtaaagctgggagcaggagaggagtctttgaaggcgaggttggtggagagggttttgtcattaatgatctaggtttttggtttagttttgttttcttgtatcttaaaattaaatatgtttctgcagaagctcagaaagcttccaacgaaattccatatcgccttggtgatagttacatccccaatacatttggggttttgtttcaccccgaggtactctgacatctagttttgcttttgttttagctaatggggggtatcatcaccatggtcaaaactccaaatgccagtagaaaacaagtaagtaatataaaggagtgaggcatgccagctgtaaggtagtagggagtggtaaggacggtggcaaaccattaacatatggaaatgagggctacatatagctagatctttccattttttcaaaataaactaggaatcttgatttttttttttttttttttagacagggtgttgctctatcaccaaggctggagcgcagtggcgcaatctcggctcactgcaacctctgcctcctaggctcaagcgattctcctgcctcagcctcccaagtagttgggagtacaggtgtgcaccaccacacctggctaatttttgtaatttttgtagagacagggtttcactatgttgcccaggctgttctcaaacctgacctcaagtgatctgcccgcctcggcctcccaaagtgctgggattacaggtgtaagccaccttgcctggcaaggaatatagatttctatatcagacctttctgttttttttttgagactgaatttcactgtgtcgcccaggctggagtacagtgccgaaatcttggctcactgcagcctctgctttcgggtttaagtgattctcaagcctcagccccctgagtagctgggattacaggtgcctgctaccatgccccggctaatttttgtatttttagtagagacgcggtttcatcatgttggccaggctggtctcaaactcctgaactcaagtgatccgcctgcctcggcctcccaaagtattgggattacaggtatgagccactgcgctccgcccagatctttctggttttaaatcttggcaactaatccaaactttgtaaaaacctgggctccaacaaaatacagttgcgggacagatttgaccaatgggctgctggtttgcaacgtctgtattagggttctcattttgcagatcttaacttctggatagtatgtcatgggcatctccctttatccagggctcctatggtgtcgtcaagttggcctacaatgaaaatgacaatacctactatgtgagtatccgcattctcctccctgcccccatccttatccacagaagagcctcctttccagcactcagcttcctggaaagttttcctagctgttgtctcattttattcttaggtcatgtttattttgtgccttaggaaggaagtggtatgcccattttacagataggaaaatggggaggtgaggggattggcccagaaaaagttactcattcagcaaaaggcttttatgcccttcctctgagctgtcatctctgcatcctccatagtattgagaacaaggcagcagtgagacagatgtctgtgtgggtggctttggagtcagtccagcgtagttttgaacctgaatctatcgtgtgccaaccatgtgaccttgacaagtgatatttctccatgtgtaaaacagctgagcctcagtttccccatgtgtaaaacagctgagcctcagtttccccgtgtgtaaaacaaccagtcctgcccctcctttgcccattgctccagctcacttgtgttttgattcgatggcagcaagtcctgaggctcgtggtttcccagctgagagaggcgactttgagcctcaggaacacctcagagctggaggcaccccaggagtccagcctccctacaaccccatggctgcttgaccctctctggtaatgaggggctcactctgttgacctgagcctgccagggggccaggagcttgggccggctttggagtagaggaaccccgactgcgccctccttccccttttcctccctgctttaaccaggacctggctaaaggtgctgtccttcattttcctgcaggcaatgaaggtgctgtccaaaaagaagctgatccggcaggccggctttccacgtgagtttggcgggcctttgttgttaggtacaggggctgggacaagacagggcagagccccctgaatgggaaccattgcactgggcatggtgccacatgcctgtagttccagctacttgggaggctgaggcacaagaattgcttgaacctgggaggaggagtttgcagtgagccaagatcgcaccactgcactccagcctgggtgacagagcaagactctgtctcaaaaaataataaaataaaaatatttattaaagttatataggtatcaagtcaaaaaatccaatagaggaaaacactggcaattcctcaaaaagttaaacatggtgttaccgtatgactcagtaatttcactcctacttatatacccaagagaacaggacatccgtgttcacctaggagcttgtatgtgaatgttcatagcaggtttagccacaataactaaaaagtggaaacagcacacacggcttcagagaatgaatagagtatatatgcatccagtggaatattcatccattaaaagtaatatgaatagagtatatatatatatatatatatatatatatatatatatatatatgcatccaatggaatattattcagccatgaaaagtaatgaagtaccaattcatgccccaacacagaggggtcttgaagacattatgctaagtgaaagaagcctaacacaaaagctcacatattatgtgattctgtttatgtgaaatacccagaataggccaatccataggaacaaaagtagatttgtgattgctgggggctctggggaacaggggaaatgaggggtgaatgctgatagatatcagatatgtatatagatatttagggaggcattgaaaatattctgcagttggccgggcacggtggctcacacctgtaatcccagcactctgggaggccgaggcgagtggatcacttgaggtcaggagttcaagaccagccaggcccaacatggtgaagccctatctctactaaaaatagaaaaactagctgagcgtagtggtgtgtgcctgtaatcccagctactcgggaggctgaggcaggagaattgcatgaaccaaggaggtggaggttgcagtgagccgagatcatgccactgcactccagcctgggtgacagagcaagactccatctcaaaaaaagaaaaaaaaatatgcaatagataatggtgatggttgcacaaccttgtcagcactaaaaaccattaaaatacacattttaaaatggtaaatttagcagggcacggtggctcatgcctataatcctagcactttgggaggccaaggtgggtggatcacgaggtcaggagtttgagatcattctggccaatatggtgaaaccctgcatctactaaaaaaatacaaaaattagccaggcatggtggcatgcatctgtaaatccctggctactcgagaggctgaggcagcagaatcgctggaacccgggaggcggaggttggagtgagctgagattgcgccactgcactccagcctggacgacagactgagactccatctctcaaaaaaaaaaaaaaaaaaaaaagataaattaaaaaaatttaaataccacgaggtatttgaattatatctaccaaaaaaaaaaaaaaaaaaaaaaaaaaaaaagggccagagcacagggagggctcataatggaaaacacagtttttggctgacctttttcttttctcctataggcagccttggttttttaccacttttatttcctggtagctcctgtgtgtggccaaataataggctgcaggtgaaagtataaaaggttgtttaaacataacctccctgccagcattgttgggcaaaatgtcagtttgggccaaaaagaaaaattaaataaaaacaaacggccaggcatgggggctaatgcctgtaatcccaccactttggaaggccgaggcgggtggatcacaaggtcaggagttaaaaatcagcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaatagccgggcatgatgcaggctcctgtatccccagctactcggaaggtgagacaggagaatcgcttgaacctgggaggcagaggttgcagtgagccgagatcgcaccactgcactccagcctaggtgacaagagcgaaactccatctcaaaaaaaaaaaaaaatccttcatgtattcgcatctgcaaagagctttccctaggggagtactaggaggtaaagcagaaaagatatttgatagagtgccctgaattccagtctaataagtttggacttgatctttaatgggggcgtggggggcattaaaggtgtttgggtacaggagtggtctgttgaaagttgtattttaggacaatgagtttaacagtgatgtgtcccagacgggggtagggagagtgaggagatgcgattgtggctgccacaataacacttgtgcgagttaggtggggctgtacatatggttcttcaatcagcattttttctctaaaaaccttaagcaatcctggctatgcagggagatgtctggcggttgcgtaactcacacccagcagccatagagactgtcccttgttgatccttcagggcggaataatgggcattgagatctactgggactgcaacctagaccgttggttccatcactgccgtcccaaatacagtttccgtcgccttgacgacaagaccaccaacgtgtccttgtaccctggctacaacttcaggtaactccaaggcccaggtcaaactcacccagtggctgaatcgcattcccaggaactggtgagactaattttggtttccaaggcaacaagatgaatgaaaaaagactttctctaagaactaggtgataactgaattttttccataattttttaaaattctcaaaagagatgtacactctttatttttttacttatttttttttttttgaaatggagtctcactctgtcacccaggctgaagtgcagtggcgccatctcagtcactgcaaacttccgcctcccaggttcaagcgactctcctgcctcagcctcccaagtagctgagattacaggcggatgcacactgtttataaaacaaaactattgggaaacagaaaagcatagagggggatcaaaatcacccataattcccctaccctgaaataatcaataacaaccctcgggggaattttcctcatctgtaccaattatttcatacagctcctatgagatcatagcatatatatatatatcttgtggtattctgcagggtttttcataccacagccactcaaaattctttgtaaccatcacattaatgatcataacattccattttgtaggtgaacaaataacaactgctacaattcaggaagtgttttcttttcttttcttttcttttcttttttttttttagatggagtcacactctgcttgcccaggctggagtgcagtggcatgatctcagctcactgcaacctctgcctcctaggtccaagcgatcctcccacctcccaagtttctgggaccacaggcatgtgccaccacacccagctaatttttgtatattcagtagagatggggtttcactgtgttggccagtctggtctcgaactcttgacctcaagtgatcttcccaccttggcttcccaaagtgctaggattacagtcatgagccactgtgcctggcccaaggagggttttccatataccaagcactccccatcgccatccctaaatctcccaacaaccctggaaggaagatattgtttctggaagatgatttgcccaagacccacagctgatagtacatgttgcataattctaacccacgtcactctgaccccacactcacactccatcccttccttcccatctcatgattttctcacctacgcctccatgattgaatatttgagttgcttccagtttttctattacaagtaaccacagtgtgcatctttgcacataaacttctctttgaattccaggttacttccttaggataaatttctagacttattgaatcaaaggttgtgaacattttatcatatgctttttatttttaaaaatatctatggttataatgtttcatttttttttctgagacagagtctcactctgtcacccaggttggagtggaccgggtgcaattatagctcactgcaacctctgcctcccaggcccaagtgatcctcccacctcagcctcctgagtagctaggactacaggtgcatgccaccatgcccagctaatttttaaaatttttttgtagagtcggggtctcactatattgcccaggctggtctcaaactcctggctcaagcaatccgcctgccttggcctcctaaagcgttgggattgcaggtgtgagctactgcacctggcctataattttcatttctaggatttttatttggtgctttttcaaagtcatctattattgttccagtgagtcccattcttaccttaaggatcctactccttctgtccattctactgtatcattcctttcataccgacctattatctgaagtaacttgggtgggagttctcctcgtgggctttgaaatactgtcttcagtagaaaagatcttatgcaaagttctgcatgtgctgtgtgttatggagtattccttatatattactcaaagcagcttcatgaactggcaggcagccccttaaatgtgtttctgtttctgtttttttgttttttggtctgcatgatgttttaaaacttgagacaggccaggtgcggtggcttatgcctgtaatcccagcactttgggaggccaaggtgggaggatcacttgaacccgggggtttgaggctagcctgggcaacatagggagaccccatctctacaaataataatttttaaaacatcagccaggtgtgggggcatgcacctctggtcccagctactcaggaggctgaggcaggaggattgcttgaacctgggaggttgaggctgcagtgaaccgtggttgtgccactgcactccagcctgggtgacagagtgagacccttacatggtggccactggctggagctgagtatcagtggtcctatttagaaaggggctgggctttctggttcatcactgtccccgccgctccttagtgcttatacctggcccacatcactcatttctgtcatctgcctggcccctgtgtagacatttgagtttgaaacccttgactcaaaggcaggctgatgctttttgcttcctctggatcaatggaatttcatccaaggcaatggaaccagctcctaattgtgataactttttgatcatcccctgccactgtgctgaataggcttatggccattaagaagagaggacaggatgaatggtcccctgactgactgcccttccagggtgtttttttagctgtcagcagaagcatgcggggcagtgtaccaatcaggtgtcagcaagtgtccttccagcgactgagttgagcacaaaaacatctgctcctggagagacctgagccctctgaaggcctcagccagttatgatgttaatgttcttttagaacaaagtggtagagcatttgttgtctggaatgagcaccagaagaaatctttggccaaaaataaattgttgagggccgggagcagtggcttatacctgtaatcccaacactttgggaggccgaagcaggaggatcacctgaggtcaggagttcgagaccagcctggccaacatggtgaaaccctgtctctcctaaaaatacaaaaattagctggacgtggtgacaggtgcctgtaatacagctactgggaggctgaggcagggagaactgcttgaacccggaaggtggaggttgcagtgagccggggtcatgccacttcactccagcctgggcaacagagcaaagctctgtctttaaaaacaacttaaataaataaataaattgttgaggtctgatgagtaagtggacaagttattttccagcagacacacaaaagagaaggaaattacaggttataggaggtatttcagaaaatataactttctaaaacataggaagttgaagaagttgatcacattacagaattctgttgtttagaaaatgacctgtggcgaaatgtccttattcagtgaataggtgattccgcttatgcacgacctgtgtgaagtggatcaggccacccagaatgcacgatgcgcttctcaggcccagcaggagtatgtgtctgtgttaatttcctgtggctattatgactaattgccacaaatgtggtggcttaaaacaacagaaattaatcttcttatagttctggaagccagaagtttggaatcaagatgtcagcagggccacactcgctctgatgctctacgggagggtcctctcttgcctcttccagcgtctggtggctccaggcattccataactttatagcagcgtcccacaaatctctgcctccatcctcacatggccttctccactgtgtctctatgtcttcaatctcttttttttttttttttttttgaggcagggtttcactccagtctcctagactgaagtgcaatggcgtaatttcgggtcactgcaacctctgcctcccgggctcaagcgatttgatctctcctttatcttataaagatactagtcattggatttggggcttaccctaaatccaggataatctcatcttgagatgtttaacttaattatatctgcaaacactgtatttccaaataaggtcatatcacagccactagggattagatacttgaacatatcttatttgggggctcaacccattccagtgtacgaaaaacactcttgttcaaggcccgatgtttctcagggcatagcccactgactacctgcatcagaataatcacttggtacctgtactggaaatacagactcctagaaacatctcagagcttctgcaaccactctttgggtgaggggctcaggagtctgcctctgaacacactcaccccaagtgattctttctttctttcttttttttttttttttttgagatggagtcttgctctgtcccccaggctggagtgcagtggcgtgatctcggctcactgcaagctccgcctcccgggttcacacgattctcttgcctcagcctcccgagtagctgggactacaggtgcctgccaccacacccggctaattttttgcatttttagtacagacggggtttcaccatgttagccaggatggtctcgatctcctgacctcgtgatctgctgggattacaggcatgagccaccgcgcccagccatcaccccaagtgattcttgccttcagtttaagagcccctgtatcaagactatggaagcagacattcacgtgcttactacacaatgttaaccttcccaggcaaaccaactcacatagggagataatgccaatcccagggcaggcagtggcaatgcatgcttgcttgcgaattaaaaaacaaatcactgcctgggcacgttggctcatgcctataatcccaacaatttgggaggctgaggtgggtgcatcacttgagctcaggagttcaagccagcctgggcaacacagtgagaccatcatctctataaaaaaattttaaaaattagtcgggtgtaatggtttgcacctgtagtcccagctgccgggaggctgaagtgggaggatgacttgagcccgggaggcggaggccacagtgagctgtgttcaagccactgcactccagcctgggtgacagagccagatcctgtctcaaaaaaaacaaaaacaaacaacaacaacaaagataaatcactcaatacatcagcaggagaaaaagctctcttgaaatagtcacatgcaaagaaattgaattccctccagtcagaaagagccactaaagtgcctgagaatatctgatcgatttcaatgtcaggttttgagaggttttttaaaaacagtttcagatgtttcttactattttttggcagaacatctgccatctgctttcttctctccctacatcttgtaactagacggtgaattaataactcagaaaaaataaacatgtatatgtaactttatctaaaaagaatctcaaagtgtggtgagaagaaggggcagatttaaaagttttatgaagcgttcattttaagcctccttaattattcttgaaaaacaaaacacaccacttttcctgactgcagcactggtgagggttgcatatcacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcatggtggagggtgcctgtaatcccagctactcgggaggctgagacaggagaatcacttgaacccaggaggtggaggttgcagtgagccaagattgcaccactgcactccagcctgagccacagagcaagactctgtctcaaaaaaaaaaaaaaaaaaaaatatatatatatatatatagtatttttagtagagatggggttttgccatctcttatatatttttatatatttatattttttatatatttatatatatttatatgtattttatatatttatatatatgtgctgaaatctaaaataagacatatcacttaaaccagctatcataggaccaatggtaaagagcataattagtaaatgcccccttctgcattaatacgtagattgtatgtcacaatttcatgtagcaggtgatgggacttcctgacattcttgggcccagcatacaatctttttatttcttttttagagacagggtctcattgtgttgccctaggctggagtgcagtgtcattatcacagctcgccacagcctcaacttctcaggctcaagtgatcctcccgcctcatcctcccaagtagctgggaccataggcacacgccatgatgtctgactaattttttatttttttttgtggagatgggggtctccctatgttgctcaggctagtctcaaactcctggactcaagtgatcctcctgctttggcctcccaaagtgctgggattataggcatgagccactttgtctggcctacaattccttttctttctttctttcttttttttttttttttttgagttgagtctcactctgtcacctaggctgtagtgcagtggtgtgatctcagctcactgcaacctatacctcccaggcccaagcaatcctcccacctcaacctcccgagtagctgggaccacaggtgtacaccaccacgcccagctaattttttgtatttttggtagagacagggtttcaccatagttgtccaggctggtcttgaactcctgagctcaagcaatccacccgccttggcctcccaaagtgctgggattacaggtgtgggtcaccatgcccagccttcaatttcttcagattattgtataataataaaatttctaaaaacagattactatgagaacaccttgtaatgataaatatttttctttcacatggtgaaatcataacttacatgtatttaactccctcaaattcagttatacatgttccatggggacatggagagagagagaacaatataaataatgcaatgattcagcaaccgggttcgctggagtaggtgtgagatgggatactggcatctggtgttccctccgtcaatctctgttcccacgtgctttttagcgagcatcttgctgctctacttattaatctaggtacatatttttcagccacatgacccctaaaataagtcaactccttcaccttcacctggagcaaaactgtaaaaacagcaacttgttctagatctggaggcaaaattggttccagcagacccactgggaagtgggaggtgtttgctatgctttgtggacaatttaagtgtttaaaaggcaattttgatgagccatgattttcatcttaagtgccaactttagaagataaccttcatataaaagtttctctacagtttgtattttaaaatataaaatggaagaaaaaactatcaccagctttgcttttttcctcttggttaatggactatctattaacgtctcactaaatggccaaatggagtctcacagtacacagtttgggaaatgctgccttaagttgctctgtgaagccttaagttcgtgtaaccatgacttagccatctgtgaaatgggtagacccatggggcataggaattggggaatgtattttgcatcaagtaggactggtgtggaccacaggtggaaatccagacaggctcgagcaatgttcaggatacagcagcaagtgacaggttctggccagctgtccctactggggctgcaaggactaagagccaggataaggagacagggcctcggttattgaaaatgggatacaaagcagggactggttatggcggaaattaaccaagaggctgttcagcttcttctattctcacaaccaattcagatctggattcaaaggcagggatgcagctacaagaggagtttgtgttggaggtctgtgtagataggatgctaagcaggtctgtgtcagccaggatcgtttgggcagtaagtgacagaaacccaacttgcgttaaccacaaagcctcaaaggggaatttattggatcatgtaactggccagttgaagagatggtgctgtcctcggacgtggatgaagataagagttcaaactgtgtcatcaggacggatccgtctccctacatcctggctccatttgcttctatttggcttccttcttgaacaactctgtatgtacaagatatcctcacattctcttcttttaacaacctcagaggagcaaacaagtctttcctgatagctctgctaagaaagtcccaggaaagactctgattgatcagatgtgagttacagatccatccctgaaccaatcactgtggccagggccaaggtgtcatcccattggccagcctgggtcatgtgctggctcccgtagcaggaagtagggagaagacgagggagccgtgtgagccctacgtgaaccacatccagtggattttccttaggaaggaagattctgtgaccagaccaaatggaaaaggaagtggggagggtaggcagacaaaaatcggtgatctattacaaggtctttccaaaagccagaaattagggatttctaagtgtacctctctagtcctggcttgtctcagccctgcagctgggctgtggagactccatcagcaattgctgaccccctattcttacctcggccccttcctgagtcccaccaggagccctgctcctcatctgggacatgcttcttggcccatggaggttgccagctcaccttggtactttactactatttggtttctgtgaccaccaagctgttgcttaaaccaagccgcctatggtggcaccactttggagaattcttttttattttttgagacaggttctcactctggttaccgagactggagtgcagtggtatgatcttggctcactgcagcctcgacctcccgggttcaggtgattttcccacctcagcctccccagtagctgggactattggtgcatgccactacacccggctcatttttgtatttttagtagagacggggttttgccatgttggccgggctggtcttgaactcctgacctcaggtgatctgcccccctcggcctgtcaaagtgctgaaattacaggcgtgagccaccgcacccggctggataattctttagattttattccaagtgggttgagaagccatgggaagattgtaagcaaaggaataaaagttggttgcattctctttggaggatttccctcttccctggagaccagtcctcacagaagcttttccaatggccacagaagactaaggaagattgagagaggcacaggaaacaattccactcagagctgctgcttcgccactgcccagtcagcctccactggcgccaacacgagcctatgctgtcattcctgggcccaggctggctgtcgctgtggagatggtgctgctgtgctagtttgtggctgttaaaatggagctcctggctggacacctgtttcccagtgggtggccacaaacctgtgagtctgggcctcctccagctgagtagaagtgagcccagcacagaggccggggaggccccagacgccaggaggagcaaatccaaatccaacccaagcatggcccctctgaccctgaccatctttttttttttttttttttttttttgagacagagtctccctctgtcacccagactggagtgcagtggcacgatcttggctcattgcaacccccacctcctgggttcatgcgattctcctgcctcagcctccctagtagggactacaggcatgcaccactacacccagataatgtctgtatttttagtagagatggggttctgctatgttggctaggctggtctcgaactcctggcctcaagcgatccatccgtcttggcttcccaaaatgctgagattacaggtgtgagccactgcgcccagcctgcccctgactgccttcagaaaagtagaagcaggaggtctgccacattctcatcccatccttgacacctgggtgatgtgctagagcttgaggggaaggtcagaggtaacccagttcaggaagtgaccccgtaggaggagaagaatccagccacgtgacacacagtacgaagagaacagtaaatgcaaagacctggaaacgaggaacagcaaggacagcatgtcccagaacctggggagagaggagggagcagccggagctgagggcagctcaggggaagagttgctatttgattttcagtgcatgggaagccactgaaaagttttatgcagagaagtaaaaccatctcactcatgtttctagaagccttatgggccactgtgcagagcatagagtgtggtgggacaagaatgacggtgaggaaccagtgagaaggttcctggagtcaccagatgcgaggagatagaggcttgggctagaatgggctggcggagctggagagaggtggacaaagctgagatgtgttttggaggcagaaatgatagatttgccaggaggtgaaagatggctctagattcctgaggaacgatgatgccttttaccaacctgaagaagaccaaggagaggcttgaggactaacacggaactgtgaaggaggccaggcaaaggtggagactgccgtgagctgtgatcacgccactgcaccctcgcctgggtgacagactgagaccctgtcttaaaatatatatgtaataaaaaataataaataaagggccaggcgtggtggctcaacgcctgtaatcccaacactgggaggctgaagcaggtggatcacctgaggtcagaagttcaagaccagcctggtcaacatggcgaaatcccatctataataaaaatacaaaaattagccagacatggtggcacatgcctgtaatcccagctacttgggaggctgaggcaggagaatcacttgaacctgggaggcagaggttgcagtgagcctaaatcacaccactgcactccagcctgggcaacagagtgagaccccataaataaataaataaatacataaataaaggatatcaggcaagcaattaaaacacctgcctactaccatctatccgcatcctttttttcatgtctaacaccaaaacaccaaaatagctggaaacatatcatgtcaaaagataagcatgattctttcaaatgaatggctgtggacttatgaaaagctgcctccgcgtctgattttcttgtttcaaggggtaatgatggaggtttctctcctgcacctgcaggcctccggggatgctgccccagtgcagcctcccaccctgggctggagcctcccagccccgctgcatgggtagcacagtgttgggaagaggaaggagcagtttgtctggctttttcacaggcccacagctggccggtacagtggcagagaaggcgaggctgaggtggggctggggaagccagcaggggcctgatcatggagcgccttgagctgcatcccacaggtactgagaaagcatggagagctgtcccccagcccccagcatcttattagaaaatattgaaacataacagaaaacatgaagggttttatgttcatattttcattttagagagatcattctgcttgaaatataacacctactgagtactgctgaggacttaccatgtgccgggttctgttcttagcatgtgacatgtattggcctatttgattctcctacataatcctggaagattggttgtgggagtgggtgatcatgacctgaacagcctaaccatgtttagggaacactctgtgttatgcgttccaccacacaattcatgtcacagctgaatgtcccagtttcccttgcagctaggacacaacgggagacccaagctttccaaacatatgccccaggcaacactttgatacacaaggaataacactggatgctgggtgtgcacagaattcaaattcaggaatggagggaagtactgccctttgacccatacaataggggatccccttccttggaccccatggcttagagggccccactctgtccctctgcagactgtgagctgccctatggaatgaggggtgtctgaggctgtattaatttctatttgttacacagcagtggaaactaatacagtcccacaggcctaaatcaaggcgtcagcaggctgagttcctgcctggagactctggggaaaattcacttccaaactcatttttgttgttggcaaaattcaatcccttgaggctgcaggactgggctctgctcctcactggctgtcagcctggggccactctcagattctgaagtcctcccacattccctgccacatggtcctctccatctccaagcctgctatgacacaacgcattgttctcatgcttcaaatctctgacttctctcccgggaccagaagaagaatactctcttcttttaaggggctcatgtgattgggtcaggtcaactctatcatatcatggagtctcaccgtcttgcccaggtgggtcttgaacacctgggctcaagtgatcctcctgcgttggcctcccaaagtgctgggattacaggcgggaactgctgtgcccagccaaggccagcatcttcagacctctctgccctgttttcacatggtcttctcctctttgtgtgtgtgtcaaatctccttctgcctctcttataaggacgtgtgtaatagcactcagggcccacctggatgacacagggtcatctcgccatctcaaaatcgttaactttggccaggtgcagtggctcatgcctgtaatctcagcactttgggaggctgagacaggtggatcacttgaggtcaggagttcaagaccagcctggccagcatggtgaaaccctgtctctactaaaaatacaaaagttagctgggcacgcacctgtagtcccagctactcaggagactgaggcaaaagaatctctagaacctgggaggcagagactgcagtgagccaagattatgccactgcacttccagcctgggggacagagtgagacttcatctcaaaaaaaaaaaaaaaaagatgactgggcacggtggctcacatctgtaatcccagcatttgggaggcccaggtgggcagatcacctgggttcaggagttcattcaagaccagcctggccaacatggtgaaagtctctctctactaaaaaaaaaaaaaatacaaaaattacccagatgtggtggcaggtgcctgtaatcccagctacttggcaggccgaggcaggagaatcacttaaacctgggaggcagagggtgcagtgagctgagatcactctgctgcactccagcctggacgacagagcgaaactccatctcagaaaaacaaattaaccaggcatggtgctgcgtgcctgtagtcccagctactgggaaggctgaggtgggaggattgcttgatcctgggaggttgaggctgcagtgagctgtgtttgtgccactgcactccagcctgggcgacagagtgagaccctatctgaaaaaaaaaaaatcggccaggcgcggtggctcacgtctgtaatcccagaactctgggagactgaggtgggtggatcacctgaggtcaggagttcgagaccagcctgaccaacagggtgaaaccccgtctctactaaaaatacaaaaattagctgggcatggtggcaggcacctatataatcccagctactcgggaggctgaggcaggagaatcgcttgaactcaggaggcagaggttgcagtgagccgaggtcatggcattgcactccagcctggtggcagagtgagactccgtctcaaaaaaaagaaagtctctttttacaacttttttgaggtataacttacatatcagaaaatcaccggttttaaatatacatttcaacgacttttagtaaatttcccaagttgtgcaaccatcatcacaatccagtttcagaacatttcatcagcccagtaagagccctcacacccattaacagtcactccccactcccacttcctcctggtggttgctcaacccaggtaaccatgaatctattctctgctctggagatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagagtgtgcatgcagaagggtgtagaaaatgctagacgtgtttcatcttcttgacaaaatgacattgtaagatgtgtgtatatgtttttaaaaatattacataggggctgaacatggtggcccactcctgtagtccagcacagggaggcggaggtaggaagattgcttgaggtcaggagttcaagaccagcctgggcaatgtaggaagacttcatgtctacaaaaaaaaaaaaaaaaaatttcattagccaggcatggtgatgcatgcctatagttccagctacttgagaggctgaggtgggagaaccccctgagcctgggaggtcgaggctacaagaagctgtgttcgtgcaactgtactccagcctgggcaacagagcaagaccctgtctcaaaaatatatataggctgggcgtgatggcttatgcctgtaatcccagcactttgggaggctgaagcaggcggatcacttgaggccaggagttggagaccagcctgaccaacatggcggaaccctgtctctactaaaaatacaaaaaaagttaaccaggcatagtggctcacacctgtgtaatcccagctacacgggaggctgaggtggcagtgagctgagatcgcgccattgcactcaagcctgcactcgaggtgacagagtgactccatctcaaaaaaaaaaaaaaaatatatatatatatatatacacacacacacacacagacacacacacacaatacatatatatatgtgtgtgtatatatatatataacatggttatgtgagtatttgtatgtattttattaacagtaatgttatcattgtttttcagacctgcttttttaaaggctgcagaaaacttcactcttttggttaagaacaacatctggtatcccaaatttaatttcagcaagtaagtggtggccaggtgtgtgagttcaccagggtcttggagaaacttctggctcttctctcttctctgaggttttcgtcgctctgattttctgcttcctctcgactttaggaggaatatccttcccaacatcaccactacttacctcaagtcgtgcatttatgatgctaaaacagatcccttctgccccatattccgtcttggcaaaatagtggagaacgcaggacacagtttccaggacatggccgtggaggtgggtgcgggccctggctctcctgacccagccctggaggcgtctcgtgccaggtgctgaggaaagccttgccgtgtctctgctgctcatccccagggaggcatcatgggcatccaggtcaactgggactgcaacctggacagagccgcctccctctgcttgcccaggtactccttccgccgcctcgatacacgggacgttgagcacaacgtatctcctggctacaatttcaggtgggcgtgagcttgggcccctcgctcatgttgtagggggtgctggtggctgcgtacgtgccagtgggccgcccactgaagaccagcactcaggcagcaccccaagggcaggctgccggtcccccgtccaaggcggcgggaaggccatgctgggaaaatgcccttagtggtgtcctgctccggggccatcccggcccccgagacccctccttgccctttcctgccgcaagaaacatgttgagatggttcttagagcagccaggagaagctgggggcttaagctttccagcacctgcctcagccatgacctccattcactgcctcaaggagcggatgatcttgtgatcctccagtccaaaggcctctggggcctggcccaggaattggtttctcaaaggttgaacctgtgccagaatctccagagtgcaggggacacaggtctgaggcccctgaaaggccttgctgggttccctgctgcaaatgctggcatctcggtgtcctggggcagatgtaagcgagtcccacaaacagtggcttgcaactacaggacttgattctctcacagttctcacagttctagaggccacaacctaaaatccaggcatcagcagggctgtgctcgctctgaaggctctggagagagtccttacttgtctctcctggcttctggtagcccacggtgttccttggcttgtggatgcatcactccagtctctgcctctcctgtcatgaggccttctgccttgtacgtgtctctgtgtcttttcttcttgtaaggatatcagtcactgaatttagggcccaccctactctagtatgacctcatcttaacaaattacgtctgccaatatcccatttccaaataaggtcacactcccaagcttcaggtagatgtgaatttttggggacacactgttcaacccactacagctgatgatctcatgatcagaatctatagccaggtaaatttccacgtaccctttgttgcatttttcacagtccttaaaaaggaagcgctccaggccgggcgcagtgactcacacctgtaatcctagcactttgggaggccaaggcgggcagatcacctgaggccagcatggcgaaaccccatctctactaaaaaaaatacaaaaattagctgggcatggcggcgcatgcctgtaatcccagcaacttgggaggctgaggcaggagaatcgcttgagccagggaggcagaggttgcagtgagccgagatcgcactgctgcactccagcctgggcgacaaagcaagtctccgtctcagggggaaaaaaaagaggccctgcaaggaccatccctgggcgcggtcagcggtgctttgggctgcacttgcctccccctagtggtgacgtgtggaatccgatccatacgggatcctaagacctctgtaattgtgggatctgctgtccttttgaaccttctggctcactgagtaaagcagatatttgaatttttcttttctagcagttagatttgtgttattccatctctactgtcacacacttcttgtggaaacctcaagcttaggtcagagccctaaaacggaaagacctcaggacgcctatcccccaacctcgggcagcaccaggccctgcctgtgtctcccaggcctggcccatggcgtggaagttgtgggccagatagagcatggagctagggtgcgggccgaggctcctgatggatccctggagaacatggggcagcagatggtatgtcttgacggttcttcaccaaccatccatcccctgctcatgcgtgtgtgctctctcgcgtgctcgctctctctctctctcatatatgtatatgtatatatgtgtatatatatatatatatagccattatatatatagccattatatatatatatatttttttttcttcttcttttttaagggagtgacttgctctgtcacccaggttggagtgcagtggtgcgatttcagctcactgcagcctttgcctcccgggttcaagacattctcctgcctcagccgcctgagtagctgggattacaggcgcccgccaccacacccagctaattttttgtatttttattagagacggggtttctccacattggccagggtggtctcgagctcctcacctcaagtgatccacctgcctcggcctcccaaagtgccggaattacaggtgtgagccaccgcacccagccatatatttttaaatggtcttactgagatgcaattcacatgccataccgttcacgcatttgaagtgcagaattcatagttttcactatattcacagataagtgcaggcttcaccacagtcgattttagaacatttccgtcatctcaaaaagaaaccctgcacccttctgtcatcccccggcccctggcaacagtggtctactttctgtctctgcagatgtgcctcttctgagcatttcatataatcaatatgtggccttttgcgtctggctccttccccttagcctgatgttttcaagcttcatccatgtcgtagcctgtgtcagtacctcgtctctttttatggccaaatcatattctgctgtgttgacagacgacgttttgttcatctctttatctgtgtgacgaacgagtggttctttttgttgttgttgttgttgttgaagactgtgtgcacagaatcaatgtttctttgaaaaaataaataaatttaaaaagccctaggtcaagagattgagaccgtcatggccaacttggtgaaaccccgtctctactaaaaaatccaaaaattagctgggcatggtggtgtgcgcctgtagtcccagctactcgggaggctgaggcagaagaattgcttgaactggggaggtggaggttgcagtgagccaagattggtgcccctacactccagcctggcaacagagggagactccatctcaaaaaaaaaaaaaaaaaaaaagtccctgcactgatgctgtgttggggctggcttagtcccctcctgcaatgctggctggtcacattcttactgttagatgttggaggtcagggtcccttgagggaggcaggcaggatgtaccaggtgggatgttgagagcaaactgttcaggttcaggagaggacactggtgctggaggaggaggtctccctgtgcccctgtacctcgtgggccccgcatcctcctgcttgcacagcccgcctcagccaggagaggccccgagccgctccagcgtccattcagccggcagagtggaccattcacctgtgccagctccactctaacgttctctcacagggcccaaggtcctgccccagccatctccccctgatccatcctccttcccctcaggtttgccaagtactacagagacctggctggcaacgagcagcgcacgctcatcaaggcctatggcatccgcttcgacatcattgtgtttgggaaggtagctcgccgccactggctcccctccgtcactccctgcagggacaaggggcctctccctgcccctgcagaaacactttttttctttttcggtgtcttggcaggcagggaaatttgacatcatccccactatgatcaacatcggctctggcctggcactgctaggcatggtgagtggtttaggccctgccttcaccctcacggtgaggtgagaccctgggctggggtcctggtcctggccctaggccctagacctcagatgtgtttctaaacttgaccctcctaccttctttcccttggcccccagccctcctcccaccttcccttctccaagaccacccccctcaggtcccagccttctcccaagagatgggagtgcctttccattccggtaaagattccaggcttctcaggaaggggcacgcaaagaataagatgggttgatgggttgcaagcatcctggctcactctcaccctatgctaaactcaggcgaccgtgctgtgtgacatcatagtcctctactgcatgaagaaaagactctactatcgggagaagaaatataaatatgtggaagattacgagcaggtaggcccctcctggcccccagcaggcacaggcctctcatctcttgggtgtgggagccctgggcgtgggcctgtctggggaggcccttctgcagaggctggcaccagtgtggcgtggtgtccccgttaacccgggcagtcctgccactctcagcagctgctccatccctaggcccctgtactagattgactctttaaacccagcctcgtttcaatgaacgacatctcaggttggtgatgataatgcatgctctgagaatgcctgtgggcacacactacttcagtgcaccttgcggaacaggaagggttgggttccaggcctgggaccaacttgagaacccctggcggtgaagtcccaggagcgcacctccctcccgcctgccacaaggggtcccaggggcaccttgatctgcttgtgtccttctttgcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaatccctgtctgttgtctcatagcatgtgctagaactttccttcctacccttttacgacaaccagtaaatccactattccggctcactgtgctcagaaaaggtccatgggatggtctgtttctggcacttatgcacattttcccctacttctttatttatttattttatttttgaggcagagtctcactctgtcgcccaggctggagcgcagtggtgcaatctcggctcattgcaacctctgcctcccgggttcaagcgattctcctgcctcagcctcccgagtagctgggattacaggtgcatgccaccatgcccggctaatttttgtatttttagtagagacagggtttcaccacattggccagccaggctggtctcgaactcctgacctcaaatgatccacctgccttagcctctcaaagtgattggattacaggtgtgcgccaccacacctggcctatttattttttttattacccaggctggagtgcagtggcgcaatcactgctcactgcagtctccacctcctgggcttaagcgatcctcctacctcagcctcccatagtgctgggattacaagcatgagccactgcacccagctgcctactttttaaagcctaataatttgtcattagcttgtcttcctgcacagttcacaggacactttttctctagtgacatcttacctgtgcctccattttgacataaaattacaattctatgctgtgggtaacacaatttttggtaacatggaagtggcttcctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccagttaagattttaatttatgatctgccacacttttttctataaacacaaaaatttgaagacccagtacacatattgccctgttatatttttccatttaattatctcaaatatctttccacagcatactatcattattttattttattttatcttgagatggagcctcattcagccgggcgcagtggctcacacctataaacccagcactttgggaggccaaggcgggtggttcacctgaggtcaggagttcgagaccagcctggccaacatggggaaaccccgtctctactaaaaatacaaaaaattagccaggtgtggtggtgggcgcctataatcccagctacttgggaggctgaggcaggagaattgcttgaacccaggagatggaggttgcagtgagccaagatcacgccattgcactccagcctgggggacagagcaacactctgtctctaaaaaaataaataaataaaaaataaaaaagcttttcaatagttttgccttgctggactcactgggttatgtctgtaatcccagcactttgggaagcagagctgggagaattgcttcaggccaggagtttgacatcagcctgggcaacatagtgagaccccatttcttttttttttttttttttttttaagaattttaaaaaacgggcggggcacagtggctcacgcctgtaatcctagcactttgggaggcccaggtgggcagatcacctgaggtcgggagttcgagaccagcctgaccaacatggagaaaccccatctttactaaaaatacaaaattagccaagcgtggtggtgcatgcctgtaatcccagctacttgggaggctgaggcaggaggattgcctgaacctgggaggcagaggttgcggtgagccaagatcgcaccattgcactccagcctgggcaacaagagcgaaattccgtctcaaaaaaaaaaaataaaaataaaaaaagttaaaaactaaaaaaaaaatcataaatgttacacattttcaaccaagtaaaacgaaataaaatatatagattttacattatttccattctatatattacaattttttctttgtggcacagtgacatgaaatttcattgtgaaatttaaaaagaaacaaacaaaaatttgttgtgaaaatcacatacaggattgatgaatttggggctgcctcttgttttcagcagtatcagacaattcccccacactgcctcttgcagtcacaggttattccccatccaccttttattctacgctgcctatcaaagggtgtgatctctgaggtcttttacagcctaaagaccgaatgtcaaatgtgctaagatgtcaagatccaggtattagaatatgtccagctcatctgcaggaatatcatccttccccatctcctccatttcaacaacctgtaattcctcccacccactgaatgggagaaaacatctatagatcatatatctgatatggaatttgtatctagaatatataaagaagtcttacactttaaaaccataatacaagtggccggcatggtggctcacgcctgtaatcccagcaatttgggaggccaaggtgggtggatcatctgaggtcaggagtttgagaccagcctgatcaacagggtgaaaccctgtctttactaaaaatacaaaaattagcagggcatggtggtgggtgcctgtaatcccagctactacttgggaggctgaggcaggagaattgcttgaacctgggaggcggaggttgcagtgagctgacatcccgccactgcacaccagcctgggcaacagagagagaccctgtgtcaaaaaaacgaaaaggacgttgggtctgatggggttgagaggattatctgtgatcaacatatggcctgttagataagagtcagggtttttctgttctgtttttttgctttttgttttttttgttgttgttgttccacaatagattcagtctcaagcactacccagggaaagcaacagcaaaattataaaataatttattcctcacttctgctatcaacttgttctttatttagacgttctgtttctggaagtatatataattatactgtgtgccacacgtatctgtcattctgttatacaatgacgtatttcacaatgtctatgtgccagataagcgagtcttacatctttaaatgcctaaacatttaatttaaacattttttcattgtagattctcctaaacaaatgacactgtctcttctgactggccttttgcggctcaaggccattgtaacaaatgtcagtcttacataaccataaccaaatgacaccctaaggcacactgaggtctctaaactaaatggccccagactgatgagcttttcggagttcttggctctgctttttatagaaacatttcttttttatgggctatttgtgtatcgctgctcttagtattggtggcctggggcaacgcgtcccacctctttctaatttgctgcattcaaacaaatgtttgttttaccacctacgttactggtgacataatacattttttatctgttagatcctagggctatagacatagtcttttcaattccaagtttcagaaggctactaggttaagtaaaaaatgaacacttattatgagattatgggggtatctcaaaggtaaaggtgaacggggggaggaggcagaaccaagaagtggaagctcaacagaaaccagaggccgttcccttcgtctctctcacctctgtgcatctttgcccggctgtttcatacttttgcttctgcagattactgttctcagcttctccatgcatacgatggttatgtcaaatcagttccagtcacctgcagagaagaaagagttgtcactatcccaatgccaaagccagaggagagactggcccggctgggtcagtttcccacctgtggtccagtcagctgtggccaggaggataaggtcacatagtataaaaacagctgctgcaccacctctgcgagaaatgacagcctagagaaagcaggtactgatgaactggcttcaccagcaacaaaggaaccagaaaatcaaaactgctccaatcgcatctgaactaaaaagaggccgggcgcggtggctcacgactgtaaccccacgctttgggaggccgaggcagatggatcgcttgaactcaggagttcaagaccagcctgggcaacctggtgaaaccccatctctaccaaaaatacaaaaaattagctgggcatggtggcgtgtgcatgtagtcttagctacttgggaggctgaggtgggaggattgctcgaacccaggaggcggaggttgcactgagccgagatcatgccactgcattccagtccaggtgacacagggagaccctgtctcaaaaaggaaaaaaaaaaggtaagcttggtgtgagggcctgagatgctcccctgtgaagaaggaatatgacgtctggccccatggattcgtggtatatactttgcttttcttgagaccttggttgtttactccctgtttactggaattattactgagacataactcacataccataaaatttactctttttaaatgtacaattcagcggcttttagtatattcacaggttccgcaactatcaccactttcttttccagcatattttcatcaccctaaatggaaaccttgtactcaccagcagccactttccatcctttctttcccccagcccctggcaaccactaatctactatcagttttgttttgttttgttttgagacggagttttgcccttgtcgcccaggctggagtccaatggcgcgatctcagctcaccgcaacctccgcctcccaggttcaagcgattttcctgcctcagcctcctgagtagctgggattacaggcgtgcaccaccatgcccagctaattttgtatttttagtagagatggggtttctctatgttggtcaggctggtctcaaactcctgacctcaggtgatctgcacgcctcagcctcccaaagtgctgggattacaggcgtgagccaccacacccggcctctactttcagtttctatggatttgcctattccagacatttcctatacacagaatcatacgataagtgccctgtggcatctggctcctctcactcagcgtggtgttttcaagggtcatccgtggtgtggcgcgtgtcagtgcttccttcctgtggctgaatcatgttccattgtatggatggaccacattgtgtttatgtgttcattagttgatggacatttagattgtttccactttttggccattatgaatgctgctatgaatactcatgtacaagtttttgcatgaacatttttctttttcagaggaggggtggaagtttatttgaaatgccttaggatgggaaaggaagctgtgcttggaagaggcccaagtgggcatgggaaggttaaagagacaaggtcagatgccaaacagcttttcttttcttttttttttttcttgatacggagtctcgctctgtcacccaggctggagtgcaatggtgcgatctcggctcactgcaacctcccaggttcaagtgattctcttgcctcagcctcctgagtagctgattacagggattacaggcatgcaccaccatgcctggctaatttttgtattttgagtagagatggggtttctccatgttgcccagcctggtttcgaactcctggcctcaagtgatccacctgcctcggcctcccaaagtgctgggatgacaggcgtgaaccacggagccccgcccagaacatatctttttaattctctggggaaatcctagaaaaggaatatcttggtcctacggtaatttttatgtttaacattttgaggaactgctgttttccaaagcagctggcccattttacattcccacgagtaaaaagcagctggaccattttacattcccatgagtaatgtgtgagggttccagtttctccacatccttgccagctttttgattgtccatctttttaattataaccatgctagtggggaggaaatggtatctcactgtggctttgatttgtatttccctaacgataatgatatcgagcatcttcttgtgtttattgatctcatgtgtatatcttctttggagaaatgtctattcagatatgtttgcccatttttaaatagggttgtcatgttattggtgagttttaagagttcttacgatatctgaaatactagatccttaacagatataggatatgtgaatattttatcattctgtgggtttttccctttcttgatggtaactttgaagcacgaacttttcagttttgacaaagtagtccaatttatctatttttttcttttgttgccttgctttaggcaacaaaatctaaatctaaaaaaccactgtctaatccgaggtcacaaagatttgcccctatgttttcatcagagagatttataattttagctcttatatgtatgtctttgatccatttttaattttctctctttccttattatttttattatattattttttttaagacagagtctcactgtgtcacccaggctggagggcagtggcacaatatcagctcactgcagcctccgcctgctgggctcaagcaattctcctacctcaacctcccaagtagctgggattacaggcatgcactaccacacccggctaacttttgtatttttagtagagatggggcttcaccatgttggtcaggctggtctcaaactcccgacctcaagtgatccacctacctcaacctctcaaagtgctgggattacaggtgtgagccacacctggccaatttatttttttaaaaattttatgtagctgggactacaactacaggtgcgtgctaccatgcccagctaatttttgtactttttgtagagatggggtttcaccatgttgcccaggctggtctggaactcctgagctcaagtgagccacccacctcggccccccaaagtgctgggattacaggtgtgagccaccgcatcccgccttcttatttatttttgagacagggtctcactctgtcacccaggctggagtgcagtggcacaattgcagctcactacaaccttgacctcctaaactcaagtgatcctcctgcctcagcctcccaagtagctgggaccacaggcatgcaccagcatggctggctaatttttaaagtatttatagagatgggggtctccctatgttgtccaggctggtctcaaactcctgggctctagcaatcctcccaacttagtctctcaaagtgctgggattacaggaatgggccaccatgtctggtcaataaagttattttttaaaaagagataatccaagagcaacagtgtaaacaaaataacttttccaaatcattttttaggatcagcttctttggtcaggcctaatgatgttaccaactagtaatttataaaaacttgcatttctacatttttcttaactgaccccattccaaaacacaagcaaaccatctaaattcaagatttgtgaggttgggactaactcattactatagggtaagtatgaatgaaggctggaaatgtgttttgattgctgccattattttttatttttattttttctgagatggagtttcactcttgtcgcccaggctggagtgcaatggcgtgatcagctcatggcaacctccacctccccggttcaagcaattctcctgcctcagcctcctgagtagctgagattacaggcatgcgccaccacgcccagctaatttttgtatttttagtagagacggggtttctccattgttggtcaggctggtctcgaactcccaatgtcaggtgatccacccaccttggcctgccaaagtgctgggattaaaggtgtaagccacgtgcctggtgttttttggggtttgtttgtttgttttgagatggagtctgtcacccaggctggagtgcagtggcacaatttcagctcactgcaacctccgcctcccaggttcaagcaattcttcctgcctcagcctcccgagtagctgggattacaggcacctgccataaggcccagctaagttttttatattttcagtagagatgaggtttcaccatgttggccaggctggtctccagctcctgacctcacatgatcatccgcctgcctcggcctcccaaagtgctgcagttataggtgtgagccaccgtgcccagccatgttttgattcttaaggaaatgatttttaagtccccttccaatgaggatttagcaatggagttttcttcttctacagataatttgaggcttcccaattgcaccaaactccatttgggcagatacctcacctgtccactccatagccctagcatcaagaaaagtgccaagcacacaacaggcactcagtaaatttctgtcaaatgaatgaataaaataccaccaccttttcctgagaccattttggaccaaggctggcatgggcatctctgttcctccctctaacttaagaattccatctcttagaggcagatgctgcctgttttctgcaaattttattattcacctttctatatttggaaaaacaagttggtgtggcttacttaggaatctcatatccaggaaatgagctaaaaatgttgtatcaaagattatgcataggatccacaaactaagaagcaagcagatgagagcggttagagacatcgtggtatattttccggaagaaatggtccatggattaaaaattgtcattatgatgagtctgcagtaacacagaaaccacgtagtgcgaatcagaaaatgaaaagcacagccattgactatgattacaaaccaaaactttataccaattacctgttggaatttatgctgcatgaaggcaggatattttgcttgtcctgttcactggacagtacttggcataaaggatgtgcttatgaatattttctgggaaactaaatataacattcacctgtgaaaacacatctgggccaggcgcagtggctcacgcctgtaatcccaacactttgggagcccgaggcgggtggatcatgggaggtcaggagctggagatcagcctggccaacatggtgaaaacctgtctctaataaaaatacaaaaattagctgggcgtggtggcgggcacttgtaatcccagctactcaagaggctgaggcaggagaattgcttgaacctgggaggcggaggttacagtgagccgagatcgcgccactgcactccagactggacaagagtgaaactccgtctcaaaaaaaaaaagaaaaagaaaaagaaaaaacgtatctgaagggaatgaacaaatacacatgcggaaaattgtattcatggggtagaacggtggctgtttccccccctttcactattttctctcctaaagttgtgatagcattttctcagtggaaaggatgaccacagaattatctcccctgggctgcaactaaggaagtatttggagtgagaatgcgaccaggcttcaaatccaggaggggtattttacagggcgtgtggctctcacccagggctcacaggacacctgatatttaggctgttccccaagaggctaaggacagcgcggccccagctcccccaaccacagctgcccaagtttaggagcccgcactcgtgagcgatggctactccgcacagccccggggtcctctacggaaatccctggcacctatcagtacccctaagggaggtcgctcgttacccctcacttgaactctgtcccaaatgggaggtcactctctcttcgcggaccccatcttccccgaaagggtctcttgttctctctggccctcctgagaaggtcattactccccaactcgccttttttggtttctggtttattgaggcagggtctcgcttcgtctcccagactggagtgcagtggcgcgatcacagctcacacggcagcctctacctcctgggctcaagcgatcctctcacctcagcctccctgggactacaggcgagcgccactacgcccgctttttttttttttttttttttttgtatttttgatagagacgaggtctcgctatgttgtccaggctggtctctaactcaagattcctctcacctcggcctccgcaagtgctgggatgacaggtgtgagccaccgcccccggcccctcgcccgccttttgaaggagcctttcgtcctcaagggcgaggccactccccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaccggcgccgtgcaactgctcatcctggcctacgtcatcgggtgagcgtggggccgcgcggggggcgcggcgggtgctgccctcgcgtccgcgccgtgcggcggctcatcctggcctcggtcacctgggcgagtccgggagcggcgagccgaggcggtgacaccttccctgggccccagccgccgcgccggggccccgggggcgggaggctgcttgctgctgttttaaagccacagcctgggccaggcgcggtggcgcaagcctgtaatccgagcactttgggagcccgaggcgggaccatcgcctgagcccaggagttcgaaaccaatttgggcaacatcgtgggaccccgtctctgcaaaaaattaaaaatcatccgggcctggtggcgcgcgcctggggtcccagctactcaggaggctgaggtgggaggatcgcttgagcccaagaggctgaggctgcagtgagctatgatcacaccacttaactcgagcctgggagacagtccgagacccgtctgtttacaaaataaataaaggcaaagcctggctaggctgttaccctctcctgcctgaccccccatagtgccccttggctgtaggggcttcgccctgaacgtctcaatcttcgctctccacttcccatcctgctgatttgctgacaaaaccaaagcttggaatttccgcttggttccttctgggtgggtggcttttggtcatttcttttgatcactatgcggtgtcactatgtggtagtagcgaggtcagactgtagcgagtgtttaaagtttgcttcctttgttttctggggttgtggggctttttgtggtacctgccctagcctagtcagtcattccccatgctgcccccttaggctagagatgccctaccgccctcaggcctcgctgaatgtgccattgtacttgaaggcacctgttacttttttaatttttttatttttttgagacggaatttctctcttgtcgcccgggctggagtgcaatggcacgatctcggctcactgcaacctctgcctcccgggttcaagcaattctcctgtctcagtctcctgagtggctgggattacaagtgcccgccaccacgcccggccaatttttgtattttttagtagagacggggtttcaggctggtcctgaactgacctcaggtgatccgcccacctcagcctcccaaaatgctgggattacaggcgtgagcccccacgcggggctggcacctgttacaattgaatacaacgcgagagagaagatgataattaccttgccacctggggccactttaaaggcttacctggggtgttctggtgtctacagctgctgggctgacacgtattgcctagtgcagtggtctccaaactgcacattggaaccatctggaaatctttggctcccatccccagacccttttttatttttttgatggagtctccctctgtcgcccaggctggagtgcagtggtgcaatcttggctcgctgcaacctccacctccctggttcaagcgattctcctgcctcagcctcctgagtagctgggattacaggcacccaccaccatgcccggctaatttttgtatttttagtagggacagggtttcgccatgttggccaggctggtctcgaactcctggcctcaggtgatccacccgccgcagcctcccagagtgctgggattacaggcgtgagccaccgcgcccagacgcatccccagaccttctgatttaattgctgcagagtatgatcggctgcccaggtgattctcatgttcagcaacgtttcggaaccaatgaactgtgtttcccaagtttacctgatcatggaagactcatctgaggaattgtttaaaagtaacagatccccccgtctttggggtgaggtttggaatcttaacactgcccaagggaagcccaagcaggtttggcttccaatatctgtcagcagcagcagtagatacagacagtattcaagaggatggctttccaggtgcagactcaacatcagaaccacctggcccacacccagatttggactcattggctcacacctgtagtcccagtgctttgggaagccaaggtgggaggattgcttgaggccaggagctcaagaccagcctggacaacatagcgagaccccatctctaagagaaaaataaagtttaaaatggtaaattgtactgatggagcagtgcaaaaaaaagaatttttttttttttttttctgaacacggtggctcatgcctataatctcagcactttgggaggccgaggcgggtggatcacctgaggtcaggagttcgagaccagcctggccaacatggtaaaaccccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaagattacaagcgtgagtcaccagacccaaccccagctctgccatctctatggtgttaccttcatcagcatgatccaaaatggttcccaccagaactgaattctaaaaaggctggaagcactttaggaggctgaggcaggtggatcacctgaggtcaggagttcgagaccagcctggccaacatggtgaaacctcatctttactaaaaatacaaaaaattagctgggcgtggtggcacgtgcctataatcccagctatttgggaagctgaagcaggagaattgcttgaacccaggaggtggaggttgcaatgagcggagattgcactactacactccagcctgggtgacagagcaagactccatttttcaaaatcaataaatcaataaaaaattaaaagcctggaagaaagaggaaaggagaaagagaaggcatgttcctcccttgaaggatgggatctgtcactgccacttgcaggtcattggccagagcgtagtcacatggtcacacctacctgcagtagaaggtaggaaatgccatcctcattctgctgaccatgttccctaccgaaaatcagggagccagacattgaagacaaccaagaattcctgccaccagtacccatgaaacagtcctctgagctggggctgaatgagtcctacacatggaaggaaatctttgggtttccaggggatctgggcagctctgaggcatataacatagcccagccaggaaaaagctcccaaaagagaatttatttgtccaggaatgtacaggcaaaaaatcaccattctgtgtttttccatggggtagaggcctgaccaacctcatgtggtttgttccgtccagcttggcactgacagaggctggtggggcctgggggagggtctgaaaatccagggtctcaggtatgaactactgctctgatcaactgctaggctgtgtcctgtgggaatgtgctgggtttctacatgacccagaggtcactgatttcacaagatctgcaaacaatccaatattcaaatatttaactatagcagagattgatagatttttctgccatgcccagtatccccctatagctcaatctgaaatcaacagaccttcatatccacagctgtggcttattggaccattccctgatccaccagctgaacgagagtcatgctgtcctctgaggctccaccatacctggaatagacatctcttggtaggaccatgcttcctgtgttctcagttgatatggctcagattgagctgtccccttccgcaagtcccaggggcaggtccaggatccagtcctagataatcaaagcacaatttttccctggctactgtgctttgttcaagagcaggcacatgattcaggttggtctgagacaagtcttggaattttggctaaaatcattgaaaaagtggtgctctttgagttggagttgctaagctggcaggacataagcctaaagctcttggtggccgtcatgccagcagggaattaagttgactcagagaaaaccagaggcagagggtaatgatggagggatttctgatgacatcatttgaacacactgatcaagccatacctgaaacctcactagatttaggagccaataacctccctttattgcttaagccaattggagcaggcatacatatcacttttgaccaagagtcttggctaatctagcatctttgtgtcccttcataacgtggcttctcactttgtatctgatgtggcaattattcctgagcacaattaatgcgtcctccttggctacgagaatttttttttcttttttttttctttttagatggagtctctctctgttgtccaggctggaatgcagcggtgcgatctcagctcactgcaacctccacctgctggatgcaagtgattctcctgcctcagcctcccgagtagctgggactaaaggtgcatgccaccacgcccggctaatttttatatttttagtagagacagggtttcaccatgttggtcaggcaggtctcgaactcctgacctcaagtgatttgccctcctcagcctcccaaagtgctgggattacaggcatgagccaccgtgcccagccagctatgagatcttgaaaccagaattcctcctaggtgccagacacaactcaggtgtttggggaatgcttggtgaatgagtggctggatcgatgaatggatggactgatggatggaaataattaagataatacacgtccctccagaacatcaagcctccaattgcagcctatgcttctccaggcctttctcagaatccttgccccattcttgtgttcattcactgaggtaataaatgtttattgctcactacaatgtgtgaggctgtgtgccagggagtgtggcacagtggattcctcagcctagacactgtggacacttttgttttttgtttttgttgttattgtttttgagacagggcttcacgctatggcccagctggagtgcagtggcacaatcacagctcactgcagcctcaacctcctgggctgaagcaatcctcccgcctcagcctctcagttagctgcgactacgggtgcatgccaccatgcctggctaattttttttgtatttttttgtagagatagggtcttcctatattgcttaacctggtctcttaatcttaatcttaatctggtggcacccgggctctggagtcatatggacctggatttgaaccccagctctgccccttcatcttggtgtgaccctggacaacttgcttagcatctctgggccttgatttcttcatctgtaaagtgaacattggtggcattttgcccatatagttgttgcgagaataaccaagataaaatgaccccttactatgtgctatttacaaatgttagctgtaattatgcttttgctttccaatttaactagccaggtaggtaggtaagtagggggagagagagagggagagaaggaggaaacagcaaaaataaaagcatttttttctctgataatttgaggaaaatatacttgtctagaccagtggttctcaactagggatgactgtgtgccccagggacgtttggcaatgtctggagacatcttagttgtcacgactgagggagtgctactggcatctgcagccaggggtgctgctaatctataggacaacccctgtgacaaagaaatacctggttccaatgtgcacagtagccaggcatggtggctcacacctgtaatcccagcactttaggaggctgagacaggaggatagcttgagctcaggagttcaagacaagcttaagcaatacagggagaccctatctctacaaaaaatacaaaaaaattagccaggcatggtggcgtgtgcctgtaatcgcagctacttaagaggctgaggtgggaggattgcttcagcccaggaggttgaggctgcagtgagctgtgattgtgccactgtactccagcctgggccacagagtgaaaccctgtctcaaaaacagcaacaacaacaacaaaaaacaaaagtgtccccagtgcctaggctgaggaatcctggtctatcatacattgacatctctgatattaagggccacagtgcaaggtacagtgtctggcacatagtaggtgctcaatgaatgtttgacaaccacatgaatgaatgaatcaatcaatcacagaatggatgaatcatcgaatgaatgaatgattatatagttcatttgtcatttggctgagtgcctgggacagggctgcatccgagcagctgttcattaaataggtatggacaggttcctgtaaatgttcccttctgaagcagctggggagtgaggtcctggcgggggaacacccggcctcacagctgtggttccaggtcatgataaattgctgtgggaagccacagagcagacagctcatcacacattgtaatggattcattgtcttctctcgtggccccctttatctcaaactctcagcagacaagggttaaaagggagtgagctgagtgagggcctgtggatgctgctcttcaggaaaaggagggaaaatgagcccagacaggatcatcgttaaccggctccaaggtcaagagccgggttagaacgttagaattagagatgggggcagggatggcggcgggactctctccatcaccacaccctatctaattcatttattcaacaaatatttattgagtaccagagactctttgggcatatgtgagttaacaaaacagatgaaatccttaccctgttggaatttatattttaaagaagcaggatgaacaatggacacataggccggacataccatgtgtgaggggccctgtgcattaggagaaaaatcaggtagggagggaagataaggcatgtttggggctgagtttttccattgaggtgaaattcaaataacatgaaattaatcatttaaaagtgaacaattggccagcgcggtggctcaggcctgtgatcccagcactttgggaggctgaggcgggaggattgcttgatcccaggagttagagaccaacctaggcaacacgacaagactccatctctgtttttttttaagtgaacaattgagtggcatttagttcattcacagtgttatgtaaccactatttctgtctagttccagaacattctcatcaccccaaaaggaaaccccgtacccatttggccattcctcctcctccagcccctggtaaccgttgcttttctttctctgtgtgggtttgtctgtttttggatatttcacataaatggcatcatacactatgtggccttttgtgactagctcctttcacaagaatctcaccttgttttcaaggttcattcatgtggtagcatgtgcctttcattcttttttatggctgagtaaaattgaatcacatggatagaccacattttgttaatccattcgtctgtttagggacatctgggttgtctccatctttggctactgtgaatagtgctgttgtgaacatttaggttacaagtatctgtttgaggccaggcatggtggctcacgccagcagtcctagcactttgggaggccgaggcgggtggatcactcgagatcaggagttcgagaccagcctggccaacacggtgaaaccccatctctactaaaaataaaaaataaaaataaaaatggtatctgcttgagtccccattttcaattctttggggtaaaaacctaaaagtggaactgctgggtatatggtaattctatgtttaacttttttaggaatggccagtttcccacagcagcagcaccattttacactcctatcagtaatatacaaagcttccaatttcttcatctcctcaccaatacttgttattttccatttttaaaataacagtcatcctagtgataggaagtcgtgtgtcctgtggttttgatctgtgtttccctaatacatatcattacgtggtgagcatcttttcatgtgcccattggccgtgtatatatatcttcttagatagtcctttgctcacttttgacgttggtcatttgtctttttgttactgagttaaaagcatggagctaacttatttttatttatttttatttttttatgttttttgagacagagtctcattctgtcgcccaggctggagtgcagtggcgcaatctcggctcactgcaacctccgcctcccaggttcaagtgattctcctgcctcagcctctcaaagtgctaggattacaggtgtgagccatgacgcccagcctgaacttttaaatagggtgatcagaaaagacctccctaagatgatgactttttttttttttttttttttaagatggagtctcacactgttgcccaggctggagtgcagtggcgcgatctcggctcactgcaagctccgccttccgggttcacgccattctcctgcctcagcttcctgagtagctgggactacaggtgcctgccaccatgcccagctaattttttgtatttttagtagaaactgggtttcaccatgttagccaggatggtctacgatctcccgacctcgtgatccacccaccttggcctacccaaagtgctgagattacagggtgagccaccgcgcccggccagatgatgacttttaagtgaagaccttaagaaggtgatgggggatgccaaggtgatatctgagaagagcattccaggcagagaggatgtcacatgcaaaggccctgaggtaagtcactttcatttgtctgcaactcggttttcctgtctgcaaatggggaggaataaaaccatgaagcatcacgtcaaatgctggcaaattatcaacacctgggttccccacaactcttgctcttaagcaagatacttaatgtctcagagcttccatttgctcacctgtaaaatggtgataataattgtaccgacctcacagtgttatcagattaaaagaaatatgatttgccagggcttggcacacagtagtgttcagaaatgcagggtttgaacccagaccaggaggacttccagtcctgaggggcgatcacagctcactgcagccttgacctcccaggctcaggtgatcctcccacctcagcctctcaagtagctgggactacaggcatgtgccaccatgcccagctaatttttgtatgttttgtagagatgggtttcaccatgttgcctaggctggtctcaaactcttaggctcaagtgatgtgcctgccttggcctcccaaagtgctaggattacaggtgtgagccactgtgcctggctcccctccctccctccctcccttccttccttcccttcttttttttgagttagagtctcactctgtcccccaggctggagtgcagtggcacaatcatggcttactacagccttgaactcctgggttcaagccatcctcctgcctcagtctcccaagttgggattacgggcacgagccactgcacctggctcagttcccctcatttctatgggagagtctgaagggtttcatagtgtgggggcctgtggtccatcctgactgctaccctgtacacacacatgtgtctgcccaacaaataccattcggggaaataacaaaacacaagatctatctttttcaacacaagttaccatggtgttttgctttgtcttgttttttggtggcaaatagattgtgggccttggggtctcaagtgagtgttcagatcccagcttccgtgctttactggttgttggacctccggcagcacccaagaggactttgggccttatggggccacacagatggttatcctggtatgaagaaaaggacaagaaacccgagcagtttgggtggcaagggaagaacaggagagagaaattccaatcagcctatttaaaatgccgtgcagagcctagtgagagtgaaacgacaatccactagtttccagcccttatttttctccctctagaaagaactaggaattaggaatctcagattcgagccatcactttgtccaaagctaactctgtgcccttgagcaaatcccttccactctctgcctcagtttcccaggaatccctttgtaaagaccttttcctctctgtaaccatggtggtgctgctactgaccagcagagggcagtgttgcaccaacattctctatggctctgcattgcttttgcctgaccttggacgggaacattgaaatcattaattagtggtcagtgtcatcatctttttcaaaaggccttattttatcctcagtgcatagtcagaacaaggtcttgccacagtgtacagatgaggaagcagagcctcagaaacataagaaacttaattactggtaattttggtcacaccacgtcctaaatttagactctcagaatggtatgaacccattgctgtgtgtctgagcagcaaagcattgataatccattacctgctttatgcatcatgaagcactttctgatcctcaatatcagacaattctcatcttattctcctccagtttgtaaatgagcaaactgtggcttctagaggctatatcatttgacttacagcttttttttttttagagaggcccaggctggcctcgaactcctggcttcaggtgatcctcccacctcagcctcccaagtagctgggattacaggtgtgagccattgcacctggcaccagcatattcacaatcagttccatcttagagactgtttggtggactcccaaaaatattagtttaaaaatgacagagcctggcgttttgcaatttttatgtgatgaaatgtactgagttctcatataaatattgctccttgttttgcaaaaggaattaggcccctttccctgtctcagcagctgcaccggttattagcaatcccctagggaactggaatagctttagatcaacagtggttctcaaaagggactatcaaatgacacacctgtccccagctccagattccgatatccacaccccaaacatccaatcactgtttctcatagtcttttgatgttttttgtttttgttgtttttggtttttggtatttttttgagacaaagtctcgctccgtcgcctgggctggagtacagtggtgccatctcggctcactgcaacctccacctcccaggttcaagctatcctcctgcctcaacttcccaccatgcctagataacttttgtaattttaatagagatagggtttcaccatgtaggccagtctggtctcaaagtcttttttttttttttttttttttttttttttgtcagagtctcgctttgtttaccgagccagagtgcagtggtatgatctcggctcactgcaacctccacctaccaggttcaagcaattctctggcctcagcctcctgagtagctgggataacaggtgcacaccaccttgcctggctaattttcgtatttttaatatagttggggttttaccatgttggctaggctggtctcgaactcctgacctcaagtgatccacccacctcaccctcccaaagtgctgggattacaggcgtgagccaccaggcccagcctaattttttgtatttttagtagagacagggttttgccatgttggccaggctggtctcagactcttatcctcaagtgatccagctgcctcagcctcccaaagtgtggggattacaggtgtgagccaccgcacccggccttctgcttgatcaattctgctattaagactctgatgcattcttcagtatgtcaatttcattttcaactctagaatttcctcttgattctttttaattatttctatttccttgttacattcatctgataggaaatctgaattccttctctgtgtcatcttgaattgctttgagtttcctcaatacagctctttcaaattgtctgcctgaaaggttgcctatttttgtttctccgtgattggtccctggtgccttattcagtttggtgaggtcatgttttcctgcgtggtgttgatgcttatggatattcatcagtgtctgagcagtgaagagttaggcatttattgtagtcttcacagtctgggcttatttgtgcctgtgattcttgggaaggcttttcaggtattcaaagggacttgaaccccgaacccaataaaactgtagttctgcggactcgtaaaggtaccaccttagtggtcttggagaagatccagaagaattctctgcattaccaggcagagattcttgttcttttcccttgctttcttccaaacaaatggagtctctctctctctctctccaagctaggcctcttggaactgggggtggaaggacacaagaacccctgtggccatcaccactgggactgcactggttcagacctgaagcagcccagcactgggtctcacctaaggtctgctagaactgctacctggccatcacctgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccccatctctaccaaaaatacgaaaaattagcttggcatagtggcgcacacctgtggacccagctacttgggaggctgaggtgggaggattgctgtagcctgggaggcggaggttgcagtgagccaagattgtgccactgcacttcagcctgggcgacagagcgagagcctgtctcaaaaaaaaaaatatgtggctcgcgttatgtttttattggacagcgcagctctgtaggattccttatgacgcattcactatctcggtcatgagaatctttaaagcagtaaatgctttgcttttgtccgtcttgctataatcaaaactgactcaggacctgcattaaggctctttttttttttaacctcatctcttaactttttgatgcaactcatcttagtgaaattgtggtctcctcctacagcaaccctccctcaaaaaaagaccgaacacacaattctcatctatctaactctgttaacaatcatatgaggaggaaataatcacatgataatgagtggcatgaaaccctgtgtctctaaattaagcaactcactgtacttgatgagtacatcagtcttcctgccccaagcttttgtgtgtcagactggaattaaatggaagcttacactgcagctgaattcctagaagccctggacttgtcaggggaaaagcccatggggggaaagcccatctctaggctgggcaatgaacttggagactgctcgatcacacacactcataagtaacaaaaccattaatttcttttcttttttttggtggagggacagagtctcactcttgcccaggctggagtgcagtggcatgatctcagcccactgcaatctccacctcccgggttcaagtgattctcctgcctcagcctcctgagtatgtgggactacaggcacccaccaccacacccagctaattttgtgtatttttagtagagtcggggtttcacaatgttggccaggctggtcttggactcctgacctcaacaaaaccagtgaatttctgaagtctcagcatctaggacttagaagaaggagaagcctagcatttcctgattctataaataacaacactgatagtctctagtagatgtttaacagcagttcgaaggggaggggttctgatttgtagtactggccaatttccacggtgtcagtacttgctctgtgaccaacgatgactcacaaacattgttgtaaacatttgacctacattaattcttttaccctcacaagaatcctgtgaagatctactatcattcccagattatagatgggaaaaactgaggcacaattggaggttaagcaccttggccaaagttatgcctcgtgaatggtggagctgagccatgaaccaagacctctgcctccagtctgtcctaacccctataagctaatgcctgtagatggttttttttttttgagacagagccttgccctgtcgcccaggctggagtgcggtggcatcacagctcactgcagcctccgtctcccaggctcaagtgatcctcccacctcagcctcccaaatagccgggatttttattggacagcacagctctgtaggattccttatgacgtattcactgtctcagtcacgagaatctttaaagcagtaaatgctttgcttttgtccatcttgctataatcaaaactgaccatgcccggctaattttttattttttgtagagatccctatgttgcccaggcttgtctcgagctcttgggcacaaatgatcttccccccttgacctcccaaagttctgggattacaggcgtgagccactgtacccagcccctttggatttttaattgttcaaactggtagtcatagtcccacttcagaggagagaaccatatatgtgaccagaattcttgggggaaaagtaagaaactactcttaaaagttccttaaaggatagaattctcttttctagaaagagtagcctagggttgtccaatcttttggctttcgtgggccacactggaaggagaataattatcttgggccacacattaaatatgctaacactaacaatagctgataagctaaaaaacaaactttttttgatcacacaaaaaaaaatctcataacgttttaagaaagtttacgaatttgtgttgggcctcattcaaagccatcctgggccgcatgcggcctgtgtgctgtgggttagacaagcttagagtagagcatagtgggtgagagaagaggcttcagatgcttctggcttgagttcaaatcctgactctgccactcactagctgtgtgacctttggcaagtgacttaacctctctgtgtttccatttcctcctctgtaaaatggaaataataataatgatacctgtctcataaagtggtcaggattaaatgagttaatacatataaagagcttagatcagtgcctggtgcctataaacactccagtggtaactgttataatttgtattatctcttggtgattcccataggtcacaggcattgaaagtgctcaaagggccaggtgcagtggctcacgcctgtaatcccagcactttgggaggtcgaggtgggtggatcacctgaggtcaggagttcgagaccagcctggccaacatggtgaaaccccgtctctactaaaaatacaaaattagccaggcgtgttggcgcatgcctgtaatcccagctacttgggaagctgaggcaggagaattgcctgaacccgggaggcggaggttgcagtgagccaagatcacaccattgcactccagcttaggcaacaagagcgaaacatcgtctcaaaaaaaaaaaaagagaaaatgctcaaatgtaataaagacagtattcatcgagcgttttctctgtgccatcagtgtgctgagtgctttacctgcaccatctcatttatttcccgcaaaccctcctgtggtttaggtgctaccatccccatttggcagaagtggaaatggagtcccctagaaggtacgtagcttgtagaaagtcatgtaattagtcaacatcgtacttccagccactggccagcagaagcttccccatcaattcaaatccattgaatcctaatggcaatttaagaggcctgttttattttataggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggtgtgtctcccactgtgtcttctgtctaacactgacaccttgctctttactgactttgcacacttgattaatgattgacgtggcctgagtcctgacatcaccaatgcccagaatgattgttttagtccaagaaaacggtgcagccagatctcttttcagcttaggatctaacagagtgtatccaggcagctgtggttcctcagcttgaaagcatggcaggctgaaagccctgaaagatgagaaaacaaatgtcttaaatcctgatagaaattcaagtggaaatatcacctttccacattttgggtttgcattattgtcccaaatacacgaggtaaatcttttcagacagtgtaaaaactttaggccgggcacagtagctcacgtgtgtaatcccagcactttgggaggctggggcgggcagataccttgagcccaggagtttgagaccagcctgggcaatgtggtgaaaccccatctctataaaaaaaaaaaaaaagaaaaaaaaaaaaaggaattagagaccattagagaccaaaacccaaacaagaaggaaacagagacagcagcacaggactccattgggagcgaaaggaagggaagacattgtttactgctgcatactagtcttcaggctgttaatctgcaaagctccaagttaaacattgactctttagtcctggtaacagctctgcaccacacagtcaaacccgacatagccctccagatggcctatgtgctaagggaccgagggcgaccagtagagataagctgccaactcttggctcagagctcttgccagggaaaacaagaactccagaaactctttcttcaggtgtgttcttccccctgccttctcaagagaagggtcttgtggggtccccagagtggagaccgagctaatgagccataaaagtcaggaggaagggccaggtgcggtggctcatgcctgtaatcccagcactttgggaggccgaggtcggtgtatcatgaggtcaagagattgagaccatcctggctaacatggtgaaaccctgtctactaaaaatacaaaaattagtggggtgtggtggtgggtgcctgtagtcccagctactagggaggctgaggcaggagaatctcttgaacctgggaggcggaggttgtagtgagccgagatagtgccactgcactccagcctggtgacagagcaagactccgtctcaaaaaaaaagatcaagtggaacaggggatttgcagttggctggagggggcagtcctgttagcatgtacctgtctcagcagagagacggttgcctcctgtgcaggcatagccttgtcccggtgagctctgggaatgtcatgctcggtgtgtttactgggcagatgaggaagggcacaagccccgcttttgtcccttggtggaaaggagcaccccacaactcagccttccgtggtggatctgggcgggggccgtgtgagttccccagggctttcctcatgagctttcacgacgtctgtgttctttgtagatggaacacagtcatctatttgcagccccttggctcatctccagactgaaattacccttaatttgaagtagataagtgataggaaacaggccagatgtggtggttcatgcctgtaatctcaacacttttggaggccgaggcagaaggatcacttgagcccaggagtttgaggctgaagtgaactgtgatcacgccactgcactccagctagggcaacagagcaagaccccaactctaaaagagagagaaagaaggagagataggaaacgaaaagtagaccatactggattgttccaagtataactcaggagagtcgtaggagcggccttctctaacaccaaatgcagagtgtgtttgtacattgaacacctgggaacgtgacaggtggcgggagagaggctgcagctcatgccacatcctcacgcctcctcctgtggccttctccttgtctcccaacatagtttgccctaggcctttggaggacgccagctatttctagagcttccaccacttgtcagaccgtggggttggggatgtctacagactggttggtttctgagttgccctgatccccaagatggctcccactactgactgttatcctcaggagtgtgaaatgctaaaagctttgggcatctccttttaaaatgcctgggcccagccaggcgcagtggcttacgcctgtagtcccagcacttttggaggccaaggcaggaggatcacttgagctcaggattcaagaccagcctgggcaatatagtgagaccccatcttgattggatgggtggtggatggatggatggatggatggatggatggatggatggatggatagatagatagatggaaagaaagaaagaatagataaatgataggataggagaaagaaagggaaagaaagaaaagagaagagaaaagaaagaaaagggataggatagatgacagatgataggatagattagataggtgatagataatcgataaatagaaaacagatgatagatataggatagattagatagatagatagacagataatagatagattagattagatggatggacaccagcccccaatgagaggaggatccaactagaatcttttggggtctttgccttttattccttatatgaggaggtcattatcagcaattcttcagtctcatccctagcaaattgctttccagaaactctaaatcaattatttggcacctttatacatataaggaggaaacagaaccttttcaaagagaaatgtcacttgctgaccctgaccgagtcttctctagaatgtttgatttataatttcagttaggaaagaaaaccagccagatttgagccccatgaggcctcatgtttttattcctctgagataatctggttggcagggaatgtttttagcacttgttggctctttccctcagtaagtcaagtttgattgagaaaccattgtttcagtttgcagacccccccctttttttaactgcagtcaaattcacttatagaaactaaccattttaagtcgggcacagtggctcatgcttgtaatcccagcactttgggaggctgaggcaggtagatcacttgaggccaggagttggagaccagcctagccaacatggtgaaatcctatctctactaaagatacaaaaattagccaggtgtggtgatgtacacctgtagtcccagctactcaggagggtgaggctggagaatcgcttgaacccaggaggcggagattgcagtaagccaagatcgtgccactgccctgcagcctgggcgacagagcaaggctctgtctcaaataaataaataaataagaaagaaattaaccattttaaaatgaaaaattcagcacatttagtgcattcacagtgttatgcaagcatcacctctatctagttcaaaacatttccatcaccccaaagggaagcctcgtatgttacacaaccactccccattccccacttctctcactccctggcaacccgtaagtgctttgtctctatggacttgactgttctggaaatttcacatcaatgtaatggtatcctgtgtggcctttgtgtctggcttctttcactcagcatcatgtttttggggttcatccatgttgtagcctgtatcagtgctttattcctttattttattttttgagatgaaatctcactctgtcacccaggctggagtgcactggcgtgatctcggctcactgcaacctccacctcccaggttccagtgattctcctggctcagcctcctgagtagctgggattacaggtgcccgccaccacacccggctccttttgtgtgtgcgtgtgtgtgtgtgtgtttgtgtgtgtgtgtgtgtgtgtgtgtttagtacaaagtttcaccatgttggccaggctaatctggaattcttgacctcaggtgatcctcctgcctcagcctcccaaagtgctggaattacaggtgtgagccaccatgcctggacccttcattcctttttattcatggctgaatcacattccatcatgtgactagactaggacagacatttgggctgtttccaccattttttttttttttttgagacagagtctcgtgtcatccacgctggagtgcagtggcgcgatgtcggctcgctgcaacctccgactcccgggttcaagcaattctcctgcctcagcctcccaagtagctgggactacaggtgcccgccatcacacccggctaatttttgtatttttagtagagacgggagtttcactgtgttgaccaggctggtcttgaactcctgacctcgtgatccgcccgcctcagcctcccaaagtgctgggattacaggcttgagccaccgcgcccgacctgtttccaccttttggctcttgtgaaaagtgttgctctgaatatttatgtacaaggacttgtttgagtcactgttttccattgggttataaactttgatgggagagagcgggagagcacgcggtcagtgtttgagttgtcctcttcagtcagcgtctgcctttcttggctctccgtgagtcctctgagcgtggcttgcccgtgctgtctcccctctgcaggaggaaaactccctcttcgtcatgaccaacgtgatcctcaccatgaaccagacacagggcctgtgccccgaggtaggaggcccccgggaagagccccaggccccacacccctctccacgcctgtccacctgtgtgtggggccgggccacgtggactttcttttcgctccttctttttccagattccagatgcgaccactgtgtgtaaatcagatgccagctgtactgccggctctgccggcacccacagcaacggtacgagcttgtggcctcctggggagggcagcccctgagcagatcgcccccactgtggagcgtctctgatagagaaatcttcccaattccttcacatgaccctgggtgagccaggtgccgaggctggggtcctggagcccctctacattcattgctgtcattggagccccacaagccatcccagctcttgccctactgttttttttgttgttgttgttgttgttttttcttgttttttttgttttgttttgtttttttgtttttttgagccagagtctcgctctgtcacccaaactggagtgcaatggcatgatctcggctcactgcaacctccacctcccagtttcaaacaattctcctgcctcagcctcccgagtagctgggattacaggcatgcaccaccacgcccagctaatttttgtacttttggtagagatgggttttaccatgttggccaggctggtctcgaactcctgacctcaggtgatccacccgcctcagcctcccaaagtgctaggattacaggcatgacccactgtgcctggcctcttgtcccattctttagcttggcatcaccctggctgagatgtggctggcacacaggtaactgtcttcctccgattctaactcctggacagtgacactgtctaaatcccagatttgcacagctcaagactggctgcatgggaggctggatggggctctcactccctactccaaaaaggtagaaaataggagacccctgtggacatgggacccccctgccacccttgtgcttgtaggagtctcaacaggcaggtgcgtagctttcaacgggtccgtcaagacgtgtgaggtggcggcctggtgcccggtggaggatgacacacacgtgccacagtgagtccagccctagggaaggaagtgcctttttgttttgttttgttttagacacagtttcactctgtatcccaggttggagtgcagtggtgcgatcttggctcaccacaacctccacctcccgtgttcaagtgattttctgtgcctcagcctcccgagtagctgagattataggcacccaccaccacgcccaactaattttttgtatttttagtaaagacggggttttgccatgttggccacgctggtctccaactcctgacctcaagtgatccacctgccttggcctcccaaagtgctaggattacaggcgggagccaccacacccagccagaagccaccacacccagccggaagcaccttcaactctgcgtgtcagccttgaacagaggtggtcaaggagttacacctgtgtgttgtggctttttgtgtgtttctggtgtctgtatgaagtcaggctgccctaggatggctgctctcaaccacaaggcagcgaccatcagtggcaagatgggccacaagtagtctgtcactcacgagaagggtgcaggtgactgacttccttgtatgttaggactctgtcagttgcaaataactgacaggaaacagttctcagtgccttaagcacatgtgcacaaacacatacacacatacacatgcgtgcacagcgggggggcagtgtattgtccggctgaccaaaaagatccagcgtggccaggagaatctcgtgccaggctgaggcagaagaatctcttgaacctgggaggaggaggttgctgagctgagatggtgccactgcactccctcctgggcgacagaggccactgcactcctgcctgggcgacagagtgagagacaaaggacaacaccctagtctcccttcctggctctgcatcccgccgtgccagcttcactcgcaggacccacagcatagcccgggaggcagcgctgcacttacagccccccaagtctgagtctccctttccagctgtccctggagattctagacctgtccatcatcgtatcaatggccatatctctcaacccatctctgtggctggggaatgggttttgcttatcagcttgggcctgggtcacatgcccacctctgcagctggggctagagtcagacccacccaagtgacataggcaagcattggggagatatggcttccaaaggacatttggggttctgttaccagaaaagctgggagcagatgctgggaagaaaacaacggatgtttgctacagtgtattttaaactaaactagacaggttcatcctggcgcggtggctcatgctgtaatcctaacactttgggaggctgaggcagtcggatcatctgaggccaggagttcaagaccagcctggccaacatggagaaaccccgtctccactaaaaatacaaaaattagggttagggtggcgctcgtctgtaatcccagctacttgggaggctgaggtaggagaattgcttgaacccgggaagtggaggttgcagtgagctgagatcgctcttctgcactctagcttgggcgacagagagagactctgtctcaaaaaataaaaatttaaaaaaataaataaataaaaatttaaaaatcaactaaactagccaggttcaaggttgctctagaataacattcttcgtggttgtaattggctgtgcttcatggggtggagtccgggcagcgctctgagaagtgcgtgcagcctagggcctttctcaccgagagctcagaccgaggtctccatgagccccggggagcaggaagccactgaacctcatcctgggtgtgttgagacagaaggaaaggctgagaactgcagatttagagattgctaaggcaaaggaaggagatagaaaaagaaaaggaatcctagcatcttagagctggagaggatctcacagagctgtgctctccaacacaggagactctggccacgcgtggctattgaaaattgaaatatggctgggtccgaaaggagatgggctgtccataggaagtgcacttatcatcaaattggattttttttttttttttttgagacgaagtctcgctctgtcgcccaggctggagtacagtggcgtgatctcggctcaccacaacctctgcctcccgggttcaagtgattctcctgcctcagcctcctgagtagctgggattataggcaccccccaccacaccttgctaatttttgtatttttagtagagatgcaggtttcaccatgttggccaggctggtctcgaactcctgacctcaggttatccacctgcctcagcctcccaaagtgctgggattataggtgtgagccactgcacccagcccgattctgtttattatttatttattttttatttatttgtatttatttatttatttgagatggagtctcgctctgtcgcccaggctggagtgcagtggcgccatctctgttcactgcaagctccgcctcctgcgctcacgccattctcctgcctcagcctccccagtagctgggactacaggcgcccaccaccacacccagctaatttttttgtatttttagtagagagggggtttcactgtgttagccaggatggtctcgatctcctgacctcgtgatccacctgccttggcctcccaaagtgctgggattgcacgcgtgagtcaccacgcccggccctgaatatttattatgaaaaaaagaatgtataatatctcattgatttttgtatgttggttacatgttgaagtaatattttgggttactgtataaaattttacttgtttcttttactttgtagtgtggctattaggaaactttaagttggagtgtggcttgtagttgtgtctcataagatactttttttttgacacaggatcttgctctgtcacccagtgcagtgataacgatcatggctcactgcagcttcgaactcctggactcaagtgatcttcccgcctcatcctcctgtgtagctgggaccacaggggcgcaccaccatgcccagccaacttattttttgtagagacagggtctcaccatgttgcccaggctggtcttgaactcctgggctcaagcaacccacctgccttagcctcccaaagtgctgggattacagcgtgagccaccacacctggcctcacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaaaaaaaaaaaaaaaaaaattataggacttgacaagagcagatctccaagacattttgttaaaagaaaaaaagcaaactgtagaacaatatatgttatatgatatataggttaaaaaaaaatcactagacacagaagctaatctgtatattttctgcatgtatattctatatatacacaagtgtacacacacacacacatacatatacatatgtgtgggtgtatatatgtacacaaaattgtaccagtggctgcttctggaaaggagcttagggtgggggagtaggagtagtcaaagagattttagcgtcatctgtattgttttgatttgattaattcagactttatcaagcaggtcctctgcgttcaactccatgattttccccaaagataaatctctggtacctaaaaacaaagacgattggctagacgtggtggctcacgcctgtagtcccagtactttgggaggccaaggagggtggatcacctgaggtcaggagttcaaaaccagcctggccaacatggagaaaccccgtctctactaaaaatacaaaaaattagccaggcatggtggcgcatgcctgtaatcccagcttctctagaggctgaggcaggagaatcgcttgaacccaggaggtggaggttgtggtgagccaggattgcaccattgcactctagcctgggcaacaagagcgaaactccgtctcaaaaaaaaaaaaaaacaaagacgatttctttgtctttccctcatccaagaacatgattgtcctgttccagcagctgatgcacaattcactgtccattgtatatgcattcacaatttgaaataaaagttcatctttgcagctaaaactaatcaccacttcatggcccaagatgagatgaaatttaacaaacatgtaaataatttaagttgcaatagtacaaatttctggagatactgaatctagagttactgaaattgacagaatacaacaaagaaattttatgcagcaactggggggtccaatgtaaaaacattaagcagtaagctgtggctgtgttgaatttacaagttaagatgcatggggttccgcctggcgtggtggctcactcctgtaatcccagcattttggtaggccaaggcgggcggatcaactgaggtcaggagttcaagaccagcctgaccaacatggagaaaccccgtctctactaaaaatacaaaattagctgggcatgatggtgcatgcctgtaatcccagctactcaggaggctgaggcaggagaatcatttgaacctgggaggcggaggttgcagtgagccaagatcatgccattgcactccagcctggcaacaagagtgaactccaactcaaaaaaaaaaaaaaaaaaaaagcatggggttccatttctgatttatctttagattcagaaatcattaattcttggttaatgagagttttgagccagcttgttcaatagtctatcatttggcaaataggaattacagttgcctttagataggcaattcttgataattctgtacaaaaatgggtaaactttcacaccatcttttcctagacattaaagtatgtgtcctttgtggatgaatcccacattaggatggtgaaccagcagctactagggagaagtctgcaagatgtcaagggccaagaagtcccagtaagttaaatcattttgtctttttttttttttaagaaaatttactgttaaatataaacacatctagaaacttgtacaaatcaaaactgatggattttaacaaagtaaacatactcatataaccggcactcagattaaacaattgaaaattactagcaggagtcccttttatgcccccttccaatcactaccctctctttctccttttttaatttttaaaatttggctgggcacggtggctcacacctgcaatcccagcactttgggaggccaaggtgggtggatcacttgaggtcaggagttcgagaccaacctagccaacatggtgaaacctcgtctctactaaaaatacaaaaattagccgggtggtgtggtggcacacatgtaatcccagctactcagaagactgaggcaggagaactgcttgaacccaggaggtggaggttgcagtgagccgagattgtgccattgcactccagcctgggtgacagagcaagactccgtctcaaaaaaaaaaaagaaaaaaatgtatattcttaaattacaaacgaggtctcactatgttgtccaggctggtctcaagcagtcctcccacctcagctgtaccaagcccaccaactgccctctcttaaaagtagtcattatcctgtttccaaagattaattttactttggctagaattttctaaaaactgaatcacgtagtatgtaagcggtatatacgcggttgagtgtctggcttcctttactcaacattatttttgtgagagttgttcatgatgccatgtatagttcattctcattgtataattctgttttataaatatccaacttattcagccatcctactgttgatggacatttgggtagtgtccagtttggggctaatgccaataacgctgctatgctcaacatatggcactctactggacagttacctaagagtggaattgctgagtcataaggcagacatatgttcggttttaggagatactaacaaacggtgctgaaaaatggttgttcacatttgcactctccccagcagttctggttgctgggcatcttcaatttcctagggctgaattaccacaaactaagtggcttaaaacaacagaaatggccaggcatggtggctcatgcctgtaatctcagcactttgggaggctgaggcaggcagatcacctgaggtcaggagtttgagaccagcctgaccaacatggagaaaccccatctctactaaaaatacaaaaaaatagccaggcgtggtggcaggcgactgtagtcccagccactcaggaggctgaggcaggagaatggcatgaacctgggaggcagagcttgcagtgagccaagattgcaccactttgagaggccaaggtgggcggatcacctgaggtcaggagttcaggaacagcctggccaacatggcgaaaccctgtctctattaaaaatacaaaaattagccaggcgtggtggtgcacacctgtaatcccagctactcaggacgctgaggtgggagaattgcttgaacctgggaggcagaggctgcggttagctgagatcacacctctgcactctagcctgggcaacagaacaagctccatctaaaaaaaaaaaaaaaaaaaagtcttttctgctccttttgaaatatcagtgagttttcttctttttttctgttagttgaattgtactgattgattttcaaatattaagccaaccttgcattcctgaagtaaactcaatttgaatgtgttgtactattctttgtatttattgctgaattccattcactaatatttaggatttttacatctcttcttgagaaagactgaccaaagtgtttccattcttgtaatgttcttgttggatttgtgtatgaagtgaactacagtcatgcatcacttaatgatggggatatgttctgaaaaacgcatcagtagctgattctgtggttgtctgaatatcatggactctatttacacaaacctaaatagaatagcctattatacttaggttatatggtgtagtctattgctcctaggctgcaaacctgtacagcatgttactgtactgaatacggtaagcaactgtaacagaatggtaagatttgtatatctaaatatagaaaaggtacagtgaaaatatgatataaaagcttaaaaatggtacatctgcatagggcacttaccatgaatggagcttgtaggactgaaagttgctctgggtgagtcagtgagtagtgagtgaatgtgaaagcctaggttgttaccgtgcactacagtagacttcataaacactgtacacttaggctacactaaatttacttcaaaatatttatctttcttcaataataaattaatcttagcttactgtgactgttttactttataaatttttaaattttttaaactctgtacagtggtataaaaatattttctttctcaccgggagtggtggctcatgcctgtaatcccatcactttgggaggccgaggcaggcggatcacaaggtcaggagattgagaccatcctggccaacatggtgaaaccccatctctactaaaaatacaaaaaaatagccaggcatggtggcaggcgcctgtagtcccagctactcgggaggctgaggcaggagaatggcgtgaacccaggaggcagagcttgcagtgagccaagatcacaccactgcactccagcctgggcgacagagcaagactccatctcaaaaaaaaaaaattctttctctatatccttattctatatacttttttctatttttaacattttttatttttatttttactttttaaatatttttgttaaaaactaagtcatggccgggtgcagtggctcacgcttgtaatctcagtactttgggaggctgaggtgggtggatcactcgaggtcaggagttcaacaccagcctggccaatatggtgaaactctgtctctactaaaaatataaaaattagccgggtgtggtggtgcacgcctgtagtcccagctactcaggaggctgaggcagaagaatcgcttgaacccaggaggcggaggttgcagtaagccaagatcatgccactgcactccagcctgggagacagagcaagactccatctcaaaaaaaaaaacaacaacaaatacacacacacacacacacacaaaaaccatttccaatagtgctaagtcctatgaagaatgtggaataccacagtgtgataagggaatcatgtgggagaaaagctgctagatagggtggtcaggacaagaggtgatatctcaacagaggcctggcttttctgaatttcattttccaaaatctgtaaaataggccaggtgcagtggctcatgcctgtaatcccagcactttgagaggctgaggcaggtggatcacctgaggtcaggagttccaaagaagcctggccaacatgttgaaatcctgtttctactagaaatacgaaagaattagctgggcatggtggcgtgcacctgtaataccagctacttaggaggttaaggcatgaaaattgtctgaacctgggaggtgaaagttgcagtgagccgagatcacaccactgtgctccagcctgtgcgacagagtgagaccctctctcaaaaaaaaaaaaaaatctgtaaaataaagacaaggatacattatctcacaagcgtcttcaaaggcctgaatgaggcaatgcttacagaacacatgcatggtcctgatatctacacctaataaatgacggctactataaatcatgtaatattaaatgtaactttataagttaataaaattaaagaacctagaacctgagggcttgtcatggctaataggtttggaaacttgctttttcagagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccaaagagtgaagggcagtacagtggcttcaagagtccttactgaagccaggcaccgtggctcacgtctgtaatcccagcgctttgggaggccgaggcaggcagatcacctgagatcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtcccaaaaaaaaaaaaaagagtccttaccaatagcaggggctgcagtagccatgttaacatgacatttaccagcaacttgaacttcacctgcaaagctctgtggccacattttcagccaaagggaaatatgctttcatcttctgttgctctctgtgtctgagagcaaagtgacctggttaaacaaaccagaatccctctacatggactcagagaaaagagattgagatgtaagtctcaactctgtccccaggaagttgtgtgaccctaggcctctcacctctgtgcctctgtctccttgttgcccaactactatctcagagatattgtgaggacaaattgagacagtgcacatgaactgtcttttaatgtgtaaagatctacatgaatgcaaaacatttcattatgaggtcagactaggataatgtccaactaaaaacaaacccttttcatcctggctggagaatgtggagaactaaaggtggccacaaattctttgacactcaagtcccccaagacctaagggttttatctcctccccttgaatatgggtggctctgattgctttatccaaaagtggaagtgacattgtgtcagtttcagatcctgatcttaagaggctgacagcttctacttgctgtcccttggaactcttgctatcggggaagccagacgccatttaaaagtctgcctatcctggccaggtgtggtggctcacacctgtaatcccagcactttgggagaccaaggcgggcggatcacttaaagtcaggagtccaagaccagactcgccaacatggtgaaaccgtatctctaataaaaatacaaaaattagctgggcatggtgcgggcacctgtagtcctagctatcaagaggctgagacaggagaaacacttgaacctgggaggtggaggttgcattgagctgagatcgtgccactgcactccaggctgggtgacagagcgagactccatctcaaaaaaaaaaaaaaaagaaaaaaaaaatgtctgcctatcctgagactgccctgctgtgaggaagcccaagcagtcacgtggacagtgcctgaccagccccagctttcaagccatccaagcccagtcaccaaacatgagagagaagaagccttcaggtgattctggactccactaacatatgactgataccgcatgatacatcccaagtgagaactgccccataaatccagaaaaccacattgctatcttaagtccctaagtttggggcttatttgttccacagcaacaggtaactggaacagagggcaagcctgatgaatgggcacacagactcagcccataccttccctggttctaatgttctcagggagcccggaccaaccctgggagcctcaggaacttaggtttccactggacagttctagaagggctatagaccaaatcaggtaactcaccagaccagccttggaatctatcaaatctaactgctgagctacccagtgcattccgatcctcatcacaattctttgactgaaggccgggcgtggtggctcacgcctgtaatcccagcactttgggaggctgaggcgggtggatcacctgaggtcaggagttcgagaccagcctggccaacatggtgagaccctgtctctactaagaatacaaaaattaggtgggtgtggcggtgggcgcctgtaatcccagctacttgggaggctgaggcaggagaatctcttgaacctggaaggtggaggttgcaataagccgagatagtgccactgcactccagcctagataacagagcaagactctgtctcaaaaaacaacaacaacaacaacaaaacaattctatgactgaaagtgactaaaaagctggctttatgccattaacactctgtactttgcagccaatcagaactgacgcagtctgggtgctagctgcttcaaaagcaacccacaccacacttttaccatttccatacatcaactgctgagaatatgaaaatgcacagtgacaggttttaggatcctgcttcaggatttccttttcctggtttggtcactagagttggctatttatctgtttctaaacaatagctattttatcgaatagtttagagaccactattaaatattgtgactgatgaaggatctgtgaatttttttatatatgttctaagagttaccattttgataccttttaaaaaccagcagctttctactatattcatgtaaaacagcatgaataaaaccattttttgatacagggttttatttggctttaaactcaggaaccaagttaattatgccagattgaactttgatttttactaccttttcaaagatattttaaaaagtggattactacatatgatttctttggagcttacatttctttacttcacgaattctatgtcactgttacaagtttccattctgatggcttctgggcctttgtacctttgtttttggtgccttattcctagtatgtttctatcaccttaatgaggccgcagatggagtcagaatgtgaaattacaaataatcactggatccatctactgttttccatcaccttccccactgatgctctgggcgagagagtgatgtgtcacttcaactgtgtgtaatatgtcagacacgtcctacaataacaggcgtcatatttgtattatttttagtttactgtagaaaataatgtcaccgccaaaggtgatgagagtcacgttttgtaggatctgttttcttatacttaaagacagacttctgctacggtaattgccagtattcatggcttcctttctgtgtcagaagagaagggatctgctttctcttggctgatttcacatagcattggtaatagacatgcatttctctttctaaaggggagtaactttttaaacccttcctgattttagcctggcaatgtaagtgtccttaatgtgactgttttgataattaaaaaaaggtatataatttatttaaatcttcatttcctttcttttcagaaggtccccaaatcacagttaactcattcattgacgcattcactcaacaactattcaatgaggcactctctagagaccaaggataaataaggtagccagtctcatagagatatgaggagatggaaattaatcaaataattcaagcaaatggcatcttgcaacttgtgctgagtataatggtgaaaaggcaaatgatggcatgagagcttatagtagggaaatttggcctatttggggagatcagcctacctgaggaaggaatgttttagctaaaatctgaaggatgagtattacttaactagtgaatgcgggaggaaagagcattctaggcagagaacagtatgtgcaaaggtcctggggcaggaaaagcagagcaggtttatagaacttaaaggagaactgtatgactgtgccataaaaagtacagagaagtaaggcatgagttacggttggacaagcaggcaggggctaggctgcctggagcctgtgggccatggtagagtttgtctgtatcctaagacctaagccacataagggttctaagcaggaacctggtaagatcacatttaattttaatttttttatttttatttttatttttgagatggagtcttgctttgttgcccaggctggagtgcagtggctcaacctcagctcactgcaacctctgcctcctgggttcaagcgattctcctgtctcagcctcccaagtatctgggattacaggcgcctgccaccacacccagctaatttttgtatttttagtagagacagggtttctccatgttggctaagctggtctcgaatgcctgacctcaagtgatccaccggcctcagcctcccacagtgctgggattacaagtgtaagccaccacacccagccatattaatttattttattttattttattttatttattttgagacagagtttcactcttgttgcctaggctggagtgcaatgccactatctcagctcactgcaacctccacctcctgggttcaatcaattctcctgcctcagcctcctgagtagccaggattacatgtgtgccaccatcacgcctggctaatttttgtatttttagtagagacggagtttctccatgttggtcaaactggtgccgaatgcctgacctcaagtgattcaccagcctcggcctcccaaagtgctgggattacaggagtacgccacagcgcccagccaccaaattaatttttaaagatcactatgatcgctgtgtggaaaatgagctgggagtggtggtggatacagtttttgtttttgtttcagtctttccctactccatgaaacatttgcgctatatatgcggccaaatggaatgtttctcttttctcccctcctcttcctcttgggaagtcaccaaaaaaaaaaaaaaaagaaaaaaagaaaacaaatcagcagcaagagaaaaggacgaaaagctctggtggccttgaattttggaatggcccctgtcccaagctggcagggatgaggctgtgtgttgagcttcagatcacaggaaggagtgcaccaaatcaggagatgaagggcagtcagcaggacccactgggtacccaccgtgcagtgtgaggcctaaaattaagctctaatatgaggtgctgctttgacatcaggtgaaatcaggagtgcctcaccccaagtttctctcccagtcctcccttggcaaagggcgcccagtgaaacagccttccttatcaaaaagaccagatgcagttcctgctaatccctgagcggcaggtgtgagtctcctgccaacccacggagttgtccaaatgagccagtcacatcctccggggaaccagggcctcctcaccctcttggtgctacaaagcctgccccgcactggccctggttgttcactctgtttctgtgtggccctgcacggcaagtggggtcttcctccccgagctgtgagtgtgtgtgaccaaaaactgctgccaatctcatttgcccagtgttgggtgtcatgtgttcagctaccgccataaccctggggtgggaactgggaatccctccctcaccactgaggtaaagaggttattaaaacatccctacttcagctgggtgcggtgactcacgcctgtaatcccagcactttgggaggctgaggtgggtgatcacctgaggtcaggagttcgagaccagcctggccgacatggtgaaaccctgtttctactaaaaatacaaaaaattagccaggcgtggtggcgggcacctgtaatcccagctacttgggaggctgaagcaggagaattgcttgaacccgggaggcagaggttgcagtgagccacgatcacaccattgcactccagcctgggcaacaagagcgaaactctgtctcaaaaaaaaaaaacaccctaattccaggccaaccagcagccctaaaaaattaatcttcgtttggcttctaccaaaagtcatggtctacacaaagccctgcctactagaggcaataaggaaccatgaccaccacccccatttattcaaattacccactggaatgcaccgagtggggtttcaccctctgctgcttgtatgtttctcaacccatgttctaatcccatgcagtcatcattcaggaatccctgaggatcccctgattcaacttctcttttttgaatagattagaaattcctatcttctttcacttttactgtgacttttcagcttcctgttttccattcctgagggctatgaatcatatttccaaaataaatgatgatctatggagaggattttgcatttccaacatccttagctaattttaatgaattatcatggtcacatgatcctaaggcttcaggaatcggaggaagtggctgacactgacttaccattttaaccaaacaatcactgcacttaagcttggataagggtcaaataaaactaacagggctcttatgcaagcccttccagtctggtaagttatgagtatttatgttttatttccccccaaaaacaataagaccctcagaggcaaggaactcatcttggtttttgtcccttacacacctatctcagtccagtggtatgatgggcactggaaacaaaccacctggttcaaatcctggcttggtcacttattggccaagtggcctgatatggtttggctgtgtccccacccaaatctcatcttgaattgttagctcccataattcccatgtgttgtgggagggacctggtgggagagaattgaatcatgggggcggtttcccccatattgttctcgtggtagtgaatatgtctcacgagatctgagggttttataaggggtttctcctcttgcttggctctcattcttgttttgcctgccaccatgtaagatgtggctttgctcctccttgcctttgtcatgattgtgaggcctccccagccctccccaggtgacacattggaactgtgagtcaattaaacctttcctatataaattatccagtctttggtatgtctttattagcagtgtgagaacagactaatacatggctttgggcagcttctcatgtctagccatggtagctattcttatgatttggatggtgcccaagcattgctctcgagctccaggcccatatatttaaccacctccagatattctatacttaaatggtttagaggcaattcaaacagctacaaaagacaaatcatgatctcagttcaccccacccacatgtgacttccagagctcccaagatcagccagtagcaccacctgccatcagttcaacttcccaagccagaaattcaaaggataccttgatgtctcccttctccttccccgttctgtccaatctcatctgttcattcagcaaacacttactgagcaccccagcactgtacaggagctagggatgaacaggtgaataagagaggctctttgggaggttaggtgcagtggggcagacaggcaatcacggtgaaaagaaatgcagtgaggacagcttgggatacagagtttgaaagaaacaagcaggatgctgtgataggagcaagggagttacttctgacaaggggcagggatagtgtctccaaggaagtgacatttacactagatctgaatatcaagaaggagccagctgtaatgagttgaaagaagggcattccaggaagagggatggaaaacataaagctgaggggtgagagagaaataagagtgttccagagcctggtgcaggagcacacacatgtagtcccagcgacgagagatcatcccttaagcccaggagtttgaggccagcctgggtaacatagtaataatctatctcaaaaagaaaaaaaaagaaaagaaaagaaatgagtgtgctccaggacctgtcagatggccagtgcaactatgcggtgagagacacagtcttgcttgttttcttactgcctcctaaactgggtggttccatctcactgaaacagacgctcaaagaaaggcgaaattcacaggcaagcacagccttgggagggttatgaagctggtgagatgtaagcgggccctcactggaggaaggggctggaaacagtgggatgagaggaggcattcccaacaggaccagcagcacaagccaggcccagaaacaaatgactatcatagtggagggagattaaatgggactgatttggggaaaccttcaaaaagaaaaaaaggctgagatgtttgaaccagttgcaaagttaagatggagccgttcttggggctgacagaggacatgagaaaagcagtgacttaagaacatcccagccgggtgcagtggctcacgcctgtaatctcagcactttgggaggccaaggcgggcggatcatgagatcagcaagtggagaccatcctggcttacacggtgaaactccgtctctactaaaaatacaaaaaattagccaggggtggtggcatgcacctatagtcccagcttctcgggaggctgaggcaggagaatcgcttgaacctgggaggcagaggttgcagtgagccaagatcgctccactgcactccagcctgggtgacagagcgagactccttctcaaaaattaaaaaaaaaaaaaaaatccctcagaccgacatgaggacgtgggatgggaggggaagcctggggaagtgacatcatttagaagtcagctgggattatataggagtgactcagtaagccacctgtgctactgaattggtggtggtgatagaaagaaaaggaagagatatatatatatatggggggttttgttgttgttgtttttttttggttgttgttgtttttgtttttgttttgtagagatacggtctccctatgttgcccaggctggccttaaactcctggcctcaagcaatcctcccgcctgggcctctcaaagctctgggattataggtgtgagccatcacccccagcctggctaaatgaatttttaaaaattcctctgagtccaacaggaggagattggttaagtaaattatggcacagtcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggattacaggcgtgagctactgggcctagcctattttgttttttgtagagatgggtcttcctatgttgcccaggctggtctcaaactcctggtcttaagtgatcctcccgcctcagtctcccaagtagctgggattacaggcataagccattgtaccaggccttgacagtttcttaacaaacatctaccgtaccacaggccactctacccaatagaagtgaaaatgtgtttacaaagacttgcatataaatattaataacagctttagttgtaataataaaaaattggaagcaatccaaatgtccttcaacaggtaaatgaataaacaaactgtggtacgtccatacaattgaaattattcagcaataaaaaggaactacagatatacgccacaacatggataaatctcaaaatcatgatgctgtgaaagaagctaagctaaaaaggagccattgctcataggtcctagctctgtttttggctcatgctgtgaattctccctcctctcaactctccagggcccaattttcatctccaattatgaaagtttttcctggccttcaaaatgtagtccctatagccccttcaaaatcagcccctttggcagtgcacagtggctcatgcctgtaatcccagcactttgggaggctgaggcaggtggatcacctgaggtcaggagttcgagaccagcctggccaacatggcattaccccatctctacttaaaaaaaaaaaaaaaaaaaaaattaactgggcatggtggtgcacacctgtagtcccagctactcatgagctgagggaggagaatagcttgaacctgggaggtggaggttgcagtgagccaaaatcacgcaactgcactccagcctgggcaacacagcaaccctctgtctcaacaacaacaacaaaaaaaagcccctttagaaaggcatcctgatgttgggtcttcttccaattaaattcattcgttccttcaacaaatatttttgcgctcctactatgcaccaggtactgtgctaggctctggggatgggatagggtgtggaggtggatgaaatgatcctatggagcttacgttctggctgggtggagacaggcaataaacaactaaaccaacgcacagataatcagatgctgattaacgctatgaaggaaagcaaatagggccatggggcagagagaggctggagggtgctttagggatggtggcccgggaagccttttggaggaggtgatactggagttgagacttggacattatcggaataggccttacaaagttggcatggggtggtgggggaggtggttccaagcagaaggaacagcgagagtacagacccaaggcaagagcttggattccgaggaatgtgaaggcaggaacagagggagcttagggagctggcagcagaatggcaggagggatgggaaagggtcagaccacacagggccctgtgaaccctggtgaggatctgagttctctgtatccccgcagggtttacggtaagggtcctgtgagaaatgcacagcaagtgctgaacccagtgcctggtgccaacacacgctcggccaggcgggtcgtcgccaggctctcagtgacccgcctcattccatcacaccttcgcccacacctcagtctctttgctggaggctccctccggccctgcaactgctctgtccacacccacagggggtcacacacacctgccccagcagccctcacccatgagtataaacaccccagctcccttgcccctggtgggatgactgaggctgctgctctgtgctgttccccagggtcccacggaaggaaaaagccccagcggcccacactccacactggtaatcggctccatgacccaccctttgctgactgccttcccttccccatgctgattcacgacccccctagggcccctttttggccccagccgcccccaaggttccctggagtcaactcctaggtcaaccgtggcactcagatccttctgggggagcccaaccttccacagaggccctgctgggggcagggaagggcaccagggacccctaggacctggctcaccaccggctcacgcacctgcatacccgtgatggagacgtggtgagactccactgtcggccgccggggcagccgaggcgaggactgcggagagctgacgggtgagtagggcagggacgggcagatgcagcgtccgttcatgtccaggctgccaccggctgccagcccaccctgggaccgctcttgcagagacagcttgcgaccggagaggtggggccgggcctgggacccggaggtgtcaagggggacctcttggccatcggcctccaggggccggtcccgcgccaagccgaggtccacagcacagcccggctcacactcggtgaccacaatgaaggactccatgcccaggtggatgctcaaggatgagaggccccgcagggcctcacagggcttctggctttcgctgctgctgctgcccctaccccccagctcatcctggggggcggcccggttgctgctgggctggctagagacacatgatgacatggtgcatgcgccagcttcatccagcacactggggcactcccatccggcagcggagccacctgcagaaagagaaagggtcagctggcccagctcctacgggcagggacaggaaaggatcccctctcctcccggcccaggctgctgtctaattcctgcctccagttgacatcctaaaaaaatcttgcaaaacatggtgtgatctgatctctgagtctatacagaaaagcagagtctgcatcttcttatattttttcttttattcttttttctttttttttcttttttttttttttgagacaaggtctctccctctctctgttgcccaggctggagtacagtggtgcgatcatagctcactgtacccttgaactcctaggctcaagtgatcctcccatctcagcctcccaagtagctggaaccacttctcacataccatgacaataattcctaactcaattcctataggaacaagtataagaaaacccccaaatagagcacacatatcccctacagaattgacagctgcttccagctcaagccaattgttgctcggcaggaatctgggcctactattgctggtcttccctttgtttttcccaagagaagccctaaggaggttaataagtttgcctgactttttatttttaaatgctgggcattaacaatgcaggtcagggctggacacggtggctcacacctgtaatcctagcattttgggaggccaaggcaggcagattacttgaggccaggaattccagatcagcctggccaacatggtgaaacctcatctctactaaaaatacaaaaattagccgggcatggtggcgtgtgcctgtaatcccagctactcaggaggctgaggcaggagaatcgctggaatccaggaggcggaggttgcagtgagccgagatcatgccactgcactccagcctcagcaactcagcaatagaccaagactgtctcaaaaaaaaaaaaaaaaaaaaggtcggggggaatcaagtatatgccacaatatggatgaacctctaaaatattatgctaactgaaggaagccagtcacaaaaggtcacatatatatgattctatttatatgaaatttttaaaatatgcaactccacagagacagaaagtagactaatggttgcctaggactatgggggtggtgacattagtgggtgtggggaatggctgcttaatgggcacaggttttccttttggggtgatcaaaacgttttgaaactagatagaggtaatggttgcacagcattgtgaacgtactaaatgccactgaactatacacttcaaaatggccaacttatgttacatgaacttatatctcaattttttaaaaaaggccaggcacggcagctcacgcctgtaatctcagcactttgggaggacagggcgggtggatcatgaggtcaggagttcaaggccagcctgaccaacatggtgaaaccccatctctactaaaaatacaaaaattagccaagtgtggtgatgtacacctgtagtcccagctactcaggaggctgaggcaggagaatcacttgaacccgggaggcggaggttgcaatgagccgagatcacgccactgcacttcagcctggatgacagagtgagactccatctcaaaaaaaaaaaaaaagagagagaagtcggacacagtggttcatacctgtaatcctcccagcactttgggaggccaaggcaggtggatcacctgaggtcaggagttcaagaccagcctggccaacctggtgaaaccccatctctactaaaaatacaaaaattacctgggcatggtggtgggcacctgtaatcccagctactcgggaggctgaggcaggagaatcacttgaatccgggaggtgaaggttgcaatgactgagccgagatcgcaccactgcactgcagcctgggtgactgaacaagactcatctcaaaaaataaaaataaaaaagattaacacatccccttaggctgtcaattcttaccgtctctgggacagaacattaacctttgcttaacgtgtttgacaaattctgctggacaaatgtcacaggtaccactggaattcagggagtacatttgtggacagacacctgtggatgatggccactccatgctaatcacccacatcacaaagggtctctctggaccatcctggccaacatggtgaaaccccgtctctactaaaaatacaacaataagccaggtgtagtggctcatgcctataatcctagctactggagaggctgaggcaggagaattgcttgaacctgggaggcggaggttgcagtgagctgaggttgcaccactgcacaccagcctgccaacagagggagactccatctcaaaaaaaaagggcggggtggggggggggggtctctctagatgtcccaggaaaacagtgagggctcagcagagattttatgaatgaataaaatggtatctccgatgacattgggaggtagtggggtaaaagagaggaaggtacagacagcggaaagccagagctccctggaggatctggctgagaggcagaaaatggccctcagcgctctcggaacggtccttccagaagaactgatgaaagagctactacgccaggcacgtggcagggaaagcccaacaggaaaggcaaaagggaaaacccaacgccccagccctgacacgggcctgactcatgcacacagagtgtgtggtaagagaacgccaaagagtccaatcatgcggcaagatgttcaacctcacagtaagagaactgcaaattcaaactacaatcaggcagcctggtggctccccaaaaagttaaacgtagagttgccatataaccagcaattcctctcctaggtatagacccaaaagaattgaaggtagggattcaaacggatacttgtacactaatgttcatagcaacatcattcacaatagccaaaaggtataaccaagtgtccatcaacagacgaatgaataaacaaaatgtggcagagccatacaacagaatactatacagccacaaaaaagaaggaaactctgactcacactacaacacagacgaaccgtgaagacatacgctaagtgaagcaagccagatactaaaggacaagtgtaagatttcagttacatgaagtatctagaatagtcaaattcaggccagatgcagtggttcgcacctgtaatcccaacaccttgggaggccaaggcaggcagatcacttgaggttaggagttccagacaagcccggccaatatggtgaaaccccatctctactaaaaatacaaaaattagccaggcgtggtgttgggcacctgtcatcccagctactcaggaggctgaagcaggagaatcacttgaacccgggaggcacaggttgcagtgaggcgagattgcgccactgcactccagcctgggtaacagagcaagactccatctaaaataaataaataaataaaaagtgttttaaaggaaagaaaatacctgtaaccatgatcggagttatgatgataaggcctaggatgctacgggatcagacggggcaggaggtcaggagaggggagcagttggtcttatctcctatttctctgtcccccattcccccttactgtatctcagaaagaaatcatcaactctgtccctgtctcagtttccccatcaatgagagaatacaactcaagtttgatatttctctatggccctagctgctgctactttacttctccttctcatggtccttatgtcccagaagaggaaactcaagataccctgaagttcaacagcttaaggtcattgacatcctgtaaagttggtgcccatctgatagtcataggattagatgaaccaagcactcagaatcatgccctgcaagtggttaagtactcaaaaactattacttcaacaaacacctgttggatgctatggtttgactctgtgtcctctcccaaatctcaccttgaattgtactcccataattcccgtgtgttgtgggagggacccagtgggagataattgaatcacgggggcgggttcccccatactgttctcatggtggtaagcctcacgagatctgatggttttatcagggggttccgcttttgcatcttcctcattctcgctgcctgctgccgtccatgtaagaccggacttgctcctccttgacttccgccatgattatggggcttccccagccaagtggaactataagtccagttaaacctttctgttgtaaattgcccagtctcgggtatgtctttatcagcagcgtgaaaacggactaatacagatgcccatggcctgctctggtaggtagcctatgctctggaatgttcccacgaggaccaatgtccaagcgagctggcctgctcttaagtgtgtccctcagccctggctgtgtggcctgcgtcccccagggcaggcagtcagtctctcccctatcctagagctgcctctgatagggctgcaagagttcctgagaagaaaatgaggctgagcagtgcctgggaaagtcaatggagatttgtttttttctcaccaacaggaaaacaattgcttatcgaactctacaccaggccaagggcactgagccatccgcccccagcaaggctgcttttaatcggcctccttggcaagctggcatctggcccgggcctccctcacagctctgacggagtctcggcctctgcggtctgttggaggatggagaggagagacagctcagaccccgggcagggacgtcggcgctggcagggcaagcgtgaaaccccagagctcagcagagaggagccccagggacgcaggccctgacaggaagagatgcatccaggggcttctggcctcacagacacctagagtctaggccagtgtcctgaacggtttgggggtcacagaccctacaaagatctgatgaaagctaccaacactctgtgcagaagaaatcatgcaaaaagacaatagtttagcctggaaacagcaacggctaacattcaactgagctctcatcaggcacccagcacggagataaccgcctggccatgtaaccctcacaggaccaggccctctgccagggaaggacagtgaagcattcgattccagagggcggagcgtgagaggaggacttttttgcaaagttgcttggatttgacaaaatgtcagccctggccctgcatccttccccatgaaatccaggcagaggccatcccccaaggccttgcctctaccctgttccctctcacagggcagctcatcacgagccaccagagccttcctggagcagatggacccgggacccgggccaggatgagggaaacgctccttcctctgccaggaagctgagtggcgcaggcctccaggaaacaccttctcatttcctaggggctgtttccaacctgcatccgctacctcccgcgcagcaagctgccagtgggtgccaaagaggtgctcccgagcccggacacacctgtgcaggctcccccgaggttgcctcatcctgggcacaacaaaaaggcccaaaacagctccgaggatcctgccaaggccacggacgatgtcctgcccgggacatcaatgtcctccttgggaaaatgggctcagccagccaaagtcagggaccccaaacggagggaccggctaaagccatggcagaagaacatggattgtgaagattttatggacatttattagttccccaaattaatacttttgtaatttcttatgcctgtctttactgcaatctctaaacataaattgtaaagatttcatggacacttatcacttccccaatcaataccctcgtgatttcttatgcctgtcttatttaatctcttaatcctgtcagttgaggaggatgtatatcgtctcaggaccctgtgataattgcattaactgcacaaattgtacagcatgtgtgtttgtgcaatatgaaatctgagcaccttgaaaaaagaacaggataacagcaatcgttcagggaataagagagataaccttaaactctgatcgccggtgagccgggcagaacagagccatatttctcttctttcaaaagcaaatgggagaaatatcgctgaattctttttctcagcatggaacgtccctgagaaagagaatgcgtacctaggggtaggtctctgaactggcaccccctggggcgtacctgtctcttatggtcgagattgcagaggtgagatagactccagtctcccatagcgctcccatctcccatagcgctcccaggcttattaggaaggggaaattcccacctgataaattttggtcagaccggttgatctcaaaaccctgtctcctgataagatgttatcaatgacaatgttgcccgaaacttcattagcaattttaatttcacctgggtcctgtggtcctgtgatctcaccctgcctccacttgccttgtgatattctattaccctgttaagtacttgatgtctgtcacccacacctattcgcacactccctccccttttgaaaatccctaataaaaacttgctggtttttgtggcttgtggggcatcacggaacctaccgacatgtgatgtctcccccggatgcccagctttaaaatttctctcttttgtactctgtccctttatttctcaagccagccgacgcttaggaaaatagaaaagaacctatgtgattatcggggcaggtcccccgctagacgcgggcctccaggaaacacattctcatttcctaggggctgtttccaacctgcatccgctacctcccgcgcagcaagctgccagtgggtgccaaagaggtgctcccaagcccggacacacctgtgcaggctcccctgaggttgcctcatcccgggcacaacaaaaaggcccaaaacagctccgaggatcctgccaaggctacggatgatgtcctgcccgggacatcaatgtcctccttgggaaaatgggctcagccacaccctgtctcacatggggaaactgaggcccacagaggtcctcaaggaaatgcgttcattcattcattcattcatttgttcttacatgtagtaattataaagcaatgatcacgtgctggataaacaaaacagatgtggtttttgccctcgaggggactgacagtccaatgagggggaccaacatttaaaagtaggtgcacaaggccgggtgcggtggctcatgcctggaatcccagcactttgggaggccgagacgggtggatcacctgaggtcaggagttcaagactagcctggccaaatggtgaaaccccgtctctactaaaaatacaaaaatagccaggtgtggtggcgggcacctgtaatctcagctacttgggaggctgaggcaggagaatcgcttgagcctgggaggcagagattgtggtgagccaagattgggccattgcactctagcctgggtgacaaagcgagagtccatcttgaaaaagaaaaagtaggtcccaagtgaatctataagcacagactggggcagaagaccaggatatgatcaaagagaataccagaggggaccactttagatttgaagggaggcggtgggtgaaagaaggcccctcttggtgaacgtctattaggctgagacctacagggtgagtagatactaaaggagcaggaacttgttcccagcagaggaaacagcttctgagaaggccctctgtggaaaagaggcgggagagtggaggcaacagaaacaagtttcctgggtctggagcccgggagcaggaacaaagtggggaaggaggggctggaagggctacagctttgtgggaagtggatgatgacgacgagagggcagcccagggcaatgctacagggactgggctcagaccctgctgtgagttgaactgtgtcccccaaaaatgttatgtggcagttctaaccctcaggacctcagaatgtggccttatttggagacaggtctttacagagattatgaagttaaaatgaggtcattagggtgggccccagtccaacaggcctagtccaataaatgggaaaggtagacacacagccagccagcacggagggggaaggccacacggagatggaggcggagacgatgctccttctagaggccaaggagcatcagagattatcaacaaccaccagcagccaggagaggcctggaacagactcccctcggagccttcagaagggacgaaccctgccaaggcttgatcccagacttctggcctccagaaatgacagaatatatgtctgttcttttttttcttttcttttctttttgacagagtcttgctctgtcccccgggctggagtgcaatggcgcaatttcggcttactgcaacctccgcctcccaagttcaagtgcttctcctgcctcagcctcctgagtagttgggattacaggcacccaccaccatgcccggctaatttttgtatttttagtggagacagggtttcaccatgttggtcaggctggtctcaaactactgacctcagatgatccacccgcctcagcctcccaaagtgctgagattacaggcatgagccaccacgccctgcctaatatctctgttctttaagccgcccagtgtgagacttggtcacggcttctctaggaagataatacagcaccccacccaaccagtggggttcggagaagccggctgccttggaggccacagactctgaggcatttcccaaagctctagcgggagacctgagaggctcggctgcatccacggaggcggtgctggaatatttcagacccagggccctagcccagctaagcagggttatcagatccagtgacaccaactgttacaactggctctctccttcagcgctctttaatttggggccactgaaacaactgagtccgcaaaaacaaaggccctcccttgtcagatggcaatagagatatctcaggcctcagagaccccatcctcatcatagtccctagaacaaaaacgttgcaaatgatgactcctgtgtgacatctggccaccgatatactggccttacaccaggttcaaagctatctgaagaagtggtggctcatggccgtaatcccagcactctgggagaccgaggtgggaggatgacttgatgctgaattcaagatcagcctgggcaacatagtgagaccccatctctacaaaaaaaattttttaaattagttgggcatggtactcacacctgtagtcccagctactcaggaggctgaggcgggaggatggcttgagcccaggagttggaggctgcagtgaactatgattgcaccactgcactccagcctgggtggcagaatgagatcctttcgctaaataaataaataaataaataaataaccatttgaatgagatgccaacatttcagagccaggagatttcagataaaagtgcaaatttacagattttcttgaagaactgcacactgatagcactgggcctgtgttctatcctggcaaccactcgctgcagctctgggcaggggacacactcaccagcacgccacagtcctcaccacttcccagtgcctctccaaagctgaggacaggctgcctgccacggcccacgccctcccctcggcccacatctcatgccctgcctctccgctacaggtgtctgagtctgcagcccctgctttcaagtcactgaatgtcagtgcaaagacaggtgcacatcagtggtcacctgctctgaccatttcattccaccaatgaggaaaatgaaggttcagaaggatttactgatttgcccaaagtcacgcagtggttctaggcagggcgacaattgggctgagttttgttgttcttgtttatttttatttttatttatttacttatttttgagatggagtctcgctctgttgcccaggctagaatgcagtggtgtgatctcggctcagcgcaacctctgcctcccaggtttaagcaattctcctgcttcagcttcccaagtagctggggattacaggcacgccaccatgcccagctaatttttgtgttttttggtggagacagggtttcaccatgttgcccaggctggtctcgaacttctgacttcaagtgatccacctgccttggcctcccaaagtgctgggattacaggcatgagtcaccgcacccggccgggctgagtttttcaggaaggggccaacaattacaggcatagccctgccatgtccacatattgcgtcctgaataaagtccaggctggaccaaaatctctaacaagggatttgggcaggcagcccattcctctgccttgctgggacctcgacctgtgtttgagagagatgagagcgaaagcacagggtctcaaagtgcttggaggagaaatgcacaggatttgggcacagggacatggacatgactaactcatgagagctgtggctttggcctccttgtttacagctgaattcccgggcctagaactttctaggacactgctcgcactcagtaaatactgactagaagttgttgtttatttcttctgtcccaaggccactcagaaggtcagaagctttctttagctggcctagagttgaagtttctttagtctgataacagcagcccaatttatgtctgggaagccatccctccatatgagaggtggccctacagggctgaccccaccatcagcttcagagatttgcatgtgactcaagcctggccagctggctatcaattgctctggtcaagtgggtaactcaagaatagatatgaggccgggcacagtggttcacgcctgtaatcccagcactttgggaggccaaggcggacagatcacttgaggccaggagttcgagaccagcctagccaacatggtgaaactccacctctactataaatacagaaattagccaggtatggtggcgcatgcctgttatcccagctactcaggaggctgaggcacgagaatcacttgaacccgggagggggaggttgcagtgagccaagattgcaccaccgcactccagcctgggcaacagagcaggaccttatctaaaaaagaaacagagtagatgtgtgggccaggcatggtggctcacgcctgtgctcctagcactgtggaagtctgaggtgggcagatcccttgagcccaggagtttgagaccagcctgggcaacacggcgagacctcatcgctacaaaaatacaaaaaaaacctagctgggcatggtggcgtacacctgtagtcccagctactagggaggctgaggtgggaggatcgcttgagctggggaggttgatgcagcagtgagccgtgatcatgccaccgcactctagcctgggtgacagagtgagaccctgtctcaaaaaagagagtagatgtgtgacccaagtcagtctattgggtcttattctgtgattttgtggaagtgttgaaaagaaagaatgtcctttctgttgaacctagagctcagaggatatattcctaaagctaccaggggctggagagaaccctgcctcagaatgaagtctaagaagagagaagagaggtaatggatggaaaagagctgaggttgaagacactgtttaggcacctggattcagccatgcctgaagctcatgtacctcaatttttaactacatgagccaacatatttccatttttgcttaagctatttcgtgattagttttccatcatttacagtcaagggccctgacttagaaatgacagagctgactgacagggaagctgctgtctccctacaccccagggctctcatccaggccaaactgccaggcagctacaaggcctctggcaacctggacagccttcaccttgacaggcaacttgacttccaacactgcttttctctttcttttaatcttaaaacatcaaggatggggcagggaagggctgatgaacagggagaggagaagaaactggcattttcaacacaagaatcgcattgctgcagatgcagtgatactaatggttagccttcttgagtgcttggcactcttctaatcctgcatcatctcatttaactgtcacaaccaccttatgagttatagatactgttttgtttggtttggtttggtttgatttggtttggttgaggcagggtctcactctgtcacccaggctggagtacagtggcacaatcttggctcactgcagccttgatctcccgggctcaagcattcctcccacctcagccccccaagtagctgcaactacaggtgcgcaccactacgcctggctaaataggtcctgctattatccctgttccaccagtggggaaactgaggcacagagagcctggctgacttgctcacaatcatccagcttctgagtgcttcaggagggcacaagtgtgaatgctcactatatagaagctattgccaagaaagaactttggcagttactgaattcacgaccctcagttggcttcctttttttggggggcggggcggttggggacagggtctcactctattgcccaggctggaatgcagtggtgcaatcatagttcactgcagcctcgaactcctgggctcaggtgatcctcccaccttacctcccaagtatctgggactacaggcatacaccaccacacttggctaattttttgtatttttggtagagatggggttttgccatgttgcccaggctgttctcaaactcctgggctcaagtgatccacctgcctcagcctcccaaagtgctgggattataggcatgagccactgtgcctagctggtttcaatttattttaaaacgaaatctcttaaatctctaatcctgccgtgctaactcttcatcttcccctctagcccttgtccatatgcatcacattttacaaaattaaaaatagcgtatgcatatcatttcacatccttgcttccatgtgtcataagagcacattctcacatggcttttgcaatcagcgcaacagaggctgcagatggagtcaccgagactcagagaagttgagatgacctcatccaggcagcccagcaggctcgcagttgggccaggaggagatccaggtggcctgccctgcagcccagtgacccttgaggccctggatactcacagagtaagcagttcccctgtcttgctgcttgccagggccaactgtcttaagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgctcttgtcacctaggctggagtgcagtggtgcgaggtcggctcactgcaacctctgcctcccaggttcaagcgattctcctgtctcagcctcccgagtagctgggattacaggagcctgcaatcatgcccggctatttttttttttttttgtatttttagtaaagatgggctttcaccatgttggccaggctggtgttgaactcctgacctcaggtgatccacccacctcagcctcccaaagtgctgggattacaggcatgagccaccgtgcccagcctaaatgaaggatcttgagatgggagattatcctggattatccagttggtccttaaatgccccctcttgtaaatgctctctctctttgtaagacagaggcaaagggagattggacacaggatagggagtgaaagtggccactgaggcaagatgttatgctgctggctttgaagaaatgcaaggaatgcagctccagaaggtggaaaagctgaggaactggattctcccttaaagtcccggagggagcaccgccctggctcagggaaaatcatctccaacttctgatctctggcaacataagcaaatatgtgttgtttgaagccactaagctttgataacttgctacagcagccacaggaaaggaatacaccaagtagctctcactcataaggattgttttgggatttgacgaggtagcgtaggtaaagaccttagcgcagcgggtggatttactaaatgctcagtaaatgtgagccacattatgaagacccagtggcccggcctcttggctgtttgacatcctccatccctagacacacagccccacatcccagtgtacaaagcaccaccaacctgaattgccacatctgaaaaattatcgcctgtttctcggaagatgtctcctagtcggaaaatgggacactgtggattctgagtcttgtggaaggtacaagtgatgtttaaacctggcaggatgtttctcctgtccataattaaaagcaaacaaacaaacatctcgattgaaaacagatctgtctctttcccaggagtgagccagtgtggtggagaggttccatgaaagccccaaatgatccctgcctcctgggacccctgggcagtggcctctcacactggaccagggttgatctgtgtgaccaatggcatatggcagaagtgttggggtctccccccaaagactgtggcttccatcttggttatactcttggttgcttgctctgtctctcttgggtcacttgctctgggagaagccagccaccatataccaaggatactcaagtggtctagggcgaggttcacgtggtgaggaactgagctctcccacgagcaactgtgtgagagcttggaaaagggttctccagccccagtcaagcctagaaatgactgcagccctggttgacagcttggctacaacctgacagaccttgagccagaaccacgcagcaaagtcattcccagattcctgacccacagaaaccgtgggagacaataggcgtttgttgtttcaggcttctgaggtttgggataatttattactcagcagtagataactaagacagccaggcagcctgggcacttacgtggtgtagttgtggccggggaagtcgatattgttcttgatgagcacagtgaagttttcggcactgttcaagagagcaggcctgggagagagacatgcaaaatggccattagtgacggtggggaccgagggagcccatgggccagtgggaccagaggcttctggtttcttggcttggtctttgggatgcatgaagagaaatggatacagcaaacctagtgggcaaagcattctgaaactctccacaaagcccctccagctcctccaagaagaatttctcccttcttgagatctgatatggtttggctctgtgtccccacccaaatctcatcttgaattgtaatccccatgtgccagaggaggggcctggtgggaggtgactgaatcatgggggcggacttcctccttgctgttctcgtgatagtgagtgagttctcacgagatctgatcatttaaaagtgtgcggcacatcccccgaaactcgcctcctgctccatcatggtaagatgtgtttgcttccccttcgccttctgccatgattgtaagtctcctgaggcttcctgttaagcctgtggagctgtgagtcaattaaacctcttttttttcgtaaagtatttggtctcaggtagttctttatttttatttttatttttttctgagatggagtctcactctgtcacccaggctggagtgcagtggcgcgatctcgggtcactgcaacctccacctcccgggttcaagcgactctcctgcctcagcctcccgagtagccgggattacaggcgtgtgccaccacacctggctaatttatgcattttttaatagagatggggtttcaccatgtttgccaggctggtatcaaactcctgacctcaagtgatccgcctgcctcagcctgccaaagtgttgggattacaggcgtgagccaccgcacctggctaggtagttctttgtgtgagaatggactaacacaagacccagtggcatttactgtggcacctcttacagtgatgtaattacacattcaggtatgtacagtggttgagacttgctccgtatctgggacttgtattttacctaaaacttagcaaagtctcttatgcgtagttacgtatgaaataaatatctaacacctactacgtggtgatggatgtgttgaatgaatgattaaacgaaccatcttagctaattcatataatatatgagaaactgaaattcagggagttgcttgcccaggtcacgtcaaaatccagcccagaggcaggcacactggagatgcagtttatttaatgagtgagttgatagcagagctggaactgaaactgcagtcagtcaagggccgcttgtcttgaacaaggactacctgagtggaggctgctgtatctcccagagctgggtgattcccaaagaaatgcccctgaccgagaaatgaacctgagtggagctattagcgattgagaatcataaggggtgatgctgctgagcgcaccccccatcccggcattgggaaaccttcgcctgagccttctacaggccagcttggggcagttttctctttgccccacgatgctgagggaatgatcctgaatcacatcggtctagaactgcgctgtccaatatggtagccactagacatgtgtggctatttaaatttaaatttaattaaaaattcaggctgggagcaatggctcaaacctgtaaccccagcactttgggaggccaaggcaggaggatcgcttgagcccaggagttcaaaaccagcctgggcaacatagcaaaactctatctatctatctatctatctatctatctatctatctatctatctatctacctgtctatctatctattatctatttatctatctatctatctttctatctatcatctatcatctctttcaaaaattcagtagtcgcatttcatgtactcaatagccacatgtacctagtagctgccctattggacagcacagatacagaaatttccatcactgcatcaagttcaattggacagtgctggtctagaaccaccacacttctaggggtagattgtgtgtgtgtgtgtgtgtgtgtgcgtgtgtgtgtgtgtgtgtgtgtgtgtgtaagccaggcatgcatggggcttaccttacaataactgtacaagtatcatctcatttaatccttacaacagccctatgaagttggtgaaattattattctgcttttacaggtgaggacactgaaactcagagaggttaagccattttcccaaggacacacagcaaaatggtgttagagttaggaattgaatccaggtctttctaactattctctgctgaaatacatcagcccttgtggcttctgagatttaacattgtgactttgtgtattgaagcgaagcatcaatacaagggaccaccaaatctgtatgtcattgtaagcatttaatctgagaaaacttccttcccccccccttttaccctcaccccttttgctttttcctccccttccccttctcttccctcgcttcgtccttcccttccatctccctccttccttcctatccttgatcactcagtatggacactgacaagtcagaagggatcctgctgtggcactacaggagggggtctgggggtaccctggaagatctgggggaaggaaggggccagggacacccaaggatgctcagggtagtagctatttaccagttggtacaggagtgttacaacagtttaccaaccaccatggccctcccagagatactagtttgtgccaagcagtgcatccagagcgcaggggtccccaagccggtaggacccaggactttgcagggctgtgctgagaggggaaggcccaagcagcctcggcaaggcctcatctggtcgccgctgagggccactgtgtctgtctccccatgcgactcaccggggggcctcttccactgcctcgatggggcaccaggcagagacttcacaggtcttctggttcccttcatgcactacacaccttccggtctgaattcctataggggtcaaagcatcgtagaaccacagatgtgaaagaactgcagagaggacgttctccaggagggacatcattaactcaacccgggcgagagactaggctttgaccaggctttccaacccacgcagcttcagcttccatcaagcccatcctaaccacaacgaacacaaggcaaggcaaacaagcaaaacataataaagatcagagagaacacagaaagactgtggattctgctggctcttttgtttctttataagaaaaggtgcccatgaggggagcggaacaggtgtatgctctcacttagtataaatggactagaacatggcctctcaaaggggcacaagtccctcaaggggtacacagcctgcccaggatgtgcaaagccatgaaatcagcatggcacatcttcctggagtgccaggatgattaatcagtttccaagggagaattaattaaatagtgagcaatgttaaaataacttttatactaactcaaatacacatacagtatggagtagaatgcagtaatgggcatatgcctttttgtgtgtgtttgcattataaccactgatttttttttttttactatttgcagtatttttaaaattgccctgtgccttttttttttttttttaaaggggtctcgctctgtcacccatgctggagtgcagtggcatgatcttggctcactgcaacctctgccttccaggttcaagtgattctcacgtctcagcctcccaagtagctgggattataagcgtgtgccaccatgtctggctgatttttgtatttttagtagagacggggtttcaccatgttttccaggctgttctcgaacccctgacctcaagcatccatctgcctcaccctcccaaagtgctgggattacaggcaccagcctctgcgctcgctgccctgtgcctttttaagttaaaatgtgagataaagaaattctgcaggtatcgcaatagcactgcacttagatataaataaaatcaaaatcaaaatcaaaataaaacagtgcaaaaaatgtttaaaaaataaaataaaataaaaaacaaaaaaaattctgcaggttaatatgggtattgctgccaggttccctgggggtaaaagttcatggtcctcaacctttgaggaaattcagggggaaagtttagaatactcagatgatgctataggccatgtgaattttctaccgattagaatcctgaacctgctaggtttttaggagcttcttctctcactggaaaactggagtcatgtttacagtcagcagctggtctgctggggacagagccgaagcatgggcagactcgcctatggcttggtgatggtggaagagggcagctgagagcagaggctgaagacctgacctgggcatcacaaatgtcaccaagatgccagaccatccacccctagggtctcgggaaaagaaacagaaggtacctttgctctgcgggtccatccatccctttttacaacctcggtcagaggaacagagcgtcctgcgggtgggatactgcagatagaaggatgacagagtggggagtaagtgacgtgtgttactaagacgtggagaagtgattcgatatccaccagaatgtgcacacgaatgcttatagcagcactactcagaatcgccaaaaaagtggaaaccacgcaagtggccactgacggatgaatggacaaataaaatgtggtacattcatacacagaatcttatttagccataagaaggatgaagcaatgacacaggctacaacatggatggacctggagaacatgatgctgagtgaaagaagacagacacaaaaggccacaccatatacaattctatttataggaaatgtccagaataggcatctatagagacagaaagtagactgtggccagggacaggggaaggggagaatggggagtgactgctactggatttggggtttcctttgtaggtgatgaaaatgttctgggggctgggcgccgtggcttatcacgcctgtaatcccagcactttgggaggccaaggcgggcagatcacctgaggtcaggagtctgagaccagcctgctcaacatggtgaaaccccgtctctactaaaaatacaaaaattatcagatgtggtggtgtgcgcctgtaatcccagctactaggggggctgaggcaggagaatcacttgaacctgggaggtggaggttgcagtgagctgagattgcgtcactgcactccagcctgggtgacaagagcaaaactccacctaaaaaaagaaagaaaggaaggaaggaagaaagaaagaaaaagaaagaaagaaaggaaaaaaaaagaaagaaggaagaaaatattctggaattagacggtggtgatggttgcacaactctgtgattatactaaaaaccactgaaccgtatgtacactttaaaatggtggggtttatggtatgtgaattatatcccaatacaaataaataaaaatgggaaaagcagaggtctgggaagctagggatcactttcagggatgctggctgggatgggggacaggtggcttggtccaagtggccctgtggctgaaaggactgagcagggcaaacaggtgcggagactcagcaggacacatggaactgagagacattggccaggacactcgcctggcccaagaaaatgagaccagctgggtctcagggctgaaggacagaacacggaagagagaaatgagctgccctggtttatgcatatttctcttcctgttttctagggagcaggcttcatggccagtcttggggaagccagaacatgacataggtgtgaaaatggcctctgctctttgtcatctgtgcaatttgtggcttctacagtgattcaggtcaaggacctaggtcttggacccaggtatatctggttcagcagtagctgcaccattttctagctgagagaccttggccagctcactgttcatctgtaaaagcagggtgaacagatttgtcttttttttttttttttttttttggagacagagtcttgctctgtcgaccaggctagagtgcaatggtgtgatcttggctcactgtaacctccacctcctgagttcaggcaattctcctgcctcagcctcctgagtagctgggattacaggcacgcaccaccatgcctggctaatttttgtatttttagtagagacggtgtttccccatcttggccaggctggtcttgaactcctgacctcatgatctgcctgcctcgacctcccaaagtgctgggattataggcgtgagccatcatgcccagccaacaaattgtcttgcctggttgttgtgaagattaagtgagttatgaaaagaaagggtttagcacatagtacatgctcaatgaatgtttcttgtagttttcaaactctctcatgatctctttatttcccaggctgccttgtcacatggcatgccgttggtctcctccccttgtgactccccagattagattatgaaccctttgaatacagagccaaggtcatatctttgcagcccaagtgcctggcaaatagtaggtcttgatagtcatggaaggaatgaatgtgtgatcattcattgtggctcatggaaagttacattttcattatcaactggagatgaatctcaggaaagaagagaaatcagttttattttgctctccaaaaggaattctaattttttttttaaaaaacagcacattagttttgttttaatcttctcttttgtgattgttgcatggattaaagatggccacaaattcttggtcactttctccattgagaggtggagtgtttcccctactttctgaagctgagcctgtgctgtgactgcaaagccaatagaagcagcagaaggaatgctgttgccagttccaggcctaagccttaagaaggcctggaagcttctatttttttgttttgttttgaggaacctgagccactattagaaagtttgactaccctgctggagagacaatgcggacagaccttgaagagagggtaactcttaggggttcccagagaggaagagacgtctagctatccctgggtgccaattgaggctccaagggatgccaaccccagctgccatctgactgcagctccttgagagatccctagtgagaccagcagaagaaccaaccagctgaactcagtcaaccactgaactgtgagagttaataaaatgcttgtgttaagcccaccatgatcagggtagtttgttttgcagccacagataaatggagcaaatatctattcatgttggtgtgtaactggaacttggtcatatttaccgagacaacccgagatagaggggtgttgatgggcagagaggaggcaaatgcccaattagaccagcccaaaccagcctggagcataagttaaaatcccaaagagtcacatgtgctctctgggctggaagtgcttcgatggaacctgttgggttccagtcactctgagtgacatcctatctgaggagtaacatgtcatttgaatcataacaactgacattcattgagtgcttataatgtaccatgccttgttttaagcgtgtcacaggtattcactcatttgtttcaataatccgaacagctaggttttgttctcagccccattttacagatgcacacaacttggcacagagaggtgaagagtcacctgcctgaggtcacagagttaagaagtttaagttttgaacctttagcggtctagcttctgagcccaggctcttaatctctgggctatcctaactctttttcttccaagtctcaataagtccaaaagtgtctttatgtgtacatggaggtagagtgtggtgtagagatgaccaaaggatgggacaaaagggaaacaggcccccaaactggattggagacggaacactgctgggaagggagacagaagggagggcttggctggcctggctgtcagagatttcatctgagcagcagggacagttaaggggtgatgaggacaaaacaaatgtagaaagctctccttttagacggagtgttatcaagatagacaccaagggaatgttatcttggttctgaatttgggtacaaatgatggcaaagactgtactcaaagacagcacttttgcccagaggtcctggacactcaggaagctagaccttgttgccagagtgggcccgtgagcaaaactccaccggcagggctggtcctgctcatcagtggaggatctggctgggtatcaccagcgctgctgcaacggtcagtgttggaaatggtccctggtacagcacagttacgttacctgagaggggaggctgggaggttgggagttacaggtaatgcctagcagtaacacgctggtatagataaacttagaagaaaagctggtttaagaggagagagcaggatggtgaggtaaagaataggacaaatacagtttttgttttgttttgtttttagagacaaggtctcactatgttgcccaggctggtcttgaactcctgggctccagtgatcctcctgccttggcctcccaaagtgctgagattataggtgtgagccaccgtgcctagcccagaataaaacaaatatgatttgatagggaagaagctcttccagaaagaggcggctctttggagagagcaaagccaagttgggaaagattgtctggggtggtggcagggagtcatgggggcacatgcacgtgatggagaggctgagactctaagaagtggatgaatgagcaagagagctgtgtgccagggttttccaagaccagccctgcagacagttcactgtgaaccatggtaggagaagctgtgagtgaggacactcaggtcctaaccctggctctgcctgcagcaagctgtgtgaccctgggggaagtcacaacatctctgaatctgtgttctggtttgtaaaatgccatttttctcctaaagtcattgtgagcctcaagtaaaatgtgaaatgttgtgcaaatgccaagaatcaccattgtcataagctgcgaagagagccagagatagaaagagcagggttgccgtctgcacgggtccctagtgctagaaccagagactgaggcaggcagacaaagatctggtggccatggagagacactgccatgtgttctctcccttcctccactcagcccagccctaccccacaaaagaggcaggtgctcagtagatatttgtgggctcaaatacaccccagggtccgcatttctgcttcttccgacttgcacctcccccaggaactcttaagacctgacccaccactccaggtcccctccttacctcgggacacaaccgctgctcttggccttctgttttgagaaagtttgtcatcacgaagaaagagttcccctgtggagaaggagaggctaagaaaatgcaaggcctttgaaaagagaactacttaattataataatccagcttgctgggcgaacctctccacttttctaagcttctagaaatcaggatctgtgggcaacttggaatatgccaagggcttaatatcaaagctggacgagcagccctgctgagctgagggagagtgaaggagcgtttgaatgggttgaagagtcatttaccaatgcagtctcaaaagcagccttttcatgtttttgtttttgtttttttttttttttacgcagtaaaaatctcattaaattgaaactcaggagacctggggaggcgagggtaggggagcagccttcatcacaacactgttcagattttcccagactttaatgaaagggcactagggcatcccaccacctgagcaatcacaggattttaatgacccactgttagaaacaaacagcagcttgggcttcatgggtctttgcaaagcattttagccccccaagccgcaaacgtgcccctttgtccctctcgcccccttatctgttttttggactcctcaaccctactttaatttctcttttttggcaattctgctttcattttccctgcttgcaaatctagaagtcacacgccttctctcagtgaccgatgcctttcttctttttgtcatttacatcctttctttgtggaaaaatgtacccaagaatggtctcctggagtcatttttgttgatgaaatgctacacaatctagaagggctggtgctctttggtagaaagttctctgtccttctgaatctcggcagaccttgctggcttggtggctgtgcgtctaaaaagctgcgggtaaatcaagcgcgagtgaatcaaatcctgttttcaatgcaccaggacatgaggctattttgagaaaccctgtaggacttgataaagcaaagaatcatctcctggatctcacccagttttgcaatttttaggttttctcagttgggatgttcacagagcttttaaaataggaccagcgttttttctggagtgaggctgtagatcctaggggaagggagctaggccctggcgacggtgaccagcgacgagcctgggagaatgctacgaggtgctcacctgcaaagggaaggtgtagtctgcggtgtcaaagacactgtgcaccaacttcttcactccattctccacgatctcctctttcacctctgctatccccttcaccttggtgtgcacagaactgatgacaggctctttccgctggtacagcttgtcactcaccagagcaaagctaaatggcagacatgggaaagcatcaacgggaggcatagcacagcgggttgggatgcaggcgttggaggatgcaggcacttctgttccaatcctagctctgctgcgtgacttgcttccgtgtgacttgttttccctctctggataatgggaagaatagtcatacctgcctcatggattgtgaggatgaaatgagagacgtctgcagactcctttgcccagtatctggcacatagctagcacttgctacaggaaagctactgcccccaatcctattctttaatattccctaacatggaccctcatagataggacagcttctcaagtcataaagtctcgccccggtgggttcgccagctttgtctggaggctcagtaacacatcagcaccttccagtctaaggctgcatctggtgcattttcagaaacacccacctgctttatcaataacattgaaaatggcagctactctctctctctctctttttttttttttgaaacagagttttgctcttgttgcccagactggagtgcaatggtgcgatcttggctcactgcaacttccacctcccaggttcaagtgattctcctgcctcagcctcccaagtagctgggattacaggtgtgagccactgcgcccagcctctcttttttttttattccagagaaagggccttgctctgttgcccaggctggagggcagtggcgtgatcgtagctcactgcagcctccaactcccgagctcaagttgatcctcccacctcagcctcctgagtagctggaactacaggcatgtatcaccatgctcagctagtttttattattttttatagagacgggggtctctttatgttgcccaggctggtctcaaacccttggcctcaagcaatcctcctgccaacatgttgagcctcccaacatgttgtggttacaggtgtgggccaccacaccaggctgcaggagttactctttattgagcacttcatatgtgccaagtactctgcatgcaccatctcctttaatcgtcacaacagtaggagatagttaccaggattaccggcatgcgccaccgcacccagcctaaagggtttgttttattatgtttttttgagatggagtcttgctctgtagcccgggctggagtgcagtgactccatctcagctcactgcaacttctgcctgccgggttcaagtgattctcctgcctcagccttccgagtagctgggattacaggcgcgtaccaccacactttgctaatttttgtatttttagtagagacaaggtttcgccatgttggtcaggctggtcttgaatgcccaacctcaagggatccacccaccttggcctcccaaagtgctgggattacaggtgtgagccaccacacccagccctaaagggtttgttttaaatgctttatttactcattcagactttatttatttagtcccttctatctgctcagctgctgagtgatattagcaagtctaagatgatggctgccctctatgagctgaccttgggaagctgagacagagtgggccaagactcagtcccagctgttctccaccttggctgtgtaatcacccagggagctttcaagtccccagtcccatccctggagactaggattccacgggtcgggggagttatccagatacccacatatttttttaaagttcccaagtgattctaatgcatagccagggctgagaaccagtagtaggctcctgaaaagatagctcagatttgacaatagcaagtacatttgaagaagagcattccccatggcccagcaataaaactcttacatttgtgccctagagaagctcttgtacatgtgccggaggagctatggacaagaatgtttctgcagcattgcttgtaagagggaaagcaggaaataacctacatgtactcaaacaacgaatggataaataaattgttggattcatacaatgagatgctttgagccaggcacagtggctcacgcctgtaatcccagaactttgggatgccaaggcggatggatcacctgaggtcaggagtttgaggccatcctggccaatatggtgaaacctcatctctactaaaaataaaaattaactgggtacggtggcgtgagcctgtaatcccacctattcgggaggctgaggcaggagaatcgcttgaacctgggagatggaggttgtggtgagctgagatcgcgccactgcactccagcctgggcaacaagagcaaagctccatctcaaaaaacaaaacaaaacaaaacaaaaaacaaagaacaaaaattagctgtgtgtggtggcacatgcctgtagtcccagctactctggaggccacagtgggaggattgcttgggcccgggaggtcaaggctatagtaagctgtgattgcacccctgtactccagcctgggcaacagagtgagaccctgtctcaaaaaaataataataaaataattttttaaaatgagatgctttgcagcagtgaaaatgaattgactaggcctgacatagtgtctcacacctgtaatctcagcattttgggaggccaaggtgggtggatcacttgagattaggagttcaggaccagcatgaccaacatggtgaaaccctctctctactaaaaatacaaaaaatagccggtgtgggggggggggngcgccctgtaatcccaactactcgggagggtgaggcaggagaatcctttgaaccggggaggtggaggttgcagggggccaaggtcacattactgcactccagcctgggcgagtaatattgatgaaccttgaaaacaatataatttatggctggagttcaagcgattctcctgcctcagcctcccaagtaggtgggtagctcgtgccaccacacccagctaagtcaaagagaccagtcacaaaaggccacatattgtatgattccatttatatgaaatatccagaataggtgaatccacagagacagagagtagattggtcgttgcaggggacagagtgggaagaaatggggagtgactcctggggggcatggagtgtccttttggggtgatgaaaatgttctggagctagatagaggtggtggttgcacagtactatgaatgtcctaaatgccactgaattgttcatgtttacagtggttaattttacgttatgtgaatttcaccccaataaaaaattatattttttatatatgtagacatatatgtgctgtagaaatattaaaacaaacaagggaattaaaaatgtcaaattcaggatttcttttaggctgggcatggtggctcatgcctgtaatctttgggaggccgaggcaggtggatcatctgaggtcctgggttcgaaaccaacctggccaaaccccgtctctactaaaaatacaaaaattagccagttgtggtggcatgtgcctgtagtcccagctactccggaggctgaggcaggaaccctggagacggaggttgcagtgagccgagatggcgccactgcactccagcctgggtgatagagtgagactctgtctcaaaaagaaaaaaaaaaaaaaggatttcatttagagatggagtcttgctatgttgcccatgctggaacacagtggctatttcacaggtgcaatcagcacacgacagccacaaactcctgggctcaagtgatcctcccatctcagcctcccaagtagctcaggctgcaggtgcagccactgtgcctggctgcaggatgtttataaagcaaaaggaaagagaatgggatgaaggatgagtttgcagggagcaaaactggattagtaatgctttatttcttaagttggatggtggtacgtgggtgttatattatgcacaatacactttagtatttctataacatttatttattacttatttgagacggagtctcactctgttgccaaggctggagtgcaatggcgcgatctcagcttactgcaacctccgcctcccaggttcaagtgattctcctgcctcagcctcccaagtagctgggattacaggcatccaccatcgtgcccagctaatttttgtatttttagtagagatggggtttctccatgttggtcaggctggtcttgaactcctgacctcaggtgatccacccgccttggcctcccaaagtgttgggattacaggcataagccagtgcacacggccaacatttatttaaaaagaaggattttcaagaaagatgttgggggtaagatacccagatttgagacccaatcagcacatacgagacatagctattaaatagaattccatagacaaatatgataacacttgctcattaatacatttcagcccagcatcccaacacatacatggtgcatgcagcgctttctcatgctggatgttgcaacgttctcctggaacaacactgggtcatgtgacccaccatttgggaagctcaattctgatctctcatatttatcccagaatgtgcaacatatgatcgatcagccttaatggaatcaggccctctcctaaacagaaaacgtgtctctgtgtcatcatgaacatgtaaattttaagaattaaaatgcttcagagctgcgtcaaagacaaaaagggaatgaaagcgagtttgcacactttacctgtcgggggggatactgtgatcatgaaagtgagtttgtagtatcctccctttggaaagaaagtgctaatgaccatcccagaaatactctcccgaccttgcttggtgactaaggtgagccatgtcacccctccaggtggtaggtttaatccctgaatgaagagagaactcccagccttccccatccccatgacctttttgctctaagaggctataatgttatgcattctgtagaaggcaaagccgctggtacctggagctaacgggagtgtgaaggacctagggatttcactgagccggggaggatgggtaagttgtgggggtgtggtggtgtgcacctatattcgcagctacttgttagaccgaggtaggaggatcccttgagcccaggagttcaagacaagcctgggcaacacagtgagactccagtctctaaaaaagaacaaagctggaaagattttgggaagtagaacagagctaatgggagagaagccagggccactgatatggtttggctgtgtccccatccaaatttcatcttgaattatagctcccataatttccatgtgttgtgggagggacctggtgggagataattgaatcatgggggcagtttcccccatactgttctcgtggtagtgagtaagtctcatgggatctgatggttttataagaggtttcttcttttgcttggttgtcattcactttttgcctgccaccatgtaagacatgcctttcgccctctgccatgattgtgaggccttcccagccatgtggaactgtgggcccattaaacctctttcctttataaattacctggtcttgggtatgtctttattagcagcgtgagaacagactaatacagccatcaaggggcactcacaggcaagtctggctgaggaggagccctggagtggcagggaaataaggatggagggtgaggttgggcccatgggaccctgaggctgcttgctctggacccaccagatggagatgaaggtgcccaccataaagtcgttcttcagagtctcaatccacatgctctgaatatgagtgactgtcacagacttacactggcatcacaggtgagatgggccccatgccagcatggttagattgctcttcaagctctgcagggaggacctccctttcagcaaagttcctctccgtcttacagcccctgggcttccagcgcaaaggtaacatcaaagggctgagcctccaaagtgtatcccttgtatctcttagctcacacctaagccaggccaacaaacatcttcatggacccctaaagaacagtagcgccaggactgtgcctgcagtgcggcacagagaagcttggcgtgcagcctctgcatctcttatttaaaatcccaagaggagaatccgatcaggtccatcgctggtccacccggccatggtgggggctcagcaaggggcgaggacccaagagatgctctgagaagaaagtgggggagagccagcacccccagggcaagtttaatcccgattgtattagtttctggttgttgctctaacaaattaccacaaacttagtggctttcaacaacactaatttattcttttgcagttttgggggtcagactcctaaagtcagtcaaacagggtaaaaatcaagggttaaaaagaaaaaatataaattaagatcacagctgggtgcggtgactcacgcctgtaattccagcactttgggaggctgaggcaggtggataatttgagatcaagagtttgagaccagcctgggcaacatggcgaaaccccatttctactaaaaaggcaaaaattagctaggtgcggtgatgggtgcctataattccagctacttgggaggctgaggtgggagaatcgtttgaacctgggaggcggaggttgcagtgagccaagatcatgccattgcactccagcctgggtgacagagtgagactctgtctcaaaataaataaataaataaataaataaataaataaataaataaaaaagatcccagcccaagtcattcccataggcaatgggagtgtcttctagatatctctttatgtccacacctagacacacaaatagatatactgatgttacaaacgtggctgcaagctgttttgtaacttgttatttttgttcaataatatgttattagttctttctatgacagtaaagatagatctgtgataaagatagatctatgatacacagtcattttcagtggctaaagagtatcttagtgtttaaattgaacatatgaaacggcccattttggctgggctcggtggctcactcatgtaatcccagaactctgggaggccgaggcaggcagattaattgaggccaggagttcaagacccgcctggccaacatggtggaaaccccatctctactaaaaatacaaaaattagctgggcgtggtggtgcacacctgtaatcccagctacttgggaggctgaggcaggagaatcgcttgaacctgggaggcagaggttgcagtgagccaagatcgtgccactgcacttcagcctggtgacagactgagactgtctcaagacaaacaaacaaacaaacaaacaacaacaacaaaaaaaactgcccattttgcattttgtaggccatagctatagaatataggcagttccatatggttcaagctaaaaggtacattgtgataatttgtcaaccagcctctgggatggatatttactggaacctttgttcaattttcccaattataaacattttttggtaaccctaatatagtccttaccatgtgccaaccactcttctaagtccattttgctaacatatattaactcttgcaatccttactctcccccaccaaaaacaaaaacaaaaacaaaaaaccaactctataaggaaggtactattattacccccacttaatagctgaataaacggtgtcatgaatgaagtgagaagcttgtccaaggtcacatggtaaatagcagcaccagctccaaacacagccatgtagcttcacagcctcagctttcttaaatgctacagtgaatggaatactttttcgaatttccttttcaaatgttcattgctggtgtaaaaaaaacccacacaattaatttttgtggttgatcttgttccttgcaacttgactgaattagtttatttgctctaacagttttcttgtgaattctttgggattctccctatatgggattgtgccacctgtgactaaagatagttttacttcatcctttacaatctggatgccttttattgctttttcttgcctaattgctctggctagaacttccagtacaatgtcgaacagcagcggtgaaagcgggcatccttgtcctgttcctgatctcagggagatgcactcaggctgtgctcctcaacactgtgctcactgtctgtccatcccgcattcatgttgccaggaatccctgcacaagcttcttctcacccctaagacattaagtccataggacaacttctgggtgtgcacattttatagctgagttcattttcccaaatcacaaaaacttgaaccatttcatgcttctatcagcaaagcaagagtgtgcacactgcctcttcagaggggcttggcccggctcagtggctcacgctgtaatcccagcactttgggaagctgaggcagggggatcactggaggtcaggagttcaagaccagcctggccaacatggtgaaaccccgtctctactaaaaatacaaaaattaaccaggcatggcgatgtatgcctgtaatcccagcattcaggaggctgaggcaggagaatcacttgaaaccaggaggcagaggttgcagtgagctgagattgtgccatgccctccagcctgggacagagtaagactcctcccaaaaaaaaaaaaaaaaaaaaaaaaaagagaggcttgacaaataagaggatggtcatgtgaacttggctgggacagtagagggtcgggtcaccaggctgggagcacagggcccgtaggatgggggctgtgagtttgaagaagaggacagacatagtagcagcgtgcagccatttgaagagtagaagagggacacaaggcagaactctaaccaaaggcgaaagttacagggagatagattgtggctcagtataaggaagaaatgtctaacagggcagtcccagagcagaacgagctttccttgtggttgctgctggtgatggtgaggaagatgatgatgataattttcatttatcccatcaacttccctttctctcctgtcccatttccatctgcatttaaacatcatttctcatcttaaaaatgcctcccctccccagcttaatccatcctaccaccactccatgcctctcttctttatagctgagtcccttgaaagagtgagtcaccaggccgggtacggtggctcacgcctgtaatcccagcactttgggaggctgaggcaggtggatcaagaggtcaggagtttgagaccagcctggccaacatggtgaaaccccgtctctactaaaaatacaaaaaattaggcgggtgtggtggcacatgcctgtaatcccagctacttggaaggctgaggcaggagaatcacttgaacccaggaggcagaggttgtggtgagtggagatcacaccatcgcactccagcctgggcgacagaggaagactgcatctcaaaaaaaaaaaaaagaaagaaagaagaaagaaagggcgagtcatcacatccacttccgcatcttgattcactcactcctctacccactctagtctggctcccacccccatcccttctctaaagcctctcttgccaagtaaacaacaatgtcgttgtcactaaatccaatagatacaccatggacctgaccttcctggaactctcagcagcagttgacactgactgtgaccatgccccacttccctcgcctccttcccttagcttgcaggagtccacttgtgcctgactttcactggatcgccgtggctactcctcagaatcttttggggacttctgcgctcccacgccttaaaggttagcactcctttggggcgtgttctaggcccttttgctttctcatctacatcttctcttgctggtcggttgcaccttcttccagggttctggttgccgtctatatgctggtgatatagaaacctacatctcagctgcagattcgtatatccaaccatccattcaacatctccatttgtacattccatagacacctcaaactcaatgcctttagtcctgacctcatcttccaccccaaattggctgtttctcctgcatttcctatcccagcaagttattccagtacccatcagttgcccaagccagaagcatggtgcactctttgactcatcctctccttcttgtccactcacccgttcagttgccaaatcctactgtttcacttcctaatatgctcaaattcatctacttctctcctctgcctctatcacctccccagtccaggtcgccaacagctctcagatctggacatcccaatagtctcctaaatgccctcccttcctccagtctcaccctgtcccctctactctctacactgcaatactttagtgagagcatagactttggagtgaggttcagtctcagctctattgcttactgactacatgaccttgggtaagtgacttaatctttctgagtcattgtttcttcttttgtaataagaggatattagggctgggtgcagtggctcatgcctgtaatcccagaactttgggaggccaaggcgggtggctcatttgaagtcaggagttcaagaccagcttggccaacatggtgagaccccatctctactaaaagtacaaaaattagccaggtgtgttggtgcacgtctgtaatcccagctactcaggaagctgaggtaggagaatcgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagttcgaaatgttcatgaagctatttccagctgcagcttcacaccaactaaatgtttgtgtttttttgtttttgagacagagtcttgccctattgcccaggctggagtgcagtggcatgatctcggctcactgcaacctctgcctcctgggttcaagcaattctcctgcctcagcctcccaagtagctgggattacaggcatctgccaccacacccagctaatttttgtatttttagtagagacagaggttcaccatgttggccaggctggtctggaactcctgacctcatgatccaccgcctcagcctcccaaagtgctgggattacaggcgtgagccactgcacccagccacacaccagctgaattctgcatcaggtattcagaatccccctagaggaagcagtttgcccttcgcctctgccatgaattcacttccaagtactgagaggaaccattattttacaaatactctgcttctgctggataaatggccaacctgggcttttcttgcttttggaaaaaaaaaaaaaaaaagtttaccaactccctttattgaagctctggttcatgctgccttttaaaaaaaaatgcttgttgcctgtaatcccaggactttgggaggccaaggtggatcatttaagcgtaggcattcaagaccagcccagtcaatatggtgagaccctatctctacaaaaaattaaattagccgggtgtggcggtatatatctgtagtcccagctacttgggtggctgaggccagaggatcacttgagcccaggaggttgaggctgcagtgagctatgatggtgccactgtactccagcctgggcaccaaagtgagaccctgtctgaaaaaattaaaagtgcttgcttaggcacatgggtcaaatgaagctggaatgtttaggaatggtgatatgggctgaatgtgtctaccaaaattcacattttggaaacttcatccccaaggcaaccttattgggaggtgaagccttggggaggtgactgagtcaggattgtgctgccctcatgaatggggttggtgccctatacgagggctagagagggagctcatcccccgtctgccttgccactgtctgccacgcgaggacaagtgttcctccctccaaaggatgcggcaccaaggcaccctcttggaagcagagagcagccctcaccagataccaaacctgccagcaccttgatcttgaacttcctggcctccagaaatgtgagaaatcaattattgttctttataaattacccagtcttaggtccctgtaacagcagcacaaaacagacttaagggcaatgggtgtgtttatgatcttgctcgtcaaggagtgatggtcactggctgtcttccgaagtgggggagatgctgtttagcctcttttctaaaacaaatgtgaaagcaagccagtgttggggtgaggggcgggtgtatttctagatgccatgaacaccagcaggaggctgggtgtggtgatgcgcgcctgtcatcccagcactttgggaggctgaggcaggaggattacttggtccaagagtttgagaccagcctgggcaacaggtagtgagacctcatccctacaaataatttaaaaattagccaggcatggtggtgcacatctgtagtcccagcaactcgggaggctgaggtgggaggactgcttgagtccaggagtttgagaccaggcctgggtaatatagtgagattctgtctctataaaaaatttaagaattatctgggtgtgggggctggtgtggtggtgggcccctgtggtcccagctactttggaacccaaagtggatggatcacttaagcctgagaggtggagattgcagtgagccgagactgccactgcactccaggctgggtgacagaacgagaccctgtctcaaaaaagaaaaccagaagggttttgctggcaaattctaacccttggacaactgacttaactttctggagcctcacctcacagacgatgatccataaaacgaggttaatccctacctcgtggggtaaagtgtcatgtggcataccaggccatagttcagtgtgactgagactgctcgggggctgcccacctgtctggcctccaccagaatcttgcaattacctgcctgcgaaagcagtgctgctcaaacttcagcacgcggacgagtcacctggggagcaggtttaagccaagcctgggtatctgcatttatttttttcttttaatttttgaaacagggtctcgccctgttgcccaggctggtgtgcagtggcatgatcacagctcactgcagccttgacctccagggttcacgtaatccccccacctcagcctcctgagtagctgtgggaccataggcatgcaccaccacactcaattaattttttaatttttttttttttttttagagatggggtcttgccatgttgtccaggctggtctcaaactcctaggctcaagcaatcctcccaccttggcctcccaaagtgctgggattgcaggtgtgagccaccgtgcccggccggcacctgcgtttctaacccactcacaggtgacactggcgctactggtctgggagccacactgagtagcaaggtcctaggacatgctctaaattagagatttgctgaatacattagccttgacttgggcatctgacctcgctgtcagcctgaggaaggaatacagacatcagggcaggcggcctaaataaacaatcaccaatacaaacctccccaagaggcccaggcttggcaccattttgctgtctgtttatttcaactgtacagagaagcttaaacacctgtggaaaaacacgaaaggcttagttttctcttaagttcatgtactttttagtgataaatacacagtatttaactttatacacctgataaaaggaaaatgcatagtagaaagggtcgggaatgaaacagaagcatcgggcattgaatcgatcacagagtagaaaagtctgcagtccccagaaactcggcctccagctggagaggggaaccagcgtaccctgaaacttccctagcaccttggaagcaagtggaggtcatggttcttccactcggcaacgtgaagctccccgctggaagacaagtgagagcgacaggccaggcctgtgtgtccacctgcacaggcattctccttgttccagaaaggctctgaggacggaagacctgcctctcaggaaaggccagaccagtagggagaggcctccgcagccccaagtgtcaacaaggggctcaataaggctttctgggagccactggcagctggtgggatggaagggggaggtggaaaagggcagaggaaatgggaagtggatggagggtttgtgcttccttcgaggccacaagtgcaggccacaggttgcttacaccaaattggtcccacagatgagctagcaatggaagaaattatgggcgtcctctttgcccactggaagagctgctcataacagcacctcctttcctgacagggctggcttttgaaaaatcaatgtgctccaagagtggcagctcaaatgctctgtgtttacagccatcttggcttatccttttcatgtggggcaggtcctttccacagctttctttggtgtttcttcattaaaagaaaaaaaaaagtcatcaatgtgggtctcccccaccccactgcccccacagctgggtgctgcctgattgctggcattccctggaagaaatcttagatggaaggttccgtggtggggagaaatggcattgtctgatgcagctgtgtaaacaagagaagccctgcagaagctctaagcactgctgccccctgggccagccaccaggccaggccagagcccacacaagcaggctgggcctaagactagggacccgctggctttaacctctgcaaggtgcttattgcaaactaaccaagccccaactggtgccagaaggggtggagctattgagtcctctccccataaacataaagccaggagggcaagaggaagtgctgggttacaaagacccagcaagcaggccagacgaccctctctagactacctgtcctttgctcttcaaaaccagcattccctaattctgaactgcttataagatagcaaaacaagtctggctaaactacagtcaagagcttaggatctatggaagccaagaaggcccagggctccatgaatgggctgggcaggggcacgaggccttgcctttgtctgagaagtcctcacaccacagctgatcagatggaaacaatggggaagcagagtttcccggtgccgtctttccccagcccagattccaccaagcgctggaaagcagagctgggaatctcccaaggcagagtccttccagctttcctccccctcaacttcacactcccctacctgtggctctggaaggagtcacacttgaacctcaaccaaacttcccaatatcagttggaagtcaaaaagatgaaccctttctttctggacttttagctacaaaggggaacttcctgtgccaagccctggtttcctcataccccaacgagtgctgtgggtttcaacagtcttctctaaaagggtgccccaaggttattgtgtggagtctagggaagctcagatcctcaggatgatcatttgtgtgttggtccagtgaaagcatttcccacctggccctccagaaactgggtatttcattgaccacaacaatcagctaggatttaaaatgaaaacaaaaccttagcagtctttagaatatacaggttatgaactagctaagctgctaatatatatacaggcgggcataggtttcattggctctaactgatcacatgcctgaagctgtgaaatatatcctggaagctctaaatagtttctgaactactgtgctctagagttcactctagttagagacttgaaaaatgtttttgtttaatcttaagccatgtaatgtacatggaagcataggatttcaccctgaagttttcgtaatttgacaaagagatttaccagagctcggtcagctatctcagaaacctgctttgagcaactgtcatgaagaaacacgttcagtctttcaggagaaatgtttccccaccacagctgctgaatacccttccaggcttggaaaatccccttccagcagcacttattaaatttcaagccctttctgttttcctgactacaattctacccataaaaaatttaaaaatccttcttacaaataagttgcatcaaagctccctgcagctactgagggccagccctgctctgactccttgagaccacggctctggaaggtgccatggtttccggtttgcactaggagccacatctagccccctactccctctcaaatgcagcaaccacctccatggcctcagaccgccggagttttctgctcgcctttccacagttgtcaaaccccacacacagtcacttggtatatctgacgtggttctgaaaatcacaatgaaggatttttggcataaaaacgttttaaaaagcaattgtcccaaaatgcacgtgggtttgggtctgcaactcctcacacccgcctgtccagccagccagcggccacggtcgacgtcatggagtcaagtccttttttttttttttttgtcccctttaaaacaacaaaggaaaaaacaaataaccagagatgacgatcgaggctctacacacgtgctgggtttccgtaggacatgctgctatggaaacgcggtgcagcagccccccagaggcgacgcggcgcgcatgcgaggtcgagcgatccaggcagctactcgggctccatggcctcctccggccgcagtggatgcatgcgtgcgggggagccgggggcgggggcccagcaactttccacgcagggactgcctctcacaagagcacttcctcctcccccacggggggcgggtcggtgccctggaggttgtcttcgctgccttgcttcctgctcaccgaacagaaaaccaacattaagactctgagaaatgccagcgaggccctgagccagctgctcccacatctgggccccctgcccaagtgggccgtcgcgcaccccctggaacgtgatctacgtaacccagtctttgagatcctctccccttttccttgctcacataaatttttcaaaggagactttgcacgcagcccctctgtaaatgaaagaccagcatcatttgccaaaaatagcaaggacccgtacaacagttccaaaactatgtaacaccaaaattcactgcacaaatcccaagtagaaggcaccccccaccccacggcgcctgtcataccaggtttttaggtacttcgatcccccacttaggctatgagcccttacagggaagggactgtgacgcttgtcctcagtcaccagatgttgagttccttgtgtgtgggggtgatcagagcctcccctgcctggcctggcacacagctggccctcaagaaagggcagatgacaactgctccagggatcctcccgcctcagccctcctgcagccagccctgagggaggagcacctcagacagaagaggaggccccttccctcttggaagtgggaggaggagagcccttgtttccctgaagagcccaggctggagccgccggtgtgacagcgtggatggcgtgacaggtgcgaggggaatccccgagcctatcccctcaccaccatcacacagctcccctgttcttagggaggtcactgggcatgccacatgggttactgtctgtccttcccccacaacaatccgtgtctcctgtccaggagggagactgtccttacacaagggaaaggaagcgtgatgtctggcttgctatgtttctgatggagaatgtgggtaaggtccctggggaggggggcgctgtaactagacgttaggtcaggccctcagtctctgccctcgcagttgcctgttggtaggggttgggtcttactgcagacggcaggcaggcccccagtccaagacccccagtgcctgaatcagctctgtgagctcccatgaccaaggcatcctacctgctgggggctgagggcaggggatcccaggtgaagaaaggaaggggcagcatagccctttggggccagtctccatctgctggtgtcttgcaattttgatctcattgaaacgaaggccgggcgcagtggctcatgcctgtaatcccagtactttgggaggctgaggcaggcagatcacctgaggtcaggagttcaagaccagcctggccaacgtggtgaaacccccatctctactaaaaaaatacaaaaattagctgggcatggtggcacatgtctgtaaacccagctactcaggaagctgaggcaggagaatcgcttgagcctaggaggcagaggttgcagtgagccgagatcacaccactacactccaacactccaacctgggcaacagtgcaagaccctgtctcaaaaaaaaaaaagaaagaaagaaagaaagaaaataggaaagaaaccaacagcagacttgctcagagacaggaggcagccccggtttggcaaaccctaaaatggagattgagaggaggaaggccgaggaaaggccagcccgctgggtttccactccatcatccgtgaggctcacacccaaggcggggctgcccaggcgtctgtctgggcacaagctggggactgtgtctgccttctgagactgctgaagaccggttctgaaggactgccattttccctgctctatgctggagggcaaggtttctctcaaaagcataaataattcccaaacaggtgttcctcctagattaccatataagccctgactcccacgggatgggtggccaatccatttctttttcttttctttttttttttgagacggagtctcgctctgtcgcccaggctggagtgctgtggcgcaatctcggctcactgcaagctccgcctcccgggttcacgccattctcctgcctcagcctcccgagtagctgggactacaggcgcccgccaccgcgcccggctaattttttgtatttttagtagagacggggtttcactgtgttagccaggatggtctcgatctcctgacctcgtcattcgcctgccttggcctcccaaagcgctgggattacaggcgtgagccaccgcgcccagcttttttttttgagacagatttttgctcttgttgcccaggctggagtgcaatgacgtgatctcagctcaccgcaacctccacctcctgggttcaagtgattctcctgcctcacctcccgagtagctgggactacaagtgtgcgccaccatgcccggctaatatttgtatttttagtagagacggggtttcaccatattggccaggctggtctcaaactcctgacctcatgatccacctgcctcggcctcccaaagtgctgggattacaggcgtgagccactgcatccagcctgctggtcaatccatttcatctcgtaagccaactcctaacacttgtacacaaatgttcatagcatcagtcttcattcgatagccaaaaggtggagacaagtccatccacagaggaatggatgaacaaagtgaggtgcatccaaacaatggaatattatttggccatgaaaaggaatgaagcactaatacatgtagagcatggatgaaccttgaaaacatgatgctgagagaaagaagccagacacagaaggccacgtagtgtatgacgccatttatacgaaacgtccagaataggcaaatccatacctattctgagtggttactggggtgggggagttggatggggacagctaaggagtgtagggtgtcttcttgggctgatgaaaatgtcgtaaagttgacggtggtaatggctgcagaagtctgtattagaaaccactgaatcatacacttcccgtgggtgaattacatggtatgtgaattgtacctcagtaaagctatgtttaagaaacagaagtgactgcctggagctcccaccaagtcaggtagccacgatgtgctcagtgggaagggcagtggggtccccacccaccacagcacctgcagcaggggtgcccagcaggttctcccagtctcataaggacacaaagcctcatctgtcctgggaggttctggtcacctgggctggctatgtgtatgaaggaagggtggctgacagcaagaaggtctgcatccactcgggtgagggaactcttacgttactttgcaacaggcaggaaggggacttattttctaggtctaaacacatcaaagaaagagaagtggaggctggagagcccctagcgaagagccacacagtgcagcatgcctgacctatgtgctgaccatgcggactcgggggggcacccatgggccccgtgacagagcttcaacaccattgacgtgcactgagaagacatgggtgccacacaggatcttcagacctgggtgcattctcaggcattccagctggagcgccatgcacccgcagccccagcccacatgcatgacccaccattgggtccaagcccccgaggcccctcattctaatactgggtctggaggcccgcggtgagccgggccacagcagcccaggctggaaggagcatctgcccgggtggggatgcccccgtgctctgcagctgcccacccgcccccctcaggccccagcagaggctacggcacaggcaggcgggcgttaccttgagctcagacagggactcacattccctggttggttttttgctggaatcaccagagggagggaaaagggaagtgagaagggacccttgggatccacgggatgcccgttcccccaccctgagacactcagaccccaaacaccagcttcatagagctggagccagggtggcgttgacagcagatgagtggacacctctctgcatggacacacagggtcctgagtgagaccacactgctcgcccagcacagagcctcaaacctccccatcaggcactcacggtcccgggccacaaaagtgcttttcttctgactgaccaagagccccccagctacagtgcaagtccccgagaaaggtaaacttcaggtggattagctgtcagcaaaaggaggtgggctgagcccaggttggggtgctgactgtcccagtgcaccaggtgggtttcatctgagtctctccagatggcaccacttcagggaggacctgtgcagagtggtctgggcagggctgccccaagcctagcctccagccaccactcccccacccaagaaggcaggcggccactcacgtgagcaagtttccaggcgctgacagtgagcgttcctcccgccggctgccctcgaatgggttcccaaaggagcgtttacgtatcatggtcttcaccaggatctgaagagggagaaaagaggaggtggcaggcaactgcttggccatgtgggggcgattctgggcaacatcctccctcttccttctccccagcccctgccagctcccagggctggtgaccgatggcagactttgagagaaactgggcagcaccaccccgcaaccaacccccgccgaaagaatcctctgggaaaaggtgctgtcctgcaccacaccctcagccactgctcagcgtctctcccaggcctccctgctttccacctccctccctcccatcccttccaaaacccagatctggtcccctcactccctgactcagcatccccacccagaggggtctggaacttggcctgtggtcagccagagagccccggaaagttctggagcaaggacgtgaaccagtcattcttggtgatgctcttggctgccatttcccatgaagggaatggcctgcgggccccataagagtcactgggcccctcaccccaccccaaccagggcacggtgccccttcaagctgttttgggaattcacagagcttctgactttttaagcatttgctgctaacaagaaaaataagtgtttaagaaacactgatttaccaaaagatgcaaacacccaaatgcccatcaactgaagaagataaactcaaagcggtctgtctgtgcaatggaacatgattcagccataaggagtgaagcactgatccatgctacaacacaaacggaccctgaaaaccttctcctacgtcaaagtagccaggcccgaaaggcctcagagtgtaggattccaccagaatacacaaatctatagacacagagggcaggtgagtgggtgccagggctggggggaggtgaatggagagtcattgctgatgggcgggggtgtgaagtaatgaaaatgttcagaactattgaggagataattgcatgtcactgtgaatgtcccaaatgtcactgaattgttcactttaattttatgttatgtgaattctacctcaatttaaaagaaggagcggggaggggggaggcgggcgtggtggctcatgcttgtaataccagcactttgggaggctgaggcaggtggatcacctgaggtcaggagtttgagaccagcctggccagcatggagaaaccccgtctccactaaaaatacaaaaattagctgggcatggtggtaggcacctgtcatcccagctacatgggaggctgaggcagaagaattgcttgaacctgggaggcggaggctgcagtgagccaagaccacaccactgcactccagcctgggcaacgagagcaaaactccatctcaaaaaaaaaagagagagagaatgaaggcctcttcccctactgaggttcttacagtcactgggacatgccagcccctctttcctctgtgtctgagcagatgtcactccccaggtgagcccaccctgccgcctcccctgtggccttgtcaacccagagcaggagctcctcctctgtgaagcccccagcccttgcatctctctgcactggcctctgatcacacaggaggctgattcttcccaggtccatctttcttataaggccaggagcccctcccccagccccccagccccctacccctgagagcaggcactgggctaagctcatctttgacacctatgcctggcacacactggctgctccgtgtttgctaaatgatgaacacatgcagggggcctggaccttgccatcttgtcccaagtcagaccacttcccagtatctacccgcccatccctgctccagctgccctggttcaaaccctgattcaaacccatgctcttggagtaaacatgtaaaacctcgccacaccctccctccaccttccttgccctgcttcagtggccccacccagtgtgttagcccgtccgccctctctcggcggagttaacaccctaccatcctctcggtgtctatccacttcttcccagtgggtccaagtgtgcctccattaggggcatgtcctgtggtccctctactgcactgtacatacatttgttggtttgaccagcatctgcctctcaagcatggcagaggccatgggggttttgttcatcactccacccagcccctgctcccagcacaggcctgagaaaccactcggtgttcaacaagtgtttcccgaataatgaatgcctactccagacctccagggccagacgctttctcccaagaacccgtcccagagacccaggaaggaaagggagggcaactgattcaggactgagaacctcctgagcctggaacacagtaacccacggtgggtgcagagtccgacgccagctgtctcctcgtctacaggcacaaggggtggttgaggaagggtgagtgggcgtgggtgggtcttcaacagtgaaggtcctgcacagccccaggtggggaaagagtggaggaagatgtggatggatgccccagccagggctcagctttgggaggaggagagaggaagtgtgtggggaagcagagaagagaggtgcaaagctggaggagcaggagcagcatctgggctcctacaggggcaatccttcacagctggaccttctgtgcctttccagccagtctcaagggtccctcccagagcccaggggcccgccggcccactggaactagtgctggccaactgcaaccaggcctttcgaggtggctgtggtgggacaacctgctggtctctgtccccaagcctgctgcctggaacctggatccctgggactcttggtctctctcttggagctaactgccctcctggacagggacttggtcagtggcgattcccagagcctccaaggttaggcctgaggactctacattctggctccttcttcctgggtcaggatccaaattcaaggccataaaaggggacctacttgctcctaagcaattctcactctcaggagatgggcagaactttctgagtgtgtgcgtggaagtccctgcccctacccctggtggctgcccacacagcagacgtgagatatgctacgccatccaccctggagcctaaaattccagctaggcgggaatcctggcttagagacctgggctccagctcccaacccttgcccctgcctggaacttctcctagttcctctcccctgatgagctctgaaagcaggaattccagaaggataatcttccccttcctatggtaacatggaacctggctcagaagatgcaggggtcacctggcctgatacatgaccaaggcccagaggccagcagctgtggattaggggtggcccccggacatctgactcccgggcacccgcctgtgtccggcctgtcctggccaggccccacctcaggctcctgggtccctgctctgggtcaggggtccatccaccttaccacggttgccaagctgggaatgtgtttgactgagttctcgacctcctcttcagtcacttcgaccagcgtgcagttctcatcctccgacggcaacggctccgccccatgcctcgtgacccaggggtgcagcttcaacgaacgacaggaggggtgaggggcaggtgtggctggctaccggggggccctgccagcgagcggagccacaagggcatgcaggacggagaggcaagggcctgtggtcaggcatgcaaaacagctggcgagcagagggcaggggtgagcaaaggggcggaaacatgaagacggagagacaggacgggaggagctacaaggctgaaatggaagtggggcgattctccatccggccccgggtcttggccgaagtgatgggaatttggcatctgccttgcctggctgcccaaggagcatccatcactcctcagccacaatccctgacacctgggaggctcagtgcacagcaggcagcattctccccatctcacagcaggagaggcttggaggcatggtgggaccagctggcaggacaggatcaggagaggacccaggcaggggtctgcccccttgggtccaagccccaatccatgattttttgggctgccttctgttaagaccttcaaatgccagttagctagctgcctaggaagtcccagggcaaatctctagatttcctagagggccagatatatgtgtgtggcattagtggagatgtgtaggggaatacactttcctaaaagtgctttctgcaagagggtgggattcagcaggctggggaggtcgaattgctcattaatttcctcccatcctcactgcagtttctcaaagggacgggcctttggaaaggacctgagctctgggaatagggtgtggagcacggaggccccatgccggtctgcagagggtggatcccatcagcccacgccaatcagagcaagtgcaggctggcgggtcatagatcccactcccacagtcacagtgcacacaatgcccaaatcttcctacccagccctcaacagcccccagcagctcagaggccctggggcataggagaacagcggtgccaaggagggtgtggtgctgtggacacaagggtgtggggtctggctgaggcatggctgagccaaacaattccgagcacggggcacaggctgagccaagggtaccttgatttccggcaccacgatcctcgactcggggttcttgtccagcatacgggtgatcaggtccttcaagtcctcagctatgtcgggcctggggatggagaggcgtcagggtggcagacacgggaccgccaagaactcggacaggagagatgcgggacggcgggagatactcactggtctggaaattccagggcctgactcttgatcttactgtgtaaacacatgatccgctcgtccatgaatgggcactgcaaagaggccagggacagagtggcagtcaatggcggccacatctgcccttcgagggccacctgtgctgtgccactccacataggatacagcagagaaatcaacaattgcggcccaggctagggggcaagcagttcccattctccccgagaatggccaagacacaggggtgtggggcctggccgacacagggcagagccaggaatggccctctcgaagggctagagcctttcccaagcacactgcaggctccctctgtagctgggcctcagtttacctacttacaccaaagcaaacactgctcgtcacctacttgccaggtgaacaacaggaacaacaagaataacacaaaagactttgtgttatttgtggcagcagcagtgattttcaagggcttagcctggatcgcgccacgccctgccctgaggttttcattcactgttccccgtccctggaatgttcttctcaccaacatctacgtggcttggtctctcccaccatgcaggtgtctgactaaagctcaccttctcagggaggacttcctgaagccctgtctaaaacagacaacccccaatgccgccaccgcccacatcactcctcatccgtagcacttatccctgacgttatcgtacagatttgtttattgtttaacccctcccacgggaacgttagctccaagaaggcagggatttctggctgtcttgctcactgcggactctccgtgcctaggagcgttcctgcacaaagtaagggctcaataaatatctgctgaattaatggatacttgaattatttctgtcaatcctctcagaagtcatcagaaataataagtagtattctcattttacagaagagaaaaacagaagttcagagaaataatgtgtcccaggaagtacgaagagggatttaagcctagattcagctgactctgaagcctatttttgcaccaccttctgggtgacaaatcgatgctttcacccagctgagggcctgactcaagagcagcttggtcatgtgtgctggaaaaggaatccttacacgggacactgaaaatgttggagaaggtggcagagaggtacctgaaccacccgtctaaggaaaacgatttcattaagagcagtgacttgagctctagctaatcactgccttctaaggcatttggaaggaagagtggagatggtggtaacttactctgaaatacattaagaaaccagatggactgagggatgggtaaggaatgaacagacaagcacaggaaaaggttaatatagtagaatccaggtggtgggtatgtgggtgttcactggacacttcttccagctttgctacatgattgaaaaattttctaatcaaatattgagaggcaatcggtataaactcctttacttcttcatgggaccagtttcttaggctttcctcaataagaacacaagctcaggaaagggaaaaatctacgtttttattgctcacataatcaaactgaacttcagagttaaaacgagaaggccaggcgtggtggctcacacctgtaatcccaaatcccagcactctgggaggcccaggctggcagatcatttgaggtcaggagtttgaaaccagtctggccaacatggcaaaacactatctctacaaaaatacaaaaattagccgggtgtggtggctggcatctgtagtcccagctactcaggaggctgaggcaggagaatggcttgaacccgggaggcggaggttgcagtgagccgagatcgcaccactacactccagcctgggtgacagagcaagactccatctcaaaaaaaaaaaaaaaaaaatagagagagaagcccccagatatcaataataacaaaataacaacaacagaaaagcccaaacagcactccctaaatcaataatggtaaacagcttttaacttccattccaatgctacccctctgacaaaagcttctaggaataccctgacggaaagaacatcagagcagtatcaggctcaggaggaacgagcacagttattgattagtgatgtctgccttgggctcagaaatgggagaggtggcagaactgctgtccttgccctaatttatcaactatttataaactctagagcctctgccaatccttctgttttaacagatcattttttcatagatatgatcatgacatacatacacatgtgtatttaggaaggcgtcctttttcacattgagatctaggtgtagaaataaaataactcttctcttattttattttttgagatggagtctcgctcttgttgcccaggctggaatacaatggtgcaatctcagctcactgcaagctccgcctcctgggttcaggcgattctcctgcttcagcctccagagtagctgggactataggcatgcgccatcacgcctggctaattttttgtatttttagtaaagacggggtttcaccatgttggccaagctggtctccaactcctaacctctggtgatccgcctgcctcagcctcccaaagtgctgggtttacaggcgtgagccaccatgcccagcctaaaataactcttaaataagtaagtactgtctccccgcaagggtgactattaacccaggggccacccagcagtactgaggggacagacaccccgccctcttacctggccaaagacaaagcagtatagtgtcacacccatggcccaaacatccaaggcctgcaagaaaaagagcttagtgtgagggcacaaggggcggtccagcctccaatcctccagttttcctttggggaaccacctcttgactttcagcccttggagttggggcgggaccaatcttgtctcctaggctctggggcaggcacaggatccaggccaggccaatgagagcaccactacccccagccacagtgattggttcaagcatgggcacatgacccatgttgggccaatcagagccaaccccagggttttcacaggcactattcagaatgaggaatgctcttgccactgaggttggcaaatgatagaaagtaacctggtccctgggtgcctgacccacctgtggaggaaaccaaataagaaaaacaactgaaagatggcgggagatggtttctgtttgagtccctggatctagccaagcctgaagcctacccctcagtatcttgatccaggggattcactgtttaagcctgtgtgcgttgggtttctgctgcttacaatccagaagacactaacacaggcagaactctgtggctgaggcaggcccaagcttaccttcccagagaagatcttgcgggtctcagagagcgactcgggtgccatgaaggcgggcgtgcccacggtgttggagaggagcgcgtcactgcccttgaattcattgctcacaccaaagtcagcgatcttgatgtgcccatcttctccgaccaggaggttggaaggtttgatgtcacggtggatgatcttctggtagtgtactggggaggcgtagacagcaggtgggagataggggcaggaaaacctcgtgagcacctctatgcggccacatggcctggagacacaggcatggcacccctctgatgccttgtctcccacagccccaggccttttccaaccttccactccccaaacccgctgggcactgacatgctctaaaagatgaggggaaaagtgtcttcaaggaagtcccagcccaccatcaccccaccccttctcaacaatgacacataaaacactgccaatagcaattcgtaatcgcctgttatttattaagtcacaagtgacagtgcatggaaagtttttgctgggcttggctcacagctagttgtgaaactgacagtgaaacatagtttcatttaccaacagccaatactcaactgacttaccaaaccgacaatgacctgagcaggccgatttgaaatgtgaaccacacacagaactcggggcttggctaactcctcctggctggatatcagcccatggtacaggacagttctatggcctggaagacccaactgccatttctggggtgatgatgatgatgaagacgatttcagtgaaagcagcagcagagcaccaagtgaggggcccggccctgcgttgtgtttcacattcacattttacatttaattaaacctcacaaccatcctatgtgacaggcagggataagagataacgtggtggccgggcacggtggctcacgcctgtcatcccagcactttgggaggcaaggcagggggatcacctgaggtcaggagttcaagaccagcctggccaacatagcgaaaccccatctctacaaaaaatacaaaaattagccgggcatggtggcgtacacctgtagtcccagctacttgggaggctgaggcatgagaattgcttgaacccaggaggcagaggttgcagtgacctgagatcgcgccactgcactccagcccaggcaacagggcaagaatctcaaaggaaaaaaagagctaagatgtttaacaagcagaagcagaaaggacacctgccaatcaaaccactgatgtgtactggctgatctcagccctggtgagagatatgttatccccattttacagatgaggaagctaaggttccaggaggtgaacaggaccctgatcccagggtcactgggaggaataagagacaaaaaaaatagagccccaaacagtgcctggtgcacatagaaagtgctaaatagtcactattgctactgctcttcattttgccaagtggcaggaagaagggttttggctcgcctggaccatggccatagggtggctctctgcagctggccctgattctgcatttcacacaattctgtttcccactatgatggttgatactgagtgtcaacttgattggactgaaggatacaaagtattaatcctggatgtgtctgtgtgggtgttgccaaaggagattaacatttgagtcagtgggctggggaaggcagacccacaatctaatcagctgccagcgaatataaagcaggcagaaaaacgtgaaaggtgagactggcctagcctcccagcctatgtttttttcctatctggatgcttcctgcactcaaacgtcagactccacgttctttagttttgagagttagatgggctctccttgctcctcaagcttgcagacagactatattgtgggaccttgtgatcgtgtaagttaatacttaataaactccccttttaattttatatataattatatatataattttatatataattatatatataattttatatatataattttatatatatatatatgtatctcctattagttctgtccctctagaggaccccaatccacccgcccacctccctgtgctccaggaagaaaataagacactttccactttgcacccacgctcagaatgctaactacccactgggtgagagccctcccgcaggccctgctcacagtactcgatgcctttgatcagatcctggaagtagaaacgggcctggtcttcagagagtggtttgagggtgggcacttccatcacgggcctgaaaggtcgacactcatgtgaaacacaaagcagacccgccagcccttgccctctctcatgagcagagcccagtggcacctcactcagctatgcagctacagaagcttcttgcatcacccctgctgggagctgggacactcacccttggttgaccagttcgaacactgtagggaagaaaagggtgaaactgttacatgggaaactgaacatccatctctctctgtcctccccacctcccaaccacctccagaaacaccaagaaagacagaaactagtattagagctggggagaggaacagtccactgaaccaagctggccaaggtcctgctttgctaaatttccatcagaaggcaaagaaccagggatttctgacgtccccaggcccacagtctggcttgacttctagtgctcaaattggcccaggatccactggtcaaagaaaacacggcagggggctgggcacggtggctcacgccagtgtaatcccaacactctgggaggccgaggtgggcgaatcacctgaggtcaagagctcgagaccagcctggccaacgtggcaaaaccctatctctactaaaaatacaaaaatcagccgggcgtggtggcaggtgcctgtaatcccagctacttgggaggctgaggcacaagaatcacttgaacctggacagcggaggttgcagtgagccaagattgcacccctgcactctagcctgggcaacagagcaagaatgtcccaaaaaaaaaatttctttgagatgaaatttacgtaacataaaattacccattttaaagcgtgcaattgagtggcatttagtatattcacaattttgggcaatcatcacaactatctagttccagaacattctcatcacctcaaaagaaaacctcatacccattagcagtcactccctattcttccctccctcaatcccctggccaccaccaatctgtttcctgtctctatagatttgcctgttctggacatttcatataaatggaattgtacactatgtggccttttgtgtctggcttctttcacttagcatcattagcacgtttttaaggttcatccacactggtgcatggatcagtgcttcattccctttaatggctgaataatattccattgtatggatagaccacattttctttgtccattcatctgttgaggggcatatggactgtttctactctttggctgttgggaagtgctgcaatgaacgttcgtgtacatggatatgttcatgtgtggatatctgtttttggttcttttgggtatatacctaggagtggaatttctgggtcacgtggtatagttatttaatttgattctgctatgacaagcataaattggaatacaaggctgtactttaggaagttaaaaaaaaaaaagagcacagtcgatttcaaaatccagtggaggatgactctggggttgcttgttgttctggaatcatacacccacaatgagatgagcatgtaatagaaaccagaggggataccccattttccatgatgggattattatgcactgcatgccggtattaaaacatctcatgtaacctatgactatatccacctaccatgtacccacaaaaattaaaaaaactttttttttttttttgaaatggagtcttgctctgttgcccaggctggagtgcagtggcacgatcttggctcactgcaacctctgcctcctgggttcaagcaattcttctgcctcagcctcccgagtagctgggactacaggcacctgccaccacacccggctaattttttgtatttttagtaaagatggggtttcaccgtattggtcaggctggtctcgaacttctgacatcaggtgatccacccacctcggcctcccaaagtgctggggttacaggcaaaaaaattttttaaaaatgaaaccaaagggttgtttcaaagctctccaagggctgaggtggccaaggggaacagggaagctactcagacaaaaagaaggcttaaaggttctgatcaggaaaagaactgaactctcccaggccttccccatcttcagtttcatcaaccagtgtgagttagggcagatttgccattgcttcaggctgtagttaaaaacaaaggcaatgctgctaaggtacagcttctacagacaacccagcgctggccccctcagctctggcctttcctgccttggttatttaagtcttcacttgcaagcttcatgaatttctgcaccatcctcccacccacccaagcaccataaatcaggtggcatgagggagggtggcctgttgaaacaggtctattttcagtcgctaacagttcaaccacttttggggctgagcagtgggtgggaattttttaacctctagaaatagagatcgagttttctactttttttttttttttttttgagacaaagtctagctctgtcacccagactggagtgcaatggcacgatctcggttcactgcaacctccgcttcccaggttgaagtgattctcctgcttcaccctcccaagtagctgagattacaggcatgtgccaccacatctggctaattttgtatttttagcagaaacatggtttcaccatgttggttaggttggtctcgaactcctgacctcaggggatccacctgccttggcctcccaaagtgctgagattacaggcatgagccaccacacccagccccctcctccacctttttttgttttattgagacagggtcttactctgtcgcccaggctagagtgcagtggcacaatcatagctcactgcagcctcaaactcctggcctcaagcaatcctcccacctcagcctcccaagtgctggggttacaggcatgagccaccgcacctggactgagttttctgccctttgcatgtcaggcctgtagctgcagaccctttctgatacctactacccggcctcatgcactgccctgtctgtctcagtctcacacggctgtggctggaaagtaaaatataaccgtgtcaggattttcaaaaccactggaatcacataccccaaattagcatggctttctgcaactgccacctcgagttgtgaaaaactatccctgcagctgcccagctcaagcagatcacgaaactcttctttgaggcttggaccatgttctctttattctcattccacccgtcagctcaaaccccccaatggcttccatcactctcagagtcaaagccaatttttttttttttttttttgagacagtctcactttgttgcccaggctggaatgcagtggcgccatcttggctcactgcaacctccgcctctcaggttcaagtgattctcgtgcctcagcctcccgagtagccaagattataggtgcacacccccatgcccagctaatttttgtatttttagtagagacggggtttcgctatgctgcccaggctggtctcaaactcctgagctcaggtgatccacccgctcggactcccaaagcgctgggattacaggggtgagccactgtgcccgatccaagttctttacaatgttgtaaaataccttctgccacctggtccctgctgttctgcccaaatgtcaccttggtgagacattccctggggagccactgtatttctccatcccccaacccaaaactagcagcccctcgtgtcctgctcggggtttttgttttgttacggtgttgtcgctttcaaaacccacgcatcacactcaggtgcgctccccaaggacaggggtttttgaatgttgtccctgatgaacctacagcagggtctgacaaattgtaacatttgttgaatgaacaaaggcacgcctcagaaagagctcaaagccattctgacctggatctggggtcccaagtgagagaattacgctaagaatgccattctgggctaaaatgacttttggcatattgtgatttctgctgtatctccccaaacttcatttatttgcctactatgtttataatctggccatacctatatgccacatcaattatttattgaatgtttttctttaaattgactcagtttttaattttttagccttgtcctagatgataatatccatgaaactatgagtttggggtgctggttatagtttttcctatacaatgttaaattaaatataaaattgtttttctaccttttttctgtgtaccacctagaacagtgcccaccatataggaggttgtcaatatatacatgctttgggaggccaatgcaggaggatctcttgggcccaggcatttgaggccaggctggacaacatagtgacactttgtctctagaaaaattttaaaaattagctgggtatggtggcccatgcctataatccagctactcaggaggctgaggtgggaggatcacttgagcctgggagatcaaggctgcagtgagctgtgatcacaccactgaactgtaagcctgggcaacggagcaagaccctgactcaaaaaaaataaatacatgcaaatgaatgaataggatcagataaagttccagcaagaactcccttccacctgctgatcccaaccaggggtgtggcctccggtggggccagctggaccaggaaagggaaagctgtctttggtggaaggtgccagggcacaggctgcctcgagaggacccctgggcattggcaggtgtggtgcctgggtgagggtggcagaagaaaagggcttccttacccatgtacagatggtcctcattggggtcatccaggaccttggcacagccacatggaataggcaggagacggatggcgggggagaaaaagagagaatagatatgagcagggaggaggcagcatccacgtggctgcgtttgccaacaggagggctgcatttggcagcgtgtttcccagttaagatggaagatagggaaaacccccagagtgtgagatcctaatggctattcggaaaataaatgcctctctgtctgatcctcgaggatctgaacactcagaaaggaggtcgcaaaagggaggggccaaaatactcccctggaaatatctcatgcttgaataagaatccagcctatctccggctgggcgcagtggctcatgcctgaaatcccagcactttgggaggccgaggcgggcggatcacctgaggtcgggagttcaataccagcctgaccaacatggagaaaccccatctctactaaaaatacaaaattagtccggtgtggtggtgcatgcctgagtaatccacctactcaggaggctgaggcaggagaatcgcttgaacctgggaggcagaggttgcagtgagccacgatcacgccattacacttcagcctggatgacagagcaagactctgtctcaaaaaaaaaaaaaaaagaatccaacccagctcctaggagacaacggtgttcagggtgaaaattcaaatcctatctgggctcaagtgactccacgaagcctccccattgcccctaaccccacaggaaatgatgtctccctgcccagaacagccacagcactttctctctctccaaagggcaggcatcaggctacatccaccttgatttcctcggtggcgtcctgtacagggcacggcatacagaaggtgcccagggaatatctgatgaatgaacaaacagatgggctggcaaagagtcttgttgggtgaaaaggccaaatgccatagggcagcggagagaaaagacaccctgccaggacccagggcccctcgctaaccaaatgcccttgggcttcctggaaaatggccaactctagcaccagtgagtcgagattgtgtcacttagtgtgaccggtggtgatggcctacaactgccatctctcttctttgggaagaaacaaatgcagcctccctggctagactagtccccctgattcttccctcatcacgtccgctttctccagtcacccaagatcaataagacaacaggccccaagaaagggaggcaccctaggcagagcctgggctagcagcctgaagccctgagccatgccctgtggggaaggcacacccagggccttgtccgcctagagttctgcaccagatgagtcccaggcaaagtggtagctagccctcacatctcccgaaggcaccatgtactcccccaaacagaggcttccagccctttccacatgcagctccctgccctgcaatgcctttccgtgacttctcatccaggaaccaccacggccatctcaaacatcacttcctctaagaggcctctcccagcttctcccagtgagctggctgcccccgctttgtactcccatggcactctgaacatccagcacggtgacaagtccttgtcgtctagaccagaggtgctccaaacacaatctggagatgtctgcagatccccaagatgcttcatggagtttacaaggttcactattttcactttaaaacgaagacagtatttgcctttttgactatcattctccactagtctacagggttttccagaaacctgatgatatgtgatgtcacaaaacattgaatgcaaaagcagagatgagaatccaaatgtctcctatcaaaccaaacagtaacccaaaaaaaggcaaaaatgaaaaatgaagccactcttctactttttatttttcataaaaatgtattactcggccgggtgcagtggctcactcctgtaatcccagcactttgggaggccaaggcggctggatcacgagttcaggagatcaagaccatcctgactaacacggtgaaaccccatctccattaaaaatacaaaaaattagccaggcgtggtagcgggcacctggagtcccagctacttgggaggctgacgcaggagaatcacttcaacccaacaggcagaggttgcagtgagctgagatcgtgc

SEQ ID NO: 696 - DNA, 151552 bp, Homo sapiens
  misc_feature (1)...(151552): n = A,T,C or G
agagaggtaatggactccagatgacttcaagctaggcaaatgcttggaactccttgagaacagaaagataattattgtccccttaaaatattctcctgcctacagagaaaaagagagtacaccaactctttttaagaagctgtatcacctcactgaaaccgccaaaaacaaccgcagacgaaggccgattctagacacagacgcacacgtgctcaatgacacagctgcaaagtcaggtcagaggaccaacatcagcctcttttaacagacagggtttgtcttctaaaacgcaggaatagttaaatgtcaggaagctaatacaataatataaataaaatacatgagaagccaaaggcagccggggggagatgcaattatccttggataccccccccaaaaaaatccaacattcatgctggctagatgtttaatgtcatcacaaatacctactttaacaagcaatgataaactttcaacttaactgtgagctactagtggcagtcccattaaaatcaaggatgagactaacgttgaatcaaagaaaaagagaaaaagagatataattattacaaagacagaaaaagaaactatattatttgaagacaaagaatgaccatttgaaaatagttcactgaaactcacagaattttataaaatcccatatatgaggaactgaaaatacataaagtagttaccaataaacctaacataaaaggtagagaacctaaagaaatgtataaaactttccaagattccataaataaaattataggaaattttttttctttttgagacagagtctcactctgttgcccaggctggagtgcaatggcatgatctcagctcactgcaacctccacctcctgagttcaagcgattctcatatctcagcctccgagtagctgggattaaaggcatgcgccaccacgcatggctaattttagtatttttggtagagatggggtttcaccatgttggccaggctggtctcaaactcccaacctcaggtgatctactcgccttggtctcccaagggaaaatcttttaaatgggaaaaaatccataagttaagagataaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaaaaaaaaaaaaaaaaaaattgcgttatacctgcaatatatccgtaatgtgtattaatgttgttaatgtgctattttccattatttgcatattctacttagctattttatataattattttctcagcaaatactaattttaaacagaaaagcaaacttccacttctccaagctgttaaggttttacttagcaatatttaatatacacagttatataaatgtgactagttataacttggcaatatgtatgaaaagctttaaaaatgcatataccctttgatcctgcaaggttatttctggaaaatcctaaaggaaatgggctccaaaggtttatgcagaaggctgttcatcatgatattgtttaaaactgaggggagaaatggaaataggacgggaccattcataacttgctgcaaaagaacattcaatgacagaggaaatatagaccatctatttctaacatattgtaaaataggttacgaaattaaaagtataatatgattgcaatttttaaaatatacacacaaactacagagcaagagtcagatacagcagtatctctgcatccaaagcatttatcaaagtgcttagcacatactaaatactccataaaaaatatatatttttatatattatatataatatatatttatataggtatataaatatatttattttatgtatctatatctataaattttatatatatatatatatatatatatatatatatatatatttttttttttttttttttttttttcaaaacaaagtctcactctgttgcccggactggagtgcaggggcatgatctcagctcactgcaacgttcacctcctgggttaaaaaaattctcctgcctcggcctcccaagtagctgggattacaggccctccccaccatggtcagctaattttttttgtatttttagtaaagacggggcttcaccatgggggccaggctaatctcggaattttaacttcaagggatctgcctgcctcagccttaaaaatgctgggattacagggtgtgaggcaccgcccctggactatagttcttttttttttttttttgaaacggagtctcgctttgtcccccaggctggagtgcaagggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggctcttggggagaatctgttttcttgtcttttccagccttgaggggcatccacatgtcttggctcatggcccttcctccatgtccagagccatcaggctggtgaggtcttcctcactctgaacttgattctctggcctccctcttccacttgtaacgacccctgtggttatgttgagcctgcctcgatagtctaccgtaatacccctcccctgtcccagcctcatgggtcctgggaattaggatgtggacatctctgggagcaattattctccctaccacagattcatgtccttaccatatgagaaaaatcttcactctgtctcaacatctcccaaagcctaaacccctggtgaaccacctctactgggcgggcgtttctatgtctctctgtgtttttggaaaagttcttacaggtctgtagtaagaaattcaaacaatataaaatgttacagagtgaaaagtaagtctcactcccaacccagatttttttttttttttgaggcggagtctcgctctatcacccaggctgcagtgcggtggcgtgatctcagctcactccaacctctgcctcccgggttcaagtgattctcatgcctcagccttcggagtaggtcggattacaggtgtgccccaccacacctggctaattttcgtatttttacaaaaatagagacagaattttgccgtgttgcccaggctgatctcaaactcccggcctcaggtgatctgccctccctggccttccaaagtgctggcattacaggtgtgagccaccgcacctggcccatcccagatctgtagtcttccaggtctctttcccagaggtgacaacagttattattttgtgtactatcacagatgctctgtgcatatagaaatgtgtgtttatggcttttgtttttgtgcaagcatcttttgttcaccaatatgcgttttttttttggccagtctttctatgtgagtacacacacacacacacacacacacacagagctccaaaaaaaaagagttggtcttcaccaatgcacaagtaagttgcttctcaaactgtgctacttttagcagccttgctggagccatgtgtattattgttgagcttaatatctggaggctgaattcatagcagtggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctaaagaatcccctctctgggagcaattattctccagaactggaggtcaggtgatgaatttgtgttgtctgaagccactgggtttgtggtaaattattacagcagcagtgggaaactgatacaccctattgccacaaagggactgtattagtccattttcaagctgttgataacgacatacccaactggcatggcaattggatatgtctgggcaatttacaaaagaaagaggtttaatggactcacagttccatgtggctggggagacctcccaatcatggcaaaaggtgaaaggcacatctcacatggtagcagacaagagaagacagcgtgtgcagggaaactcccctttataaaaccatcagatcatgagagacttattcactgtcatgagaacagcacaggaaaggcccacctccatgattcaattacttcccaccaggtccttcccacaacacacgggaattgtgggagctataattcaagaagagatttggatggggacacagccaaaccatatctgggatattcccccaataaaaactgctactaaaggaggctaagtaaaacagtgggagagtcgttttcagtgaaattcccaaagacagaaaaatagacacctaaaagatacacactatcaacgaggttgtttaaaaggtgtgaacatatttagtacttaagatgacagccctttcttactcaatcagaccagcagcaataactcatatatgtcaaagctaatttgacctatctggagaaatcacaggactttcactccagacagccccaggttagaattctgcttctccgcctagaacaggcatgcctttggccaagctactcagtgactgtagtaaataacaatgtattgtacacttgaaaattgctaagagaggggccaggcatggtggctcatacctgtaatctcagcactttggaaggccgaggcgggtggatcacttgaggtatggagttcgagaccagcctggctaacatggtgaaaccccatctctactaaaaatacaaaaattagctgggtgtggtagcacatgcctttaatcccagctactcgggaggctgaggcaggagaatcgcttgaacctggaaggcagaggttgcagtgagccaagattgtgccactgcactccagcctgggcgaaagagtctcgactctgtctcaaaaaaataagacttataaattcacccatgattacaattgaaaaattctggaagtcctctgctataacatgatgtagataaaatatttttgcaaactctctttttattattgtatatatatatggtgtacaacatgatgttttaaaatatgtatacattgtggaatagctaaatcaagctaattaggccaagcacagtagctcacacctgtcatctcagcactttgggaggccaaggcaggaggattgctccagcccaggagtttgagaccagcctgggaaacacagcaagatcccatttcttaaaaaaaaaaaaaaaaaatcaagctaattaatatatgtattacctcacatatttatcatttatttggtgatgagaacacttaaaacctactactgtcttagcaatttttttttctattttttgagacagagtctcacttggtcacccaggctagagtgcagcggtactatcttggctcactccagcctccgcatcccaggttcaagtgatgctcctgcctcagcctcccaagtagctgggattacaggcagtgccaccatgcccagctaatttttatatttttaacagagacagggtttcactatgttggccaggcagctctcgaactcatgacctcaagtgatccacccgcctcagccttccaaagtgctgggattacaggtatgagccaccatgcctggcccctctcttagcaattttcaagtatacaatacattgttattcactacagtcaccatgctgtacaataaatcttgaatgtattcctcctagctgaaattttgtgctttttgaccaacgtttccctaatctcctcacaatcctgagcacctggtaaccatcctactactctctgcttctatgaatttgactttctggatttcacatacaagtgagaaccatgtggtatttgtatttctgtgactggcttattgtatttcgcattatgtcctccaggctcatccatgttgttacaaacgacagaatatccttcgttttccattacatatatatatataccccattttctgtatccatttaacatcaatgggcacaggttgattccccgtcctgcctattttgaatagtgctgcagtgaacatggggttgcagatatctcttccacacactgatttcatttcctttgcacatatacccagaagtgggattgctggatcctacggtagttctatttttcatttttcgaggatatatttataaactcttattcactcttcaaaaccctattcagtcatcccttgtttctgaaatcttctccaggtctctcagaagtaaatcctttcccttctatgtcatgccatgtatcataaggtcttgggttttatttatagactagaagattctcttatttatgtctgcaccccttgctctaatatgatggcactcaaagttaggtcctcaaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctcaaaaaaaaaaagaaaaaggtacaataacccctgggaatctgtggataacaaaatccaaggatgcttaagtcccagatataaaatggcacagcatttgcatatcaccttcacacatcctcctgtatactttaaatcatctctagattacttataatacctaatacaatggaaatgctattcaatagttgttctgctgtattgtttggggttttgggggggtttttggttttttgggtttttttgttttgttttgttttgttttcgtggcagagtctcgccctgtcacccaggctggcgtgcagtggtgcgatcttggctcactgaaacctctgtctcccaggttcaagcgattctcctgcctccgcctcccgagtagctgggattataggcgcatgccaccacgcctggctaatttttgtatttttaatagagatggattttgccatgttggccaggctgatctcaaactcctgacctcaggtgatctgcccaattcggcctcccaaagtgctgggattacaggcgtgagccaccgggcccggcctgtgttgttttttatttctatatattttttaacattttgatctgtagttgcttggaactgcagacatggaacccacagatacggaatactgactgtcttcaaggtgatagacatgttcattaccgtgatataatcattccacaatgtattcatagtccaaaacatcacatggtatcccataaatatatataattactagttgtcaaactaaaagtaacaatgtaaattttaaaaataaattcaaataaacaaaaaataacatcagtgggtattatatcagaatatcagaaaagcaggtgctatgggcctgacgtgggatgtgctgggctttgggagttcacaggggtctgggaaggttatgtcactgaggggcccacagcgcagaggatagcaggtcctggcagaagcctcggcgtgtgttggatgtgaagcagagaagagatgcaatctggctgagcatttcaccagactcagcctgactgctgtgttgaaagtgaaaagagacaagctaagaggctttggcaatgaaccagggagggctggggtggtgacaccttccctctcctccagcctctgaggtccttatctgtcctgctaccagcagctcatggccttgcctcctctacagagaaagtcacagctgcaagacaggcacaccgtcaagtgccccccaccatgcccacccctctggcacatgcaggcctctgggcctctccctgaggtcccagcagaggccacactccttctccagctcacccctccccaacagctcaggagttaaccacccccacagtcatgcctctccctgtttcctcttcccactcacattcaggcagcatcaaatatgcccgagccccttagaaggtttccccagcaacccagcatcctccccgaatcaggctctactctctcctcccctgctcatcgcaaaaggacttctggaaatgaaagtgtggcacacattcaccgtctccatctcccatggctgcccactcctgggcttccacctgccactactcctgcggaacaagatcagacaagatctccacggaccttcaggtgccaaccctcactgcccctttggcgtcttgagcagatgggcctgttagcaacatccagcctcgctaaccagcccttctgcttgggaaattcctcttcttcggcttccctaagttttctggatttccggggccctctgccttcccagcctgtctcctttctgatcatgttatatcccagtttgccccacccctagtgcaggactaagcaaacttcatcccacactcagcttctcatcttcagcccggaagcctctcggagtgcccgtgggttgcaactgccctaattcaacaaaaacttacagtgtgtcgtctgacaggcacctcgcagtcagcatgttaagactctcctgccccagccgagctggcatcagccagcattccacgtgcagggacctgcccacagtgcacacagcggcacaagccaggcccctggaagtccccctagtgctcttctctccccgctgccacagcatcgcagggtccttccagatagtattcagatctacacacttttttttttttttttttttttttgagatggagtcttgctctgtcgcccaggctggagtgcagtggcacgatattggctcactgcaagttccacctcccgggttcacgccattctcctacctcagcctcccgagtagctgggattgcaggtgcccgccaccacgtgtggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatcctcctgcctcagcctcctgagtagctaggaccacaggcatgcatacaccacatcagctaatttttaaattttttttgtagagatgagggtttcaccatgttgcccatgctggtctttaactcctgggctcaagcaatcctcccatttcagcctcccaaagtgctgggattacaggcttgagccgccatgactgcctgccctaggttttttgttttttttggtggtggtggttttttttttttttttttttttagatggagtctggctctgtcacccaggctagagtgcagtggcgtgatcccggatcaactggctcactgcaaccgctgcctcccaggttcaagcgattctcctgcctcagcctcctagttttgctttcttaatagcactaatccctatgtgaaatcacctccttcattcctctcccatactgggatgctggttcatccaacagagccaggaacacaaagggctcctcactgctaaacccaagcggagcatcactgacctatttaatagaaacctgcaccatgaaacctgagtgtaaattttccagcaaatttcagaaaactgatggatcctctcttggtcatttctgcttatgatctttaggagaaattagctgaaagggacatgaaagtgttggtggagtctcaattgctcattttaatgatgaggaggccgggcacagtggctcatacctgtaaacccagcactgtgggaggccgaggcaggcggatcacctgagggcaggagttcgagaccaacctggccaacatggtgaaaccctgtctctattaaaaatacaaaaatcagccgggcgtggtggtgcacacctgtaatcccaactacttgggaggctgaggcaggagaatgcttgaatccaggaggcggaggttgcagtgagcccagattgcgccactgcactccagcctgggtgacacagcgagactccatttcaaaaaaataaattgatggggaaacaggcccacagaagggaagtaaatcgggaaatttcatgaagcaagtccgcttttacacacacacacacacacacacacacacacacacacacacacacggcttctgttaagctgcaggctctaatcctggcacttcccaggcttcgcctcaaggaatatgtttatccggctaatacaggccgagcgcccgctgtgcgggtgggaggcggcgggattaacggggcggcccctccccgggcccccgccgggcttgcgttccagcgaccagaacacagaccaacaagtaaacaaataagacaaaggcagaaaaagatgagtgtgaaggagctaaccagccaggaagacgagaatagagagggcagaggggaggtgggaaagggacttcggggacaggaccccggacgccggcacacagccgagacccgatccgcgagggcagggctggcaccgcggtccccggcctggaaacgcgcccccgccgggagctccgcggaccccgctgcgcatccctgcggatcctgctcccatcctgcttctgcagcgaggccttcccgggcccctccacgacaggctccgggcctgttcacctgctcagtcccctccggagagcgcgaggccaatgcgccggccgcacggagacccggggacacgcgcgccacgcagaaggcaccgacccccgcgcgcccggcaggcggcaccggcccatccgtttgtgcgcgcggctcgggacggccccggcgcggctggagggggcctggctgagcgccccgcgtccccgggtcccgcgtccccgccccccggcccccggcccaggcttcgtaggccccggcgccctgcacctaccgaacgcgctgggccgtgaccgcgttgccggtgtgtggccgcagcaccgccaggaacaggagccgcatgccgccgccgccgcccgggccatcgaccggccccgccgccgccgaccaggccccggggccggcgcagacgcggacggcgggggagccggggcggctgggtctgtcccgcccgcccctccccgaggccgcgccccagctcgcaggttccggcgccaggcggggagggggacgggaaccgggggcctcgggcggcgcgagccctgggtgcggggtggcgcgggtgtgccccgtggggtccatcaccagggtagccgcggtccgttcccacctggaccaggaccagcggtgaccacagtcccttccacggggaccaggaccatcggtgaccacagtccctcacacggggaccaggaccagcggtgaccacagtccctcccaagaggactaggaccagcagtgaccacgttcccttccacagggaacaggcagcggtgaccacagaccattctcacggggaccaggaccagcggtgaccacagtccctcccaaggggaccaggaccagcggtgaccacagtcccttcccacagtgaccaggaccaggggcggccttggtcctttcccacagggaacaggagcaggggtggccatggtccgctcccatggaaaccagtgatggcttccatgggcttcattgggaaatcagggcttcacggaacaccgggttggctgcaggtctgtgcccaccaggaccagcagagacctcgggttccgtcccacagggtgctgcagagaggggctctcagcctcattttccatgacaacctgagtggggccttggtccgcatgaagcccaggattcctttctagtcccattccagggaacgtggcatgatcagtcccaaattccttcccaggctagactaccttaaaactaacccgaggaggggaacatggggactgtgtgaggagacagtagaaacccatttcagggccgcacctgtcgggtgagaaagatgttggagaggggaacctggggttcatcagggtacatgggctgcacctggtctggatctccaaactaggataccttgagtgagagaaatagggaactgaaggaggcctctggcaaaatgccatctgtggatttaaacaagcactccccaaaacagctgttaagtgtttacaaagatgcacatgtatttacagatgtgggacattctagtgggtgcccaatatttccattgaccttcaaacttgattttctgtcatcccctaaataccttccagcctcaaaaagggaaagtgggaatgaagaaagccatgacatgggataaccaccgtcagtggcaggtctccggcctccctatgcagcatggtgacccccaggcttatcaagatataaaagtccatcctggagggcacattcggctccgcaggcttctcccaggtacgtccaccactctgcctctcagtgtggcatggagtagggaagagttgtatatcattgtagaacaatcaaaatcctgtcctcctctcactctcaaaaaaacacccaggattttgctcttcttcctggtatttcagcttcccaggaaccaggcaggcaggccacatcctttttaaaggacaaaagcgatctgaaaatattatcattctgctaaacaacttaatactttccaacagaattacataagcaaacaggaaaggggacaagttgcacagagctgtcacaacccccttctaacgacattttagaaaaagagttttgaccccgggcacggcggctgactcctataattccagcactttgggaggccgaggtgggtggatcacttgaggccaggagttcaagaccagtctggccaacatggcaaaaccccgtctctaccaaaaatagaaaaatagatgggcatggtggtacaagcctgtagtcctaggtacttgggaggctgaggcatgagaatcatttgaacccaggaggcggaggttgcagtgagccgcgatcatgccactgcgctccagcctaggcagtaaagcaagactcagtgttaaataaataaataagttttgagtggactcctgatatatttgctacacaccaagaagaggcaataaaacgcagtgtctggtgtggtatacagaagtagaggggggcacttgcccatgatcttcccctatttcaccttgcccatgggatattaaaagctaaatgtgaacagatacatttctgattttacaaaggcgacttcagcatgagcccagaaaggaacctccctaaggagagttgaactggcagccttgtgggctcaatatcatccttagatgtatttaggctacaccgtgtttttcataaaagctgagctattattttttgtttgttttgagacagtgtcactctgtcatccaggctgggggtgccgtggtgtgattatggatcactccagcttccacctcctgggctcaagtgatcctcccatctcagccttccaaaaaagtagctggaaccatagatgtgcaccaccatgctgggctaattttttgtattttttgtagaagtggggtctcactatgttgtccaggctggtcttgagctcctgggctcaagcagtcaactcacctcagcctcccagagtactggaattacaggcgtgagccactatacctggccaagccaccattttttaattgggagctttcatatagaagttggaatttctgatatctgttaaaaaatgagagatctgattaaatgaagccaccatcctgtggctgactgaagctgggaagcagctgcctgcttaagatgaaatctgaatgtgccatttcacacagtgcttgaaggctcacttcaattccttgataacctcgatctgtattcttgtgtttagaaaaaatttgaagtttatttttacgtaaattaagttcagaagaaggtggcccaagcctaatatagtggctgtaccatcaccaggaacccagactttcctctgtctactccatcatgctagtgtttagcttctagtctcaagatcaccttatcaaggaattgataaggagtaggactgctacagctccacccatcacatcaacattccaggcagcaggaaggaaggaaaggcaaaagtggtgcactccagatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatctgaggagtcacaagtgatatttgccgaagggatattttaaaaagcaaacccgggatggcctctccaggagcaagacagagaagggggatttcaatcagggaagtgggttgaactcaaaagagcgtgcctctcatttgcaatggccagggctcaccagcattgtggggggaagtggtgttaccatggaaacctctttcgggctttgtggtccgtactcaggctcttctcactcatgaagtccgaattggtatttcataaaaattttaatatgttctaattattctgaagctgctgcctccgtaattgattttcatgtaaaagaacacaatttccctgcatttcctggccaaagtgtaattgtgcctatttcagaaacaagtttatcaatactttcatcgacatctacccaaaacagagggtcaaagttctttttccttttcttcagggaataagcacagcaaatgtgtattatccagaagggaccctgagtgaggctgcagttacaggccctcattagggattttctaccgtaagaaaggagaaattctaaactaagcttgctttatttttttccagcagaacatttactacacaaatacccggaataatactggaacatattcactcataactgcaggcttcagggttatataattccatttcatgagaatcacagaaatgcagagagtgagaatgatgacctctctccctttggaagcacaaacctgagtgtaaatgttaagccttggtgagtaggcaaaaataaaattaactcccagatatctcaggcctcctcagtgcaggtccttctgtgtgtgaaaaattggcttttaaggggagagattcatgcttgataaataaagcctaatttggaaatctctgcagagcttttggaccaaggatcaaccccctgcctgtcttcattctaatgtggttaaaacaccaatggccattcattcactttgtctctgaaggaaacatgatgatattattagcagagagctagaaactggagtggaagggaaaacacgtaagaacagcagaactggagaagatgaaataagacagaaagggagacaaggagtagaggggagaaagaacagaaagtcttacctgatttctatatgagtcgggactcttttggttccaagacataagaaattcaactcgaagtgacctaaagaagagaaagtttgggggtggagggaggaggctagctgaaattaaagatctatgaagcttcaggcatagctggatccaggtgctcatacaaggtctgagtgtggtcactctctctgtctctcagttctgtcatttcctgcattacctgcatttccaggcaggcagaaccatggctgtcgggaatgcccagattgcttcacagcctctccatacttccaggaaaaagaaccattttttccctaaccattaaaaaaatacatataattgccaggcacggtggctcacccctgtaatcccagcactttgggaggccgaggtgggcagatcacgaggtcaagagatcgagaccatcctggctaacacggtgaaacccagtctctactacaaatacaaaaaattagccgggcgcggtggcgggcacctgtagtcccagctactcgggaggctgaggcaggagaatggcgtgaacccgggaggcggagcttgcagtgagctgagattgcgccactgcactccagcctgggcgacagagtgagactctgtctcgaaaaaaaaataataatacatataattgaatatttttggatcgctgcatccatgtctacttataaagtcatcactggctaagggtattcggtgttctgattgcctagtcaaatgtctctacctccagagccaaggaaaacctcatagactaaaagtggagtgggttcatcccccaaaacatcatatggttttgtgaccaagagaagagagaatgcatgcaggactgggaacagaagagatgaagacgacagggctttacctaatgacttaaccctcagagaatcagtatgtttcagaggccaaatgctgctcacccctacaaccccacgactgtttgtgaatgactccagctgcgtttgcctccctttcccaacgagcacctggcgcaggagtgattataagcaaccgcgtctcattcactcctggaccctacacacactggtattaagaaaatgtttattttgaaaagggattcagaagtggctatatttatttttatatttcctcttgccctagttaatatttttgtggtcttgacaccctgtctttaagaaaatgacacatcgcccttttcatttcccttctcttcacccccaactgtttgtgagcccaaggtgcttggaaaagataacagggtctttaatatgatataaatgtagggggtttttctaggtggacggctctgggatgttgtcagatcagtgaggtggggggtccgcatgtgctcacctgggcaatgctgaaatagtttataaaagctgtgttcagccttcatcagagcaaataacaacctctccaaacggaaagtaaatcaatagcagctgaagactgggttttcctggttcagagacagacaatgttaatactatgctcctctctgattcccttttacatttctgcagacactggtttagaagagttagcagagaaaatggtgtgttttggagaaatgctcaccctgccccacagagacaggtgcatttaagaagatagttttacattctgaaccagcaggacttgagacacactttacactgtgttatcaggaaccaaaatggtataaaatctagctaatttttcaggaatttcctttgctaaatttatacacatgcaaacacacagacacacacacacacacacacacacacacacacaaatcctaggatcccagacagctcagcttctccagggccacacactaacaagcaaaaataagcaaaggaagataaaatagtccagcagctagaagtaatgttttaagaacagctttaattaagatcaaatttttgttgttgttgccaagattagaggttgattccagctactgagcttggtaaagtttctttcgagcatattggggagtttgtggaatccttggcgggactggagaacttacattgaagccgatttccaggaaccatgtccaaaatcacacagcaggcctggccagatggggaaagctatagagctcttactgacccactgggcacagagggcccctagcacaggcgtgaagacccccaacctgagggacatcacctctgcaccaggaacttggccatatatatagtcactgagagaatagccactgcttctcccaccaccaaaagccaaacccatcttcaaccaacggggccaacaaaaaatggcagtgccaggctgggcttccttctcacattgttccccttagaactaaagtctcatcccagggaattccatcaaatcagctcaggctcactctggctgggggaagcaatctgccatggtcctggggcatctttgtgtgtccttgctgcaaggatagcgtcccctgatactgagcactgtctgcagatggtatggaggcaaccaaggaggctgaggtgcccacagagtgactgccacgcacctgcgaactccacagggacgaggactggttcgttggccgcgcgctaccacaggcctgcagccctgggcttcccagctgcggggcatcctgctttgtgggtagccactgcaccgtggcatttgggagagagaagcgggctctgtgatgctgaggctctctccatttcctgtaccctgtgagtgacaaacgccttgctctgattccagcttgttgtctatttttggcaacttgctggccagcctccacattgacattggggcctagttcccgctcctctcctctgtgaggctggggcccttccccgacggccagtgtctcagcaacagcacagggtgggggagtctggacatgtgggctctgacccctaaagtgggaaagtgagattcatcatgtgaggcttcccttgtggaggctgaacaaagatgtccatgtcctgcagcctggaatttgtgaaaatgtcaccttcatggccaaaggaacttggtagctgtgattgagttcaggattgtgagattctcctgggttccccaggtgggcgtggtgtagtcacaggggtccttgcaataaagggaagcacatgcatcaatcagaggaaggtaagactcccgtaggaggacacagagagaggacacttagctggtttcaggacgcagaagggaccatgagcccaggaacgccggcagcctctcaaagctggaaaagacaagaaaagagctcctgcccagagcctcctgaagaaacgcagccccacagacaccttgaggatgagcagccccttgagatgcattctgactcctgacctgcagaactgtgaaatgataagtgtgtgtcatcttcagccacttcagttggtggtatctgttacatcagcaatgggaaactaagacatcccctaaatgtaaaaaggctattcgaaagataatgtataaaaactagaaagcacaggctgggtgtggtggctcacgcctgtaatcccagcactttgggaggccgaggcgggcagatcatgagctcaggagtttgagaccagtcgggccaatacggtgaaactccatctctactaaaattacaaaaattagctgggcatggtggcgggcgcctgtagtcccagctactcggcaggctgaggcagaagaatcgcttgaacccgggaggcggaggttgcagtgagccgagatcatgccactgcactccagcctgggggacagagtgagactctgtctcaacaaaaaacaaaacagaacaaaaacaaaaactagaaagtgcaagccgtgcagggcctgtgaagtgggcaggacagtggcatcattctggaagatgcccttgccttgctctggagggaaacagaggcacagacccaggtgagggggacccagttcctccaggctcagttggggctctctgctcctctccactgctggatcttccactttgtaggcacatctgggacctcaacatgattaaaatcagtctctctccaccacagccctctcccctgaacccctccgccctcccatgtttctctccagcctttcctccaagccaactgggaactcgcctggaaaaaatagaactctctgtagatggaagaggatggaagtgaaagaaaaaaaaaagttctttatttggagccatgcagtgaaagcaattatttgatatttctggagtacattttgcctttgctttatgaaatagagaaaatggtttttaaaaatgcaaaatatggttactatatggctatgagacacatgtttttaataagatcggggtgaggacaggtgactgttttcaggtatgtgaatagttgctgcaaatacatcataaagacggtgcctggaaggtgagctgtaattacagatcctagaatgtcatgtgatgattttttaccgagaacacacattccccaggtcccaggttactgacacataagtctactgtttggcttttgaccatattttcagtaattaggtaggaggatgcaggactgcctgggatgaaatgatggaaagttctggagtccagtgggtgtatgtttccatcaagctccacaactctctggttattttaagagtgctagagtttgggttgtaagtaacatgaattggaattatgtgaatacaaaaagaaagttgagaggatcaattatcagcaaaactttttaaaatataatcccttaaagtcaaaaatgtatcaggagtcacataaatttaaagctgtcaaataaagtccattgagacctgcctgctgtctactgacacattttggtaccgtattttaccaggtggacaaaattagcccccaacagttgtcaggaaagtcttgaattaaatgttgaagtacacccaggtattggaaatgcatgtttccccaaagagtaattatgttcaattctaacacaaattcttaaatacagaaattctagtggctgttaaacatttgacaagattttcaattgcgctaaggatgggagggaaaaaattatgacaaataatttggggcttctagggttaccaaagattaaaacatggccaggcgtggtggttcatgcctgtaatcccagcacattaggaggctgaagcaggaagatgtcttgaggcgaggagttcaagaccagcctgggcaacatagtgagacaccatctccacttatataaatataaaaaattaaaatgtaaaacatgataatattccaggcatatgctggacactgtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcgtgatctcagctcactgcaacgtccgcctccctggttcaagcgattctcctgcctcagcctccacagtagctgggattacaggcgcctgccaccatgcccggctaatttttgtatttttagtagagacggggtttcaccatattggccaagttggtctcgaactcctgaccttgtgatctgcccaccttggcctcccaaagtgctgggattacaggcgtgagccactgggcctggctttcattcacttttacttattctattctatttaataatgaaaagataatttaatgctatgaatttgcttgttattactactttggtcagttcttgtgtgctttgatttgttttaatgttctctttcttgttttctgtgaatattgaaactggttttggttttctttttgatctaagactaatttcagagaatttttaagttttacaatattgatgtttttgtttatacttttgttaatgatggcaaattttgttgagtcaggagagattatggcttttataattcttgcattggggatttcaaggcttccgttatggccaaatatcactctctcaaaatgttgtaggtgaatagcatgattcatgtattgtaatactaccaacggtattaattaggtcttttacagcaggagtcttaaactccagtactggcagtgggcctgaggccatggggatgagtgcatggtccaagaataacacagtgggtctgtggtgaatgggaaggcacagacaggtcctgcccgaacactttctaaaacaccatgtgggcttaaaacataagtctgtcagaagggagccccacgaggacccggatctttgtgtctgtccaattcgtcgtgtcgtcccggacatgttgtaggcctcaagaattatttgttgtcatgaagtcggtctggggcctcgctttctatttgtgtctgtagtttgtaaactttatgccaaataaagctgtattttttttttcgtctacctgttctgacaaggacaaaaagaagtgtattcctgtgagattctagcagccagatggtattttaattcacagtaaagttcatgatttgtgttgtgtctggatactatgtgtcatccatagtgaaacagccgttgggttggaaggtagcgcatgtggcatcgttgagagccgggtgtgaagcctggcctcagctctgccagttgtctccaagtctcattttcctcatcttcaaatgagcttgggttatttctccccccagcttactgtgaataataaatgaggtgctgtctgtgaatccatcaacaaaagcggctcatcacacaaggaacaattcatacatggcacctattggttattttggtttttgattctttttctctcttcttggtatttttgttgacacctcttccctttatgattgtttgtctgatacatcctggcctgtcctctcctttatttacaatctttgggttatattatgctttagttctgtgtattaaccgtaatactcagttttgtttattttttgaactgatacaagtggatgacttttatctgaaggatttggctcatttatcctgactgctgtgttgattatccagcgtcgcatcccatgcttgtttttactgggtgcccgcttgccatgtcactgtcactcagcctgaaccctgctgcttttcggcctgtcccagcctctccagggctctcagttgttcacaggcagggtcattttccccattggctttgcctctccgcctcgctcgtgactgggggcacccgtcccgatcctggtttccgcagtgttggctgtgtgtgcgcctttgccgctgctcatctctctgccaacagcctcaccaataatcaggcctatttattttctcattttctcttctcctaattcttgatctcatcatttgtgtctctcttaagccaacgtccccttaatttctttgttacctttttcatccttagtcttcagagtctgtgttttcttgaataataagacaagttctctggtagaactatgccagtagcaatagtagtatctttcccattcaggttataaaatctacttattgtcctccgcatgagtaaccttcccttgtcccgccccctgcagacactttggtgtcatccttaggctctcctcctctcctgtgaaggagaaaagtggtattcagctttcgtgtttatttccaaaatagacctgaatttctgcttgagttgcataggttctgttcccattcaaggagtggggaccagtgtagtcagctatggtcccaggggagcaggtgggagctgaggaccttgggtgtctaggggaagccattgtcacacagttcattcttcgtgtttgaaggcgctgatgccagggctaggggtgcagtgctatggttgctgtcagctgccctgtcgggaggaaggctgtcatttggggacagtccctattgtcactaccagccttgcctgattaagatgccctcagatgccctttccagaacaactaagggctctaaatagtttgctgtccttgcctgggtctgcgtttatgtttctcccgtggagggcggagtggaaggattgggtttcccttgacactcttccagggtggggctgcaggttttctgatggaagtaagctgtgggttggctcgaaggtctctctctactttgatcctggagaatgttttcactttgcttggcatttcagttgagatttgaggtggaaattccagagtttgtgttctcatcgccctatggatcatatcctggtcctttctcatgctcaggttttagaaggaacatttttaatattttcattccattgccctctgaccagacctttcttcatactcatgttttaaaataaacatattttacatacgctttaaatattagggcctgtgacctaatttgcaataagaattctttataaaataaaacttggtggtatctttaacctaaggacttggacctgcgaatagatgcttttacactttatttccagtggctgatttttgtttatagagtaggagctgctgcccttgcttgtttttctcatgtctttctgttacacttgataggtgaccagtaacttagcctgcacctgcagtgagatctcaatgctgctgagagcacaggttgatttgtgaagtcagcttactttgttgcaaagattaagcctaccctatgcagggaaaccaacatcatcatcatcattattatcatcatttgttgttataataataaatcagtagatcaccttcgatccatcactatgattggaagaacatctcagtattacctgctgttgggtaaaatagcactactgttaattctacagtaggactttttaactttctcctactcccctttgtaagagacaaacgaggtatgggtgagcaatccagatatttgaggattaaatgaaacatgttgaacatctgattttatataagatgctgtaaaaagccgaagtgaaataggtgtgctatgccatgacctccactcagcctgcttaggaggctgaaggctgggggcctattagtcctgggggaagctgtgattagacgtggtcctttcacgcatcagaatcacgtttgctacgaagtctcgtagccaacatcagatttttagattaactgtaaatgttaataaatgaatattacactaacctacttttgaattctaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggtgaggacctttagtgccggaggtgtctgagtccaggcacaagcgtgagcgctcgggcattctgactgtgctgttggaatatgttgagacaaggatagcacagcacttctgtagtttttggcagtgtgtggtttagaatatgaatcgctaggtaaacacaccagtgctgaggttctccattctttgtgtaaaaacagtatcgcaaaatattttcatgaaagtttgttaactaccttgtaagtgccacaggacagagaagaagaaagcaatcgtggttggatagttcccagcggagccctcggccatgctgccgtggtggctgggctgagctcacagctctcagtgcgcttcgtttagatgtacgtaaagaagcagatctaatttttagaaacgtgttctcacaggcctcccttttcctattagtgagatcctgcagtggttgaacaagtgtattctgggcagatctgtccggctgctgagagtgagagagaagagaagatgagtgatatgcagaggtggatggatgtgtgggtagtagtcagtggtggttttcactgtagaaaactcatccagaattggctaatgaatttgtaaagggaataaatcacaacggaatggacttctatttagaatacactacaaatctccgtgtctagttataaaaatctaaatttatagatgggcctgccaaaatagttttgaagtctattgcccttgtcacggtggctcatacctgtaaccccagcactttaggaatccgaggcgggtggatcacctgaggtcaggagttcgagaccagcctggccaacatggtgaatccctgtctctactaaaaatacaaaaaattagccaggcatggtggcacgcacctgtaatcccagctactcgggaggctgaggcaggagaatcgcttgaaccagggaggcggaagttgcggtgagccaagatcctgccattgcactccagcctgggcaacaagagcaaaactccgtctcaacaaaaaaaagataaagtatattgcctctgaaatagaatccttatgtagatttcccagtttagtgtgtgtactttgttttcaaactcccattccttgacaatataggaaaattttttctctaatctctttaaggaacacaaaagtctaagagccaacaaatcacattacctttaagcttgagagcaaggagtttaactttctgctcattgaatttattaggaattatcctaatggctaggagaatgaacagttggcccatagccattgattcttggtcgctagtaagcatcgtcctcctaatagaaaagaggttgtgcctgtctgcaggactcagtccctaggagaccccacgcttcctctgctatattaggtgaaagctttgatcccatgtgttaaagtgcccctttcacaaaaacgaccctcccttttctttcctcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaagagccagcatcctgtcccttttgaaaatagccagtgagggggaggcgcaggcactcaggagatggctgagtgagcggaggtgttttcacgtggatggcctgtcccgagctgcctgtccaccgctccttccacagcactgctctgtgctgcttgcatcactgtgtttccttacatcatgaacggttttcaggagacaagcaggcctctcttctcatcccaggggccaagcctgccctggccacagcccagcgagcagctgctgcagccaccgctccttacggggacgtccttgacagacaagcaccttctccacgcccgtccagctcagtcttcgtgaggcagctgaatctgtaccccaagcttccctttctttaacttggtggtgtactttcgttttcttttcctaacagcaccttttctgatacgaaaaagacaagatagatagtaagttacttttaaaaataaacatattacttgtgatcaatcataatgggtttttacaattaataccagtaggtggcatcttgagtgttgaacagaaccactcataaaagctgagttttgctttctccaggtttacgatgcctttaaatggacccagcaagcgaaggtttcttctttcttttcctttgtaaaaatattttatctacagaaacaaccttgttactttttcttgtataatcatgtggcatttgctctggtccggtagtacttagccacttttaggttacaaatccccttgagaatctggtgaacgtttagggacttttctgcagaaattgcagaattcccagagcccttccatgagtataggcctgtggagtcctaatgtaaagcccagaactccaagccaccaatgtcccatggacacttgtcactgatgttttctggctgtgggtgccacctccatggccagctcagggctgcttgctctgaggaggacatgtggatttggggctggtgtttcattcccaccttctcctgaagatgaacagcccgaggaataagatcctcttgtggtacatgggacagacttccttcaaagaaagaccaaagtccatagttctgaagacgaagattctggttcttggtttttgttttatctttaaatgtgtcataaaggattggctggtcattctcgttgctttctagtcatttaatcctcattcttaatttaatttcacatctcagagttgacctttcattcatcatttctgtctgacaggttgtttgtggacttcccctgcattggtgctctcagggcgtgtgtgctggggatgggccaggatctgtctgttgttttcaagaatgggaaatgtttcatgaaggaggcgtgtttgccagcagcccccaggctgtgccccctggctgcatggcagcctccttggttcacaccagtaaggagagttggagctcatctgtcgagcagcccttggcgtcctgggtagagaaataaaggctgtgacatgggaaatccacaggaagcccgctcctcagagagagttctccctgaatttgtgtggccttggaaggagcagcagctctcaggccaggttccgggggtgtctgtgccacccttatccctggccctacctcaccatctcgtgaccgacacaggaaatagctttctgtaaagtcacagcactgtgaagggagagtccccagagttttgttacattgtgtttttcttaccgacctcccagcaggctccttttattagtgttatttaagctggggagaacgtgcataccatagtaaaggtctctaatcttaagcacagcttgctgtgtttgcagtctggatctcagtggaggaacttttggaagccctccttgcctctctccttagtttactgcccccctcagaaggtaaacctgttctattccagcgttggtccccacaggttaccctcgcctgtcctgtgctgggctgtggctgtctcctttcacttagcacttctgtctgtgagcatctcccctgtacttctgagtactgctccttcgtacgagccgtcacgaggcatttatccatgctgttgtcggtgggtgcccagatgttggcagtgtggggctgttgtgaatacctgccctgcctgtgagcctggggggcgggtgcgctcattccttggggacccaagagtctgtcttgtcaaatgtcaaaaccctagtgtttgccatcttcctgtgtaattatccttctgtctgtgaagaggcccaggaatgcacggcaggttttctcccaggcgacttaggcgtttccgaataccctgtgtaatgccaccctgagacagaccctgacgaggcgtggtgtgtctgcctgcgggcttggaccgcacctccactcccgcagggccgcgcagccttcagttcatgtggcctcagccttcagttcacgtggcctgccagctttagctcgggaagttttcagtgactggtacatttggggagactcgtatttcaaaataggcacataaaatgatgtcgtttatattttgatgacaacctcgtctcagtagcgtcaaatgccagtgttgggacagcagtgacagctagtgccaggctccaggaagctggggtttgcatttccactgagtgcccaggacagagcctggtaggtcgtaagggttgaacgaatagtgtaaaacatctgttgaaaaaataaagctttagtctggtagaattcagggtattagcagctgtctttctaaatcagtagacacaggaaatgatcttctttaattggtgtgaatgagcactctttaaaaatgtgtgagatctcaccatacagatgtgtgggtttttttttttttttttttttttttttttgaaaaggagtttcacgtttgttgcccgggctggagtgcaggggtaccattttggctcactgcagcctttcacctcccgggttcaagtgacaattttttggcctcagcctcccaagcagctgaaattacaggcgccagccaccacgcctggctaattatttgtatttttagtaaaaacggggtttcatcgggttggccaggctgattctgaattcctgacctcagttgatcacccaccttggcctcccaaagggctgggattacagtcataagccactgggcctggcccaaacgtgtattatattgggtttatttgataaatgcactgttgaacatgcagtatatgttcaaatagaaaaaggaagtgccaaaataacccagctttaaaaaggtcttcaaaaaaaaggaagtctcactttttaaaataaacaaatgaaaaagtgtttttgaaaaggagcagaaaatggagcaacttgattccaaagcactcgctcccctcgggatgttgccggccacacgcacctgcgacctcgtgcaaaaacgtgcagcagtgctttccaactgggtggcaggtgatgtacatggtacggagacacgaggacgcccatggtggcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgcagtgagctgagattgcaccactgcactccagcctgggcgacagagactctgtctcaaaaaaaaaaaaaaaaagaaaaacctattacaaaaatgggtacaacacaaactgtacacagaatataaccatgtacagttacattctatggggatccaggtaaaccatgacccacctaagatgacaagtttgataaattttgggaaagaatcttaaacgtcactaataacgtgttaaaacaataatataccatttttcaacccttcagctaagaaaagattaacagaaaaaaaaatcatttattatgggtgtagatttattatgggtgtaggtggtaagctataagcaaaatcaagtttctttcccattaaaattttggtttgctatgatggtttcaaatctctactcaaagaccattaatgtctctaaataatactcactagagctaggaatgaaacctcatcaaacatgggcaggtgttttattaaatttaatagattgtactcatgtcaagttataagatatatgtaactcttcccaactactggcgggtaaagcttcttcccaacactgggtcacttaggaaagaacgcctgtttcaggacgcacacatgctgtgaactttccacttccatgtcaccaattcagaggctctggagctgctgctgtcacactaggtcagagcgcatgcctccccataggcgccaacactcagtaagaaggcaagcactgtgcagaggctgcctgactccagtcagtacatactggacttgatgtgctgtggattttgctagcgcttttttttttttttttttttgagacggtatcttgctctgtcaccaggctggagtgcagtggcgcgatctcggctcactgcaacctccacctcccggttcaagcgactctcctgcctcaacctcccgagtagctgggactacaggcgcccgccaccatggccagctaatttttgtatttttagtaaagacagggtttcaccacattggccaggctggtctcaaactcctgaccttgtgatccacctgccttggcctcccaaagtactgggatgacaggtgtgagccaccgtgcccggcctgctagcgctttttaaagacagaactgacggagtgcaatggggaaatctcaacagtgactggtctggcacttgtatcctgcacaaacacatatcgaaaccaccagaatggactgcatggctctcaaggcagcccacagaagtgattcagccatttatgaaactgaaagagaggatgttaggaaaggagcccaaaccaagtatctactggaaaagcctccggaaaccaaggacgtctcctttcccacagggagggaacgaggactcccttccttggcatcaaccagtgtggtgacggggcacagagaaggcactccagccccggggggagagagaggtctgaggccaaagctgagcctgcgctttggggaggtaggacaggcaggcagacacagcctccagtgcaaagacttcctgcagacagcccttctgcaggcgcactctgctgaaccgcagcctgcagctagagccctgcggtgattcagttcttctctgcccatgcttatttccccatgtgccacagctctggaagagaagctgaattataaagaaggcacagcaaaaacttcattcagacacgacctcactttaattatctatttgaacaaaagaaaatgcaatagtcttctaaaatgtcccagtctctagaacagagatttcttaagcccagggactaatttctttaaatctattaagtactatatcaatacattcagtctggcaaaagtagatgaaagctgctatgaaggcagcattgtttgagaatattaaattccatttcagcaatgcttaacactgaattcctcatgacagcagataatacatagttggttcaagaatatcaacttttattattatgtaactaagctgtttcatcagtcaataattttcaaatattaatgaagggagaactccaaaataattcagaaagtcagcaatacccagctttatcagcaaaagataaacaactcatttcagcacataaaaattatgaaaacagaatggaaatcctcaaaaggataactctcctcatcagagtttagagacttaggcatttgttcttatcaggtttatctgtagcgggaggagatgctgcccaggagcctgtaacaatctagaaacatttttgtcaccagaaaaatgcacacagaattttacataaaaaattcaaaggactcgcaggcaccctgacacttgttaataaacctaaggttagtaatctgaaggtggaattctcatccttgaggatgatacagtacctttaatttacaaaaattcatctattcagcattcaatagcctaattctaaatcagtaggtagagaaaaacctccctttaactcagtccaaatgtcacttttcagagcaacccaatggttttagtaccagcagaaaaatgacgtatccttaggaaaataatcttaaactttaaaataaaggattagtgctgtaaaataactgatacacatcctcttttacagacatgcacttcctgaacaacctggggcacgactgcgtgtgagcactatattctgaatccacaactgctgcagtcgggcctgaggaggaacggagcagaatgcctcttacctgcagcaaaggccgagcacatgacaaagaacatgcccacggcgatcctcttcagggaggatgggagcaggccatgtcttctcaaaatgggatcgaccagtttgtccttcagagggatgagcaggaggatgagcacagcatcaaacatggtcagccaggctgcagggagctggggtgaaacacaggaggaggcgtttactccccgcaatacaggccatcacctgtctagagaaccaacgtctcaatgggagaaatgcacgtaaagaacagttcctctccacaaggtacaacctcttcagtttagagacaacggaactgggaaaagatttctttccaaatgaatctgcatttgcttttctgtgttttgaggggaaaataatcaggtgaaaaatactaagtaatgttgaattgatgttagtcaacctaatctagcaaatgatacaaccaatgaaaaaatattctctaaaataagtaaaaactctatttcaataacaatgcttttgtgtcggtgctgttaacatttataaaagatttacagttggtagaaggaatccatttattacataagtccaaaataacaatgttcagatcattacaattgttcttaccgtgtgaggagtggttgtaatatttgaaatttctggaatcctcaaatgaagactctgtaaaacatatgttgtctgcatctaggtataaaaaacagtatcattatatgtggaccaactgtgctctcaaacactctaagcatcctgcccctcccctaagctagactcagatgcgacacacagtgactcccagaaatagacaatggctcaagtttgaaaacagacaggtcaatgatttggtcatcgtaaagtcctctggagatcaattttgaaaaagaatggccagttatccaaaggagaaattacattaacaagaggggcctgaaaaaccagaagcgtacctgttctcagcttctttttcagagaggctttagacatagttaaagcagccaaaatgactccataactaaaaccaaaaattccaagattctgtagactcatgggaaaaaaaatcacctagtcctacctactttagaaatggccaaaacaagtgctagggtaagacttcataggaagataaaggaaattaaacctgtttgtcaccactcacttggaaatacactgtccagtaaggtatcaaagccaagaaaacagggacaatcttgaccagagctttcacatcttccactttctcttctgtaaatggcccaccatgagacatcttacatgaatcaaacagactttgtttagaagattgctgaaagactccaatgccttcactttgggaaataaaatgaaggaattagttttcttcccctcccagcaatcaattatttggtcacaaattaagtttggaggtaagaaaccagctcactgtattgaatctgcttcaactcattccatcacttactaattgtacacacccaacacagctacctaaattatttctaaatgtcacagaatgtactgaaacagctgacaaagggactttctagtcaaagtgaaactgggctactgtaattttggcgtggctggaagatctgtgatgacagtgtgaaccacggctgagctgagagccccagcgcagctgccagctcggcaatctccgtgtggggagagtctgcagctctacgtgacactgggagggacactagctatgccactggatagcatatgaaaaaatgcactggattgtgtgaatttttaatcagctaatttatcaaacatcaagacctgacagccaatacccatgctgttaataaaaccctgctggtttaaactgagtcactggcaggactgaggcaggcttctattctcggaggaaagctgtcagctcttggattaaggaagagctgttgggggagggcggtgctggtggtgatgagaggaggatgtccctggctctgtcccctgacagtaggaaacagggagtgcccagtgcaccgcgtcccatgtgctccctcattaaccatgtggtgttaaaactcttcagggccctattgcacagaggaagatgccggggcacagagagtgtgaagggtgcctgaggtatggccaggacttggacccaggcagtcttggctttacagcctgaggccctgacccctgcaggacaccactgtccctccactccctgccactgccctcacatctgccggtcacagcaggaacatggacctggcatccccagctcttgtactaacgagtttcacttccttgctctgggcctgcttcattatttagaaaatgaacaggccccactagacagctccgcactctctcccagctccaaaacactctaatggggaacgggctccaaggatctcaggggtaaaatgggaaaacaaagtgcacactattctctaaagccagaagtaccaggagagagttaattcccaataagattgtgtttaactgtgggaagccaacagaaatggcacctgtcagccttctagtttattaactcatgtcccattttactatggtgccagtattttaaattctttatcttataaagtcaacattttaagtctggacattcagagtggggaaaaatagaagcgctgaaaactataactgaatattttagccaaattttggacaagaaaactaagttcgattcaacaaatactgatcgagtacctgctgtaggccctgcattgctctacctgggggctaaaggggagggctcctgtccttacggacttagtctagtgggggaaaataatcaaaaacaaaaacacccaaaagtgaaaataaattccaaagacattataaatactttcactcgaaaacattaacttcttcaagtactactttttttcaaaaaggaaattaaagtccttttgtacctaatgcagatactatcagtggtttaccacatcatattaaatacctttcactaaaaacatttaaataacaaataaacccattttcacacaaagaatcattcacacaggttactggttatattactttcgctttatgtaattaaaatatttaaaagctgtgaaatcaacatgcatctgaagctttactgggttacacatattgttaggtgcactattttgcaacatacaagggtccaacacgaagccacggtcacaagtgacacccgaacacccacaagagccctctgctcctcccacacaagttgacgagctccagtttcaggacgcctgtgcctgagtctctgtgaaggccgcatgtaggtgtgtgtattctccaggaaaagagtccactggttctcacggattcccaaagaagtatgtatctcaaaaagctgtagaaccatttctactctggtctgatgagttgaacaaatacgccttcatttctcatttaatatcaagcactatattatcttcaaaacacagatcaacctggattgaaactgagattgggccagatgaaattaagtgtcacaactgtaaaaatgttgggtatgtcatgcttcctcaggctttggaggcccaactttttttttttattttattttttcgtttttgagacggagtctcgctaccttccaggctggagtgcagtggtgtgatcgcggctcactgcaagctccgcctcccgggttcacgccattctcctgcctcagccccccatgtaactggcactacaggcacccgccaccacgcccggctaattttttgtatttttagtagacggggtttcacgtattcgccaggatggtctcgatctcctgacctcgtgatccgcccgcctcggcctcccaaagtgctgggattacgggcttgagccaccacgcccagcctggaggcccaccttttttaaggcaccctcgtcacagtggtcaccactgacagggcccttatcatgtacctggcatcctgctgagggccttgcacacatcactgtgctcaggccccaccgtgagcccatgagatgaatccatctccgctgtaaaaaaaggaaagctgggcttcgcaagatcagtaacctgcccaaggttacagagccagttcatacaaacagcagaatctgagaattcctcagaccatcaacttttctgcaagctagcccctgcttttttttcccttatttttgcccaagaagactttcaaagactatcctaagaggaaatcggcttcctaagtaaaagtaactccaaaccctctccacactgccatttgtgctttaaaacccaaatatgtccacagaacaatgctgttctcttgcagaaatgtctatgggctaccacccacacggatactaaaactttaagggttgttcctgaaaaagacctctaggatccgaaacactgcttttgtctgatcaaataaggccctggcaaaagactagtgtcagctaagatggggctatattttttttttttttttttgagacagggtctcactttgtcacccaggctacagtgtagtggtgcaaccatggctcactgaagccttgacctgacctcctgggctgaagtgatcctcccacctcagcctcctgtactttaattactaaaaattctttagtgcggtcccaccatttgcagttttgaattatgtgtctgaatgccacaatgacccactggcatttccaataggtcatgtagactggtgagatctgccagaactccacacagggacagccggagaaatcagagatgttcaggagcaaagtaggcgcacagggctattttggtgaagtttcaatctaccacgtggaaggaatattagacacattcgctacggctccaagagcatgagtaagacaaacacagacaggccgcaggcaggcagatgtgtgagtgggcccgcagaagaatgtccagcaaccagtgccatgccacaatggggtgcacggctcagagacacaggacgctctgatggctgagtgatcagcctcccacccagcagcctccaggcatttctacgttgatcaaaacattccatgaggggactgactacaaaaggtcccagagacttctctggaaggatggaaataatctatgccttgactgcactggtggttacacaacctgagtaagtttgtcataattcacaaaactgtacagatataaggggtaaattttactatctgtaaattattcctcaataaagagtaacacaaacacttctgagctctcttcttgggcttaagttctggactttattaactggcatccaacatcaccaaacatgagtcatagttggccagtgacttggaggggttctgaggacacaggcctttctgttttaacacctcagttcatgggactttggtgctaacactgggtaagtcccatgagatcatctggttaccctcagtgcatctcgccattctgctactgcaccttcctgtcaagagttacagacctgaccgccgtatgatggacctgaccgccgtatgatggacctgaccgccgtatgatggacctgaccgctgtatgatggacctgaccgccgtatgatggacctgaccgctgtatgatggagcccatgctgacctttaggtaagaggcagtggcttactttttaaagagcagagacaggtactgacagcataagcaactgcttagtttttcattcaaatgtatttcaaagctttttaaaataaaaagaaacatgtataaagcatgtcttctgtctcctcgatgtcctccacaaatttctacctttataatctggcaccaaaggagcttccgtctacactagcagtgagagaaagtgcaacgtggggttaaagcatgagctctggaatcaggccactggcctgtctttaagatgggataataagaccgcacccgcctccttggggaaatgcagtgttaaaggagagaagacatgtaaaccactcagcccaggcccagcacacaataagcacacaacaaaccgaagctaggatgttaataaagagatcgataaagtcctttcaaacagcccaagatgagaactaagtgcttacccattactctggcgctctccacttcgcttctgggaacagcaggaatacgtcagtatcttgaacatgtcggtgaaggcactgccatcaggaggcttggtgatgaaaacgctctggccacagaggaagaccacaaaagcaaggccgacgcagacagtggggatcgcataaccagtgacaaagctgacgttctgctgaatataggcaatgccacctaacgacaggatcgctcccaggttaatgctccaataaaaccaattaaaaaatctcctagtggcttccggacctcgatctttaacctaaaataacagggaggaaagacacttgaaaatatatgacagtcttcaaggatgaaaaccatatacggtcaagtggttaaaattaccgttgtcatcacaacctttaagaagcgcaacacaatcaaaattgtgtttacagaaacattcacggatctcaacaaaaagcacaccccacgcttttaattactacagttgctaggtaggtttcacttaattacactaaattccaacaaatgctagagagtttttccaagtatattctgctgtagaattttctaagtacctgaaccacttgccttggaattacctggaatgctctttaaaaacagagtccgctgggcatggtggctcacgcctataatcctagcactttgggaggctgaggcgtgtggatcacttgaggtatggagttcgagaccagcctggccaacatggtgaaacaccgtctctactaaaaatacaaaaattagccaggcatggtggtgggcacctgtaatcccagctacttgggaggctgaggcaggagaatcgcttgaatccaggacatggaggttgcagtgaaccgagactgtgccactgtacctggttgacaagagtgaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataggtcagtgatgctcccttggggtttagcagtgaggagccctttgtgttcctggctctgttggatgaaccagcatcccagtatgggagaggaatgaaggaggtgatttcccatagggattagtgctattaagaaagcaaaactaggaggctgaggcaggagaatcgcttgaacctgggaggcagcggttgcagtgagccagttgatccgggatcacgccactgcactctagcctgggtgacagagccagactccatctaaaaaaaaaaaaaaaaaaaaaaacaccaacaacaaaaaaaacaaaaaacctagggcaggcagtcatggcggctcaagcctgtaatcccagcactttgggaggctgagatgggaggattgcttgagcccaggagttaaagaccagcatgggcaacatggtgaaaccctcatctctacaaaaaaaatttaaaaattagctgatgtggtgtatgcatgcctgtggtcctagctactcaggaggctgaggcaggaggatcacttgagcccaggaggttgaggctgcagcgaagtgacattgcaccactgaactccagtctgggtggcagatcaaaactctaaaaaataaaacaaaactgttaatggaaagaggtcccgatccagaacccgatagagggttcttggatcttgcacaagaaagaattcagggcaagtccttaaagtgaaagcaagtttattaagaaagtaaaaaaataaaagactggctactccatagacagagcagccccaagggctgctggttgccttttttttttttttttttttttttttttggagacaaagcttcattttttcccccaggctggagtgcaatggggaggtctaagttcactgcaacctccgccccccggttccagcgattttcctgccttaccttccggagtagctgggattacaggcgcctgccaccacacccagttgatttttgtatttttagtaaaaacagggtttcaccatgttggccaggctggtctcgaactcctgacctcacgtgatcctttggtcttggcctcccaaagtgctaggattacagggcatgagcaacttcgcctggccttggttacccatttttatggttatttcttgatgatatgctaaacaaggagtggattattcacgcctcccctttccagaccatatagggtaacttcctggcatttccatgcatttgtaaactgtcatggtgccgatgggagtgtagcagtgaggacagccagaggtcgctctcgttgccatcttggttttggtcggtcttggctggcttctttactgcatcctgttttatcagcaaggtctttatcaccttgtatcttgtgccgacctcctatctcattctgtgacttagaatgccttaaccatctgtgattgcagcccagtaggtcttaacctcattttacccagcccttattcaagactgagttactctggttcagacgcctctgacaaaactagataaagtgattgagaggcatgatgatggctgagatgctttagagaatgtggtctgggaggctgtctccggagatgacattgaagctaagaccgaaaagaggctgtcactgagatctggagggatggtcccaggaaggaataatggtgagaacacaggtcctgagctgtgtgagaagcagaaaggcagccagggtcactggactatagagagtttggggccagtgctaggaaataagtcagagagagaggccaaatctggcttgtacatgtggtggggaaaacactttgtgcttaagaagtaattaccactaaaaaaaacaagaaaacaaaaaaagatggtgaaaccccatctctgctaaaaataaaaaatttagccagctgtggtggcacagacctgtaatcccagcttctcgggaggcagaggctcaagaatcgcttgaacctgcaaggcggaggttgcgtgagccaagatggcgccactgcacaacagcctgggagacagagaagactccgtttcaaaaacagaaaagaaaatcaaaaacaatgttgagtgaccgaagaacctgaacgggcacagagttagaagcttcaggcaaaaaggaaatattacctgttatttaatattttgctcctaacttgagctgtaaacccacatcttccaagggcccaaactcacatccacccacaaggtcacgttacttttgtcccaactcagaggtgaattaatagaaaaaataactatgttagctgccgtcctgagattcactcccccatcattctgttggtggtgcacttttgaaagtgcctgtcttgctaggccttggggctacaaaggggaaggaggcgggcagggtttatgcagaaggttgacttcagctaaactggagtggagggccatttagtcacttcgttctttcttttcctggctgtgcagaagcagaataaaggctgctattcaggctttgatgtttattcagaccaggcgtttgttgtccttcacctcaggaaggattgctgggggaagaaaaagaaaaaagcagaagttgcttgaagacatcttctgccttgtgaaagcttagtctccttgaggaaatgatgctggtgtcctggacgggcggggagggaggttcccttggtgactgagagtccctgtgatctaatcagcaatgagcagtgaggactggatgttctcctccaaaatctctgccaaagaccccggagaccaccttcaactgaccctggacacttggtgaaggagttccccaaatacgtaaatctggagttcccatcagcctggcagaataggaggtcagaattaggtaagactgaatttaaagaaaaaaagaaggggttctattcttgcacaagttggtcattgtaaagcaacaccccatctataagtaatggtgctaaatcctcatgaatgtattggcctgggaagcacagaatcctctggggacatataggtggggaccgatcccagatcagaggtcagggaaagccttctcgtgccttccaagcccattccctgttgaaaaatggcaaggtccagaccaagtttgctttgtggctcagtgttctttttcataataaggatgccaatatgggttgtgaatggaattaaaagagttaatacactttcagcgtttttaaagcagtgtctggaacatagtgaggactaagctctgatttttttatcttgcccaaattcctgtctaaggggtctgggagtcatgccctacaaaccataaaatcccatcagatgggttttatttgacactgtatatcgtgacttaccttccagtctgactctggcataacattatgagacaagaaaaaaaatcaaaatatttaaccccaaaacatgcttctgtgccatatcttgaaatggccctgcagagccatcctttgtgggaggaaaatctgcatctgtaaagaatttctgccgggcctggtggctcacgtctgtaatcacaacactttgggaggccaaggcaggtggatcacttgaggtcaggcattggagaccatcctggccaacatggtgaaaccccgtctctactaaaaataccaaaattagctgggcgtggtggcacacacctgtaatcccagctacttgggtggctgaggaaggagaattgcttgaacccagaagcagaggttgcagtgagctgagatcacaccattgcactccagcctgggcaacagagggggactcagtctcaaaaaaaaaaaaaaaatctccattaacatagctagatctttttcttccatgccctcccaatcctgaagagattaactaaaagtctagcaccttttaaagatctgaagaggaaaaatttgtcatttattgtttctaagggcagccaccgtaagacttcaaaggaacgttggtctccacagtcttttatcttaacttgaacatttcctttctatggatcccaggtcttaagacaagcctcaaccaattgtcagccagaaaatgtttaaattgacctatagcttggaactgcccttcctccccgcaacccccatgctttgagttgtcctgcctttctgaaccaaaccaatgtatttcttaaatgtatttgattgatgtctcatgcctccctaaaatgtgtaaaaccaagctgtacctcgacctccttgggcacatgttctcaggacctcctgagggctgtgtcacaggccatggtcactcatatttggctcagaataaatctcttaatattttacagagtttgactcttttcatcaacaacagttgtgagctattaatcagcataatgggccttagttagcaaggtgggagaacggagggagaggcgtcttaggcagagcgtcaaccaatgggatgggaagagaccatctcttccagagctgagagtcacgcagccttcacagcacagaatcctgtagatcagcgactctgcctccggaagagcatggggcacagaggatgtgccgaggagggggagccattttgcccccagggccgttgggcaaggtctggagacatacttcgctgtcaccactagtgttgggggctactggcattgagtgggacgccactccacaccctgtagtgcacagggcagcccctccccaagagtgaccccgctccacatgtgaacagggctttgctgatgaacccttctctaggtggggtcaggagatgtggctggagagggagacagggccacgcgacaccttcagttttgtgccaaaaacaggattgcaccatgaaaggccatgagatttgtgtgtagttgaaaatcatgtatgtatttgggtttggcatatttaagaagtaaaatgaacaggacttggcagttgagtgtggggaatgaaggagagaaaaacctgtgatttccttcatgatagagggaaaatactgggaaaaaaagacaggaaaatctaaagcttctgctgtctagtagttttttagaagatgtaggtgacagaatggaataatgtgtttcttgggcaaaaaatctgggggatcaataacttgagaattgatgtcgtattgtctgtgtgtcacgttaaatattcttcagtataaagtgttcagggtgtgtaagtttcctttaagtataacctgtgagctgctagcgagtattctgaataccctaatgtggcacctacactctagagatgtctcctaagcaatgtaacattagcaacccacgtcagaagatttgttcattagcataaagcatttcagaaattaggctggcgcggtggctcacgcctgtaatcccaacactttgggaggccgaggcgggcagatcacctgaggtcaggagttcaagaccagcctggccaacatggtaaaaccccatctctactgaaaatacaaaaattagccaggcgtgttggctggcacctgtagtcccagctactcgggaggctgaggcaggagaatcgcttgaacccaggtggcagaggttgcagtgagccgagattgtaccactgcactccagcctgggtgacagagtgagactccgtctcaacaaaaagaaattagtagtgtctaagatatgtggttcactgggaagacgacacaggcttttgaccaagaagtcagggagccctcacctgctgggcagcccttgaggggttgccagctctatttggtcttgcatccctgccataaccctctgtcatctggcttaactagattggctagtgtggctgccagtatggtccagtgtggactcgatccttcgggcagggtgcttggagaacacagagagttctgcagcccagcagaatagaccgttttgtgtgtgtgtggctgaatctggagtgagagttcctctcattgtagggcacacctggtggtgaggttggaaggaagaggtcagaagggtccccacccccctctgatcccctgagaatgaacatttgccaggagagccaggccgtcctcacggaaccggggaaattggtctaggtcagtttctaacggtgaagttcaaaattaaaagcagctctggtaagtgaaaaaatagagtctgacacctagagaaccaagttcatgtcacctgtggagggggataaactgcacaaggagtggatgtaaaaaatattcacgccgagagtaagttgtggagttgtttcaaagggtgcccccccgttatgctaaaacaggaggctagtccttggaaacactgaaatcatcttctaaaaccagggcgacaaactgctgcctgcccggggtgaaacgcagcctccctgccagttttgtaaataaagttgtagtggccccagctatactattatacgcttacgtgttgttcacatttctgcttttgcttctcaggggcagaatggagtagttagaacagaggccctctgacccacgaacccaaaggtatttcctctctgtctgcttccaggaaaggccttctgacccgtgctctacatcttgatatcagatattcactagataactgagttgcatgcctagggtattgtctgcagagctgccaagggtactggggaaatgcgtgaagatggtctcgggaagagaacaaaatagagcatttggtcctcctcggcccagagcagggaagcccaaggggcagttcagtccagccaggagtgtgttgacatcagaatgatggcaaatgttgtcacactcatagctggacttggtgcagcggggtggtgactgtgtgtttgttgtgtttctccatctggaacggagagtgcaaaggtgtgtttgtcggaatgggaagcattttagataatgggggcagatcggagcactacaggacacggaccagaaaggagagaaagcgaaggaagaaatgcaaacatcctttgcatccaaggcagtactttcccttccaggcccggctactttctggccgcatcattctgaattctctgtgtcaagcatttgggaagaaaaaaaaagtatgaggaaaagttttcaggttttctagattttcttttgaggagtcaaaggaaagtgtgaatgcagatgaagttcagacaaggaggctattttattttttctgccttccttggttttgtttgttttttgaagatcttgttactaatttttccacgtccaaagatagccattgaggccagccgcggtggctcacgcctttgatcccagcattttgggaggctgaggcaggcaggtcacttgaggtcaggagtttgagaccagcctggctaacatggtgaaaccctgtctctactaaaaatacaaaaattagctgggcatagtggtgcatgcctgtaatctcagctactcaggaggctgacacaggagaactgcttgagcctgggaggtggaggctgcaatgagccaagattgcgccactgcagtccagcctgggtgacagagtgagactctgtctcaaaaaaaaaaaaaaaaaaaccacaaagatagccattgaaagttgttgctgggcgctgtggctcactcttgtaatcccaacacgttgggaggctgaggcaggcagattgcttgagttccgaagtttgagaccagcctgggctacatggtgaaaccccatctctacaaaacatacaccaattagctgagcatagtggtcccagctactcagaaggctgaggcaggaggatcacttgagcccagggaagttgaggctgtgatgagccatgatggcaccactgcactccagcttgggcagcaacagaatgagaccctgtatcacacaaaaagaaagttgttaatatcttcattcagcagatattttttgagcgtctcccatgggtacagtgctgtgtaggcgctacacacagagccggcgtcagcagtccctgtcctcaggaggcagccgctcaaccacagacagcttgcgcacatcagctcgatgctaagcattgtcacttggaagacaagtctagcattctagcatggaagacagacacaagcacgtaattacccaaacatttgtctgattgtgatacgatcagtgctatgacagagaagtgtagggtgatgacagagagaggactctgaatagagccgacctagttccagagggcgtagggtccaaggaagagcttccctttccccctctgagggttcactgaaaaccagctgggcaaagacagactcataggagacacggcacacacctgtgttggtcatagttttacatgacatgggagccttcagaatgaagacccagagacacgagagactggccagtttatgcttaggttcaacaaggtacggacagccacatgggaataggatgggatgaaaagggtctgatcgaacaccgatagactgcttggggaggcccagcaaggcgagtctgtctggattcatcttcgcccctctgtgcagccttctttccttctggtacaaggcaggcccgctctggaatgggagctttgtgacttgcaatcaaacaaggtagtttggataatttattatttttttttttgaaatggagttttgctcttgttgcccaggctggagtgcagtggcgtgatctcggctcactgcaacctctgcctcgtggattcaagtgattctcgtgcctcagcctcccaagtagctgggattacaggcatgtgccaccgcacccagctaatttggtatttttttagtaaatagagacggggtttcaccatgttggtcaggctggtcttgaactcctgacctcaggcgattcactcgcctcggccttccaaagtgctgggattacaggcgtgagccaccgcacctggcctgggataatttctttatggtcaggttttacacaggaaggcaggggaaagttagagtaataattttgggtttcactggctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtcacatggcatcacttttgccataccctgttgtctggagcagtcactgggtcacaccaggattcaacgggaggggccatagagcaccaatgagtgaaagcagtgttcgtcatgctgtaagcaaaaaggggtggagtgaccgctgtggctgtccagcacgtgtgttccctgagcacctagggtttgatcgggtttagccctagaacctatattttcagggtgctttacaggtggccagatgctaaccctcacatcccccatccctcatttcacagaagaataaagctcttagagggctggagagttacctgaaggtcacagcaaagcaccagacacaaccccaatgtttaactacagaaactggtcaaagaggcgatggctcagccacataatgtaatggtaggcagctattgaataaaatcaactttatgttcaacaatgagaagattacgaagttacagtgtttattttttaaaagatgtataaaaataaggatgatggctactcttaggggcaggtagaataactgtgtgtgtgggtgcacaaagagggtttctgtgtgagtggtatggcagtagttgccagggtattcatcttataataatctattatttataatttatatacatggttaattattaataaattataatttatataattgttaatttaataataaattaacaatttatcaattttttggcattctgtatttgtgttatatttaactataaagaaatttaaattagctgggtgcagtggctcacaccagcactttgggaggccaaggcaggtggatcacttgaggccaggagttcaagaccagactggacaacatggtgaaaccccgtctctactaaaaatataaaaattagccaggcatggtggcagccaccagtaatcccagctatttggagggctgaggcatgaggatcatttgaacccgggaggtggatgtagcagtgagccgagatcacatcactgcacttcagcctggatgacagagcgaggctccatctcaaataaataaataaataaagtaaataaaaataaataaaaaagttttaaattaaaaaagaccaaaacagtttagcagatcctcaaaaaactgaacaaaactatactttgacctagaattttactcccagattccctccccaccaaaatatggaaaacaaatgttcacataaaaactcgtacatgaatattcatagcagctctattcatgatagtcaaaaaggtgaaaacagcccaaatgtccatcaatggttgaatgaataaacaaaacgtgacaggtccgtacagtgcaatattactcggccatgaaaaagaatgaatgatcgacatgagctacaacgtggatgagccttgaaaactttaacctgagggaaagaagccagtcagaaaaggatacatgctatatgacttcatttacttggaccatccagaagcattaaatccgcagagacgggaattagattggcggttgccaggggtgagggaatggggagagactgcttcatgaggtaatgaaaaggttttgaaaccaggcagaggtggtgattgcacactactgtgaatgtcccaagtgccgctgaattgttcactttaaaatggttaatattattttatttaatttcatctgaaaaaaaaaaagggccaagtatgttaagagccctaccatggcagaagagatcctgatggataaggaaaagcagtcacgagctgtcattaattgccctacgaagctgaaggaatctatctccagcctgactgccctgctgggaggtggaacaggtgccttctctgtggggggattggggggcagcctccccagtacccacgggcttaggcaatagctgcctttccctaatgctttgtcctccacagaccccacccacatggccagggtccttggcctgccacagtttcctagaggacaggaccccaggaaggaaggcaaggtgggaacagtattattatttgttaggatctagggatttcatctgatttgagcctttcattaagaagtccacacgatcaatagaaaaacagcattgggtcccagggagtccaaattttagctgtagtccatggtaatagacccaaggtggaatgccgtatccctgcagactgatcacatctattttgtgagacctggggaggtgtggtggggagaggaagctgtgtgtgtatctgtgtgtgtgtggatgtgtgttcctaagtgcattgtatggatgtgtctatgtgtgtttctgtgtgttcatgtgtataagtgtgtgtgcatgcatatgtgtctatgtgtgtctcttaccgtgctcgtgtgtccatgtgtgtatgcctgtgtatgcacatgtgttcatgtgagtgtgtgcatgcatgtgtatgtgtctgtgtgtgcgcacacattcgtgtgcacaaactaactaagtaggaagcttgaggacaaacctcagggtcttatcatgccctggaacatttcatccagcttcttacttgagttgctacaaagcctcaggggaaggcagttgaatgaccttcccgagtcccagtaagtctttcattgtccttgaccaaaggaataaaaatgcagcccacccaaatattaacagcatctttttgtcatctcaaaccaaactgctttataataaaaaagaacattactttattgtgtgcagacctcaagttattcactttcatccctcaaaaatttttatatgctcctaacatatggaaagcgggcatcaatggcccataatcctgtaaaatgagaaatcatatattttctgtcctacaataaaaaggctcagctctgtgaggagagtggcgcaagctggctgcttttatttttaagccatcatgatgaaggtcactcatttgcaggtggagaaacatgatgacccatgtcaggggagtcaagctgagagggggctgtggcctgtggggacaggaggggtattgagcctgtggtcagcagggtttaatcctggactttctccaaagccctgtctgtggtccttccctctggcttccccctccttcccctctctggaggctttgtctctctgcaccctggtccccaggctggctcattaacaagctgcctccttccctgaagaccagtcttgggctttgttgttaaagaatctgactttctttcttttcttttcctttcttccttctttcttctttctcccttctcccttccttccttctttctttctttctttctttctttctttctttctttctttctttctttcttccttccttccttccttccttccttctccttttttttttctagatggagtctcgctctgttgtccaggctggaatgcggtggcacaatcttggcttactgcaacctccgcctcccaggttcaagttattctcctgactcagcctcctgagtagctgggactacaggtgcccatcaccacacccagctaatttttgtatttttagtagagatggggtttcaccatgttggtcaggattgtctcgaactgctgacctccagtgatccacccacctcgattccccaaagtgctgggattacacgcgtgagccactgcacccggcctatttcttaaataatggaataacatggtggattagtttcctagggctgctgtaacaaagcaccctgtgtgctgtaaaacatcagaaacgtatttcctcaccgttctggaggccgcaagttagaaatccaggtgttggcaggccagtttcccttggcttgtagacacatcactccaatccctgctctgtcttcatgtgatgttctcccattctcccaggtatttctgtgtctgtttctctcttctttttctttcttttttttagaatcttttttttttttttctgttgagacagggtctcgctctgttgcccaggctgttggagtgcagtggcatgaacatggctcactgtagccttgacctcctagggttaaacaatcctcccatctcagcctcctgagtagctaggaccacaagcacgcacgattacactctaataatttcaaacatttttgtagagatgatgtttcactatgttgcccaggatggtctcgaattcctgggctcaagccatcctcctgccttagcctcccacagtgctgggatcacaggtatgagtccccgcacccagcctgtttttctgtcttcttagaagagcaccagtcattggattaggaagcaccctaatctaggaggactttatcctaacatgattataactgtgaagatcctgtttccacataaggtcacattctgagggtctgagtcttttgaggcactcacttttcaactcggtacacacagtgatagctgtatagatggtgcataaagcaaaaatcatgcatggtcaaaatgaccctcgaaaacccttcaaaaaggagacaaaaggtgcagctctttctctacgagggaagaaatgctttctcagagatgctggaagactctccttactcatcattggccagaactgtgtcacatgtttcctctggatgagtcattggcaaaaggaatgagacagccttgcttggcttggtccaatcatgattcattacctgggactgggaacattatcacctgtaacaaaatcaatgcaagcaaaaagcaataaatgaactgatgctgctgggtagactgtttgccaaaatggcctcaattctccccctttctgtatccacgctccttgcaatatgactttgcagctccttcataaacacgtggagcctatttcaaaactatgcacctcttaaatgtgaggcatccctacaatgggatattacacatagccctaaaaagaaggaagcattgatacataccacagtatggatgcaccttgagaacatcatgctaagagtgaagaaagccagacacaaagggcctcctattctatgattccgcttatgtgaaatgtccagaatatgcaaatccatagagacagaaaggagatttgtggttgccaaggtctgtgggggagagccggggggattggggagtttgggggtaatgactagaggtgaagggtttctttggggataatgagaaagttcccaagttgactgcggtggtgtatgcataacactcaatttactaaaatctgttgaattgtattccttaaatgagggaaataggtggtatgtgaattacacctgatatagtttatgtccccacccaaatctcatcttgaattgtagttcccataatccccacgtgttgtgggagggaccaggtggagataatttactcatgggggcagtttcccccatcctgttctcatgatagtgagtgagttctcaggagatctgatggttttataagggatgctccctcaacttcactctgcacttctctttgccgccaccatgtgaagaaggacatgttttcttccccttctgtcatggttgtaaacttcctgaggtctccccatccctgcagaactgtaagtcaagtaaatctctttcctttataaattacccagtctcaggtatgcccttagagcagtgtgagaaaggactaatacaacatcttaataaaggtgttgaaaaataatctacacctcttgtctcagagctggccttgtgacttgctttgtcctagaggagggggcagaagtgatgctgtgtctgttctgaggcctccagaaaccttacacaccgctgacatttctcagactctgggggttgtcatatgaacaagcccagactggcctggggacaatgacacatggacctagtaaccccatttgccccagcagacagcaagtcacccagcaggcatgtgagtgagcccatcctgggttactcagccatctctccagatgactggactgtgagcaaccagccaagatccaccgagccacccaactgacccatattctcaggatcaataatgagcatgtgttgccgagtcactacaccttgggacagcaggtgacccagtgataacttacacagctaccatcctaactcttgctcaacagcttcatccagacataactcagacatcacagctcatctatttcaccaattcatcaattttagaaccattttcatcacccaagaaggaagctcagtgcctatgaacagccactccctgtttctcccttcccagtccctgaaaaccatgaatctactttctgtctctctggatttgcatgtctttggcggttcatataaatggtgtcattcaatatgtgggtttttttttttttttttttggcgactagcttctttcacttagtgtaatgctttcaaatttcttccacattgcagcatagcctcataactttttatgggtagtatcagttatttatttgcttccttattctctatctttctctagtaaaattgaagatccatgacttcaggagtttgcttgttttattaattgcagcttctaccttgcctagaactgaactttgcacatagaatgcttctcgaatgaatgaatgggtggatgaatgaatgaatgaataggaaaatcagtttgtttccctcctcctattaaaaacaatgtcgaatgaccaaagaacctgaacaggcactgagttaaaagcttgtctgggccagggcatgtctcgttgccacagggggcaggccagggactcaaatccagctcagtccagctccaccagctctctgcactttcatgaagccacggggacaactgcttctttccccagcttcacatattttgattccaggcttttgcaaagcaatgttctttttgctgttgcataccaacaacaaaaaaattcttctttttgcttctggcaaaattgacaaaattgacaatggaagacaaaggaagttttcttacttggtaaagaaactggttttgctttaggtgggaaaggtttccccagctccattccctctcgatgtgtgttaacagggacgggggaggcctcactccctactgactacccgtgcatttactttaattccagggtcctgggtgggaatgaattacagggttatttaagcttgttttgccataagccttgacaaagtctttcttttcacaaaaatgtccttcattttcaaaactctgtttggcagtggagggtgcagcctgtaatccttttatgctgtggtggtgtctgtcctccacgtgactagaaacgtctttattggcaacattttgtctgggtaatgggggaagagagagagaccctgcctcaaatcacctggatgagaccctggttgcaaggggtagtcctatccaaactaacgctgaggccctgggcttcgtgacagcccgtggcacgttctcagttgtttctagcatgtctagcaaacctttggaggtcagagcctgtctactcaggggtgttcacttggagaagggcaaacacgttggggagagtaataatttgcagacctctggagaaccattcggtgctccagagctgacacatcccccacgctgtgactcgccaagccattctgtaatggatgcacgtggtgcacacctataagaagcattttcaggcctagggccaaaagaatatatcacaacgaagaaaaatggtggcaagatacatgggccaatagccggtaattcaccagcgttgaaatcatagccagccattaaggactctgtgaaggaaggagaagggaattcgaattgtagtgtggtctcttagctaagtgtctccggggctggcccagaggtgtgaatgccttaaacctcccagtagctttgcctggtgggtgggactcctgtggcctagctgaggacactgagatgaggaagaattggtggaatttaaaaaaaatacctatttccatgttttctttgcatacaatacctgcttgctgtaaaaacacaaaccattaaaaatatatatatatcaagtagaagcaaagccattcctcaccgcagcccaccaagagacagccactgagagttgcttgtcatcttcctggcacatatacatcagtgtgtgtataaaatgcattattgttttaactcaaatgggattataatctttatattgttattcatctaacttgaaaaaaatcttggtataactaaattttttacacctacacaaaagtagagagaagagtatgatgatgttcacccactgagctttaactcttgtcagtgttctgccgagctacttttatctgccatatctcacttaaaaaatttttctgttttggaaattgttagatacaaaggtagagagaagtctatcatgagctctcctgtgttcctcacttaagaacacagtttcagcagtttttatcatagagccaaccctaaacccttcctgctaaacctccacccttggattttttaaaaggcaaatacaggacgtggcacagtggctcactataatccctgtagtcccagtgttctgggaggctgaggcattcgagaccagcctgggcaacatagcaagaccccatcttcacaaaagataaataaattagctggcgtggtggcatgcacttgcagtcccagctacttgggaggctaaggtgggagaattgcttgatcctgggagtttgaggctgcagtgagctgtgatcatgccactgtactccagcctgagtgacagagtgagtccctgtctcaaaaaagaaaaaaaaaatcaaatcctgtttcacccataactttctttcttttttttttttttttggcaacagctttattgagatataatttatatatcacacattttacccatttaaagtatacaattcaatggttttaagcatattcacaaagctatacagtcatcacaatcaacgaacatttcatcaccctagaaggaaaccccttgcccattaccccttccccatttcccctctcccagcccctggcaagcgctaatctcctggatttgcatattctttatattttatatgaatggaattgtaaactacgcagccttttgtgtctggcatcccatatctcacgtcttcgaggctcatccacattgtggcatgtaccagtgcttcatttgtttttatggctgagtcatgttctgttgtatggataccccactttttgctgatccattcatcagttgaagggcacttgcgttgttttcactctttggctattgtcagtaatgctgctgtgaactttcgtgtacaggcttttatgtggatatatattttcatttccgttgggtttatacctaggagtgaaactgctgggccatatggaaaacttttgaggaaccgctgggctgttttccacagcagcaacaaactgcatgttacgtttccattaagctgtgcgtgagcatcccaatttctccagattctcaccaacacttgctgggatcttttaattaatttattaattatagagatggtcttaccatcttgcccaggctggtctcaaactcctgggctcaagcgatcctcttgccttggcatccaaaagtgctgggattacaggtgagagccaccccgctgatatgtcttttcaaataaagtcatattagtgggtataactttcttttaaatttatcgacttatcatggaagtattaatggatcagtatatatccatatatactcacatagtcaccagctgcttcctaatccattatatgaatgtagcattctgtctttatccctttggctaagcatttacatcagtcatttcccatttttcagcatcacaaacaaggtgacaatgaattcctagacatctacagttttctcaaccagtgttcccaagagaattacactctcttgccctgagccatccattgtatgtaaggaatgaacttttctcccaggggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctcttcatttggagcaatctaatgaaaaaggtagacatgcctgatgtcgtggcaagaagagagcagagaagacaaaggagggcagctgccagaaagtctcttttctcattagctgagtattttctgaagcctcatagaagtctttctttcctgtttggtcttgactaattcatctcccttcctggatgaatggagtaactcatcctggggatctgtttcttatcagtgaggggaagggagaaggcggagtgccaggagattcagacttagagagcagcgaaagacgtgcagcatttaatgaggactcagtgatgccagagaatttctttcttagctatccctttccagcttcatttttgtgttttatctaatgacccattccctggcaaaaggagaaatacaaagaatcaataagcatctaagagatgttcatgatgacaaatgaaaacagtccatcatctgttaccttccaaactggcaattctttttttgttgcacctgtttcactgacgctgctacacgttggtgaggcatatgaagaaacacaaagaacaataaaagcaagcagttcagctgaccacataggacatagacatatttcacagacacagcctcttagaagatggaagacagcttaaaggaacactaataatcatatttggagcaactatatgcagaaaataagaacattgcaaagaaacagtcagagaccaactgctccgctcttggaaatttaaaaataacattgccaaaattaaaaattaaattgaatggctggaaaataaactggaggaattttcctagaacaaaatgcaagacaggaactataagaagctcaaagaagagacgctagagatgacagaggggagaaaaatattaaagaaataataaaagtgtccagaagtatagagacacatgggtcacctcatgtgaacacagtacctttaaaacacctatactcatgaaatttcagaactaaagtaattttacatattaattaaaattaactaaacgaatttaacatatcctcatgaaatttcagaactttaaagataaaataaatatcctaaaagctccaagagaggaaaaaattcacctataaagaaattaagaatcagacttgcatcaaacttttcatcagcaacactcactgccacagaaatgtggaacaatttcttccagacttcaaggaaaaacgacttcaggactagacatttaaactcaggcctactatcatgcaatggggagtgcaaagtaaggtccttttcagacatgaaaagacccccagactctacccttttttgaagatgttccttacagatgaaaatcctgctgcatgcggtgactcacgcctgtaatcacagcactcagggaggccaaggcaggcaaatcactggagcttgggagttcaagaccagcctgggcaacatggcaaagccccagctctacaaaaaattttaaaaattagcctggcatggtcgggcgtggtggctcacgcctgtcatcccagcactttgggaggccgaggcaggtggattgcctgagctcaggagtctgcaaccagcccgggcaacacggtgaaaccctgtctctactaaaatacaaaaaattaactggatgtgggcagcatgtgcgtgtagtcccagctacctgggagggtgacgcagaattgcttgaacctgggaagcggaggttgcagtgagccgagatcgcgccactgagctccagcctgggcgagagagcaagactctgtctcaaaaaaaaaaaaaaaatttagccgggcatggtggtgtgctcctgtagtttcagccatttaggaggctgaggtgggaggatcacttgagtccagggagctccaggctacagtgaaccatgactgcaccattgcactccagcctgggtaacagagaaagaccctgtctcaaaaaaaaaaagaaaaaaaaaaggccaataatattgacctacctaccttaaatgtgcagaaggtgaacaagaaaagaaaaaaaaattcttagaaaaaaatcctagagaagaagatacgggacccaagaaactgttggactaaccttggcctccatcagaaagaaaacaataacatctctgcagtagacagaaaacatctattgaaactgaagaaagaagtcaatgtctcatgggagaatatctttaagaagaaaaatggaggaatttatttcaggagctgggatgaggagaaggctagaagatcttagcaacatggtgagagtatatattttctctctgtaagacaaagaaaaagcaattcatgaactctgaagaaacaacaaactgcacaaaaaaaatcacggccttgggttaagcaataaggatctatgggttctcaatggcaatatgaagataacacattctttgtatgttgagaccatgagtgactgttgacttagtggatggaataggctcattttattagaactgaagaatgaacaattatattctaggactctctatgacggtgcaaaaagtgttaatgtacataataatgtactcatgttatactaattttcaacttttagaatcaatgtatatttaagcagagagttttggatccaggatgccaaacaataaatcttattaaactttgtgtgatcaacccaaaggtaagctgcctgaagaagaaagaaaaggaaggcagaaaatatatcaaaagcacttatattcccatctgtcacgtagccatcacaagataaaatttagcattgatgggtcaagaagtagagattgctgtttgttatatacatgtatatatctcaccagttaaggaatttaaagtaagtatatggccatcaacaatttaaggagacctggaaagggaggtagtgacagtctgcatagctgagagtccttagataatgtctaaagttgattaaaaacaaaaaaaaaatcacagtataggtaaatgacgctttatagagataggcacaaaatcacacaaattagaaatggttaaaaattgtcagtagaactagggaatgtttggggtggatacaaaagaatattgcttctcattaatacttcttctgaactgtaacaccacaaaccatgtgttagtttcttgttgctattataacaatactataaacctgctggcttagattatctgacctttctggaagtagtgtgaaatgggtcacactgggctatatcaaggcattggcaggacagcattccttctaggggctccagggcaaaatctgtctccttgatgttttcagtgtccaaaggccacctgtactccttggcttatggccactttctccacctgtaaagccagcattgtcccatctgaagatttctccagactctgagctccttcctcttcaaagctagcaatgactggttaagtctgtctcactgtgaatcacactccttttctgctttcagcagcacatctctgactcttgtctcactctttcccgtgattacattagactcacacagaaaacctgataaagtaacatagtcacaagtcacagggattaggacatgggcgtctctctttcttttctttcttttcttttctctttctttctttctttccttttcttttttattttttttagacagaatctcgctccattgcccaggatagagctgagttcagtggtgcagtcttggctcattgcaaactctgcctctcaggttcaaacaattctcctgcctcagcctcctgagtagctgggattataggcatgtgccaccataccggctaatttttgtattttttgtggagacaggattgtgtcatgttggccaggctggtttcgaactcctggcctcaagccatccacccacctcggcctcccaaagtgctggaattaacaggagtgaaccaccacacctggccaacatgggcatatttgggggcctttattctcctaccacagactagtattaccttagtaatttgaatgaaaaaataattactcgtgtgaatttgaaaaaatctttacaatatactttgagggaaaagaagttcacaaaacagtgcctaccatatgatctaaattttgtatttttaaagagtgtgtgtgtatgcatgcatgctgtgtgtaagtgtattttcaggaaaaaaaaaactagctatttagaggtaatgtgccttctatgtggcactaagcctaactcttatttactctgtatgctcttctttattttctaaatttactataataaatatagattgcccatataatcagaaaaagttatttataaaatttccaaggaagagactgtttctagaaacaagctgatgagttggatctctttcacattctgtccaagacttttcagtcccttcagatccttagaagagctcgctaagtactcaaaggtaaggaatagtttgtatgatctgtctcagataagctgaggacatcacagccgattattagactcatccagccagatagaaataaatgtggttgttctaagatcttgacagggatgaaaaattagtgtctaggaagctgagaacccatgaacccaggtgtctatcttaactcacgcttttgaagtcacatagagcaagggttgcaaactcagctgcttaaaccagcacttctcaacccttccagtgtgtaagcattgcccagggatcttgttaattaaatgcagattgtcattcggaggggctggggcagggacctgagattctgcacctggagacctgagaatcagtgacctggggatactgatgtgatgtggctgattcagggattacactttcaataatgagggcttccagggtcaagacagggactatgaaaagcttggtgagaagtgatagggagtaggggaccagggaggtgatggtccatctgaaggtgtttcaactactaacaacaacaataatgtaaacatactctaagggaaaagcaaaactcgcctgatggccacattctggccagaagtcggtagtatgtcatgtccagttggaaggttgtgggaaaaaaaaagaaaagaatgaggggggcacttgtcacatctgatgtattagtctgttttcacactgctgataaagacataccaaagactgggcaatttacaaaagaaagaggtttaatggacttatagttccatgtggctggggaggcctcacaatcatggttgaaggcaaggaggagcaagtcacatcttacatggatggcggcaggcaaagagagagcttgtgcagggaaactcccatttgtaaaaccatcagatctcataagactcattcactatcacaagaacagcattggaaagacctggccccataattcaatcacctcttactgggtcccttccataacacatggaaattatgggagctacaagatgagatttggacagggacacagagaaaaaccatatcatctggatagccaatattgaccagatccttcagtagccaaccagtttccacctgagctatttcatgggcagaagagctttgcttttcccaaagttattggttactaacataagcaagttgggtgcggtggctcacgcctgtaatcccagcactttgggaggcttaggtgggtggatcacctgagctcaggagttcaagatgagcctggccaacatgaaaaatacaaaaattagccgggcatgatggcaggtgcctgtaatcccagctacctgggaggctgaggccagagaatcgcttgaacccaggaggtggaggttgcagtgagccaagattgtgccattgcattccagcctgggcaacagagtgagactccatctccaaaaaataaaaataaaaatacaaataaaatcagcagccagacaaacccagctcaagccctggctcagattccactcctaggtatatactcaagagaactgaaaacaggtgctcccataaaaacttatatataatgttcatagcattattcacagtagcaataggtggacacaacctgaatgtccatcagtgggtaactggataaacaaaatgtggtctaatccctgcaatggaatattattcagtcataataaaggaatcagaatcagatacatgctatgacatggatgagccttgaaaacatgatgctgagggaaaagaaggcagacacagaaggacaaacgctgtgcaattccatttgtatgaaatgttcagaataggcacatccatagagatagaaagtagagtgctgctttgggctggggagaatggtgattagggaagtgatagctaaagggtctggggtttctttggggagtgatgacaattttctaaaattgaccatggtggtggttgcacagctccataaatatactaaaaaccatttaattttacatttaaaagaaaatctagctgggcacggtggctcatgtctataatcccagcactttgggaggccaaggagggcagatcacctgaggtcaggagtttaagaccagcctggccaacatggcgaaaccccatctctactaaaaatacaaaaattagccaggcatagtgatgcacacctgtagtcgcagctactcgggaggctgaggcaggagaattgcttgaacctgggaggtggaggttgcagtgagccgagatcacaccactgcactccagtctgggtgactgagcgcgactccatctcaaaaaaacaaacgagaaaagaaaacaatatctggctggctcagggacttcctataagctgagtggccattagcaagttacttagtgactttcatcctcagtttgctcagctgtaaaatgggagtgatggctcacttccaatgtcattgggaagatattctcataatacaagcaaaacacttcacccactgctcagctctttgaaactactcagtgcagatattggtattactagtagcattcctaattgctacaacaaagaattgcttatttgttctttattattgtgttgaaactggatgagaaacctctgcagtgggcctcaggaacgcacaggcttgtctacaagtggggagttttctttgagtatctgcattcagcaaattctatcatattctctttgttgctggggagaaaaattggacaagatgtaatcctgagggatttgtcagacaatggtacctgaccggtgcagattgacaagttaagcatgtgtctgctggaccgattttcacttcgctggccgtctgcaaaggaaaatcgacggttcactgatgtttccatattagcaaagggtcaaactcagctgtctcttgagaggaggaaaaaaagcaacctcagttcagtgctcccttggcctaaaatgtaaactctgaatcgtttgatcaatcaagaaaagcttttctatccaaaacgaccgttttctgcatttcccttgtggagaaaatgccttctcttttggaaactgctagaaatctgcttctctcatcaatatcactggcagattttttttttcctttctttagttctgaaaatgattaatctaacaacagtttcggtgactttctatgagcggaccatgttcaattgtgctgatggcccattaatactggcctaatgttggctgcactcccacctgggggatctacgaagaaagctttgtgatttacccagagagagctcatcacggaattagtgcaatggatagatatgatcctaggatctgaggacgccatttaaatggtccagcagtgaaaagaggtcaccgaaagcagggaagccagaccattagcttcagcagcaaacaaataaaaagtgcagtctggctcttacacgtgggcacggtgggtctctgccctggccccacacttcggaggaccccgctccagtgttcctctgcccttgcattatcatttacctgtgttcctccctgtgaaggaggctatgatgagctgaattatgtctctttaaaaatgcatctgttgaagccctaacccccaatatctcagaatgtgactgcgtttggagataggaccttttaaagagatgattaagttaaaatgagtctattaggttggccctaatacagtctgactggtgtggtggtaagaagacatttggacacacagaggcaccagcgatgcgtgtgcacggaggaaagaccatgagaggcctcggtgagaaagagagaagaaggctgaccccaaccaagagaggggcctctggagaaaccaaacctgctgacaccttcatcttagacttttagcccccagactgtgataaaataaatttctgttattaaagccatgcagtctgtggcattttgttatggcaaccccagcagactaattcacaggccaacgggaggtgtccaccaaggctttggtatccacttctagactatgctccacagagctggacccgagaatcctctgcacaatggccccaggactatttccagagcagtaagggcctctaccttgaggctgacctcccaagagaggaccatgaagcccatgtacccagcctggcccagagaggcacccagggagtagctgtttgcagggaatctaagcagagctggcttctgaggacaggtgtttgcatgcagacaggtgaggcctccacaattgcagaagaaagatgcgggagggaggggacaggtgtttgcatgcagacaggtgaggcctctccaattgcaggagaaagatgcgggaggcagggaaggtgagcaacccaccgccgggcatcaaggctgaggctggctttcgctgttgtatgtaccatgtcctgtgcaactacagggagtcaaagggttttccactggagcctggctttctgggttgttatgcaggcatagtgtcaaagtgaggaaagagaccagcaggatttgttttccggtgacaaccccgttgaccaaaacaggatctggtgccgtcaggataaagtgaaagaaccggcagaaccagcagatggtgacaaaagccatccccagctgccctcattgctcattggcataagaggctcccaccagcatcgtgacagtttacaaacaccatgggaacacattggaagttgtcacccctttccttggcaacaacctggaaattactgtccctttcctagaaagttctaactcacccaccctttaatttgctgtagccctccccttaatttgcacataattaaaagtaggtataaatgcaattgccaagagcccgtacattgtcaactctgggtgcactgcctgagttagtcctgccccacaaggagcagtaccattcagtaaaacattcctgtctaacaccaccagcttgcccttgaattctttcctaggcaaagccgagaacccttccaacctaagccccaactttggggctcacctgtcctacattgaaggcaaggatagggaacgcattttgtttgttcacctgattagtaacctttaagcatttacatctgtggcaggtggacctccactgatgctctcactttgggccccacaaatgtctggggtgaggccaatggtacccaatcgaatgggagtttgagactccattagcccttgggcggccccgttttcatcttcctgatactgatggtgagctgggccaagagacactctggaaccttcaggctgcctcttctcccacttgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttttttttttcgatacagagtctcactctgttgcccggactggagtgcaggggcatgatctcagctcactgcaacgttcacctcctgggttcaagagattctcctgcctcggcctcccaagtagctgggattacaggcactcgccaccatggtcagctaattttttttgtatttttagtagagacggggcttcaccatgtgggccaggctaatctcggaatcttaacttcaagtgatctgcctgcctcagccttcaaaatgctgggattacaggtgtgaggcaccgcgcctggactatagttcttttttttttttttttgaaacggagtctcgctctgtcgcccaggctggagtgcagtggcaggatctcggctcactgcaagctccgcctcccgggttcacgccactcgccttcctcaacctccccagtagctggaactacaggcgcccgccaacacgcccggctaaatttttgtatttttagtagagacggggtttcaccgtgttagccaagatggtctcgatctcctgacctcgtgatccgcccgtctccaccacccaaagtgctgggattacaggcgtgagccaccgcgcccggccgactacaaatattttttaaaagaagttgcaagcttaattgtaaaattatatcttttttgcaaacttaattttgaataaaaacataaataaaaccaaaaacacacacacaaacagtggtcgtttctgggtggcgaaactgcaggtgccatattttcttctttgtatttttacatagtttccaaatcacctctataagtaatttaaaaatcaataagaactatatatttttaaatacagtttaatcaatagaaggctgtctaagaaatgcgtagtgtatgcacagaatgaaatatcacacagccagttaatgacagggtagggcaactcaatgtctgcaactggtgcagagaaggtccccagatactttgctaagtgaaaacctcacggtgcacagggacagctcttcttactgacaatggttctggtgctttttacacatgatgctacacagagagactttaaccttcaaaaacataaccctgaggaataaatacagtttaatttccatatggacaacaactaggaatgaacaagtaaaagtttaaccacatttactaagagtaagcatggcttcagttctcgatatttattagattgagcaatgtaattgatttttttcctctgggcaataggttggttttgcagagggctcctctcctccttcaactcttaaaagaagcaaacctaacttcagatgactttgtttatttgaagcagaggtcaagcatggtaaaattgagaactgtaagtttgaaggaaaaaacaaaaatccagcaatctgactagaggagaaataagtccttgcccatctgttagtagaatacgaactggaataacctttccatatagcattttgtcactgtcaatcaaaacaaaagttacacagccctttgacccacaggctttcctaggaatttatatttccaacatccacatacaatggtgtaaagaaatgtaatcgaaaacacttcagccttgcttggaatagcaaaaaaacaagagagacttttaataagtatggtgcattgtcacagtggaatacctcacagccaataaaaagaatgtagctttgtggatttggaaaagtagctaagatatgagttaaatatacagacctaatcccacttgtgggaataaaatgttccacatatgtgtgtaaaacctttaaaaagaaataacaggggccggctgcacttggtggctcccgcctgtaatcccagcactttgggaggccgaggcgggcaaacaactttaagccaggagatggagaccagcctggccaacacagtgaaagcccgtttctactaaaaacacaaaaagtagctgggcatggtggtgcacacctgttaatcccagctattctggaggctgaggcacaagaattacttaagcctgctaggcagaggctgcagtgagccaagatcatgccactgcactccagcctgggccacagagtgagactctgcccacccccccaaaaaaaagaaagaaagaaagaaagaaagaaaaagaaaaaaataataagtatcactttacagaaaatgacacaacttgacaacttgttgggggtggggtgggggaagagggagaacatcaggaagaatagctaatggattctggtcttaatacctaagtgatgggatgatctgtacagcaaaccaccatggcacacgtttacctatgtaacaaatctgcacatcctgcacatgtactgctgaacttaaaagctgaagaaaaaaagaaaagaaaacaacacaactcactgtcaacagaatcactaaactcagggctgaggctttgtgactgcatgaaagagttgcaacagtcagtgacaaccttacaaaggttcctactgagctatcagggattccgaacttcatcttggcctataaggaaagttaaactctacacttctttcacattcagagacaaagctcagactgtgtttcactacacttaaaactgaattcaaggctgggtgcagtggctcatgcctttaatctcagcactttaggaggccaaggtgggtggattggttgagtccaggagttcaagaccagcctgggcaacatggcaagaccttgtctctaaaaatataccaaaaaaatagccgggcatggtggcacatgcctgcagtcccacatgcctgtacttgggaggctgaggtgggagggttatttcagcccatgaaatggaggttgcagtgagccaagattgtatcactgcactccagcctgggtaacagagtgagaccctgtgtcaaaaaaaaagaaaaaaaaaattcaaagtcatatacttgttcagcagaaaataactctctagaaataatactttcagaaacactctccgcatatacagaaaacagttcatttagattgttcaggcacggatgcaaaaatatggaagcacaaatatattctcccaagttggtatgctatgatgtctgtacagagacaagcattctaaaaggtgaaatagaaaaattaaagacaatgtaaacatttatttattgaagactttaaatgatggcacctctgcacaatggatgagacagatctatgtatgtgccactatgggagaaagttcccagatgtgtggctgagcggtgaaaaggaagatgctgaatatatattcagcggtgggcttccatttgtgtgtgtgtgtttaagatgggggaggaggtacatataaatacatgcatgggtgtacatgaacctcctcatatgcatgctctgtgtagtgccctctcacactgaatagtgctgacctgtgtaatcagaaggatattgtgggattcatgttgtattgacttctgagcctgggtcatgaaaaataaggcaaattccaacttgcttttcttttgatggttctctcagggagaagctggccatcacatcgtgaggacactcaagagggccatggagaggaccatgtggtaaggaactgagacctcccaccaacggccttgtgagtgcactataatggatgcacatcagcaagccccagtcaagccaccagataagactgcagcctcatgggaaaccctgagacagaccacccagctaagctgcttttgaatgcccacaggaaccattagataacaaatgtactgcgataagcaactaagttggggcagggggtaatttgttatgtaataatagataatcaatacagtacatatatttctaggagaatatccacaagaaaatgttaactgtggttacctctggaaatgagaaataatacagtggggataagaggtgggagacaggcttacttttcatactataccactcagttacattttacaccggggcaatttttcatgtattacctgaaaaaataaaaaagaacacatagtaagatgtgcccatatatgaagagagtgttcagagagggctcaacttcctgtggaacaggaggcaggaaaaagagctggagcttaaataaggtttgatacagtgtggaaaaatgaaaaaatcaccttcagtaaaaaacctctaaaatttttgaaagtgtgacacattttgctgaccaaaatttaatcctgatgtgatgatgactagagcaaattttgatcctccaatgacatgctattactatcccttaaaatggtgcagcacaaatgataccactactatgtcatttaattcatgtttgaggaaatcactcaggccagacaataacaaaaatatctgtcttgcctttatttggtggctgctatactctcagtaaagtcagatgggtcttgtgagtgttaagaaaaattttccacaacctgaaaataaggtcaagaataataagaataaataaggtccacatgcattttcttgcaatgttctaggaagccataattaaaagggtcctctaaagactcattttctgagagagtgtattgttgtttgacttcactatttactattaattgaaagctcatactctgtgaagttacattaagccatttgtagctttgtgtcagggagagacgtaaatcatttctgtccagtagaagagatacttccaaagcttggggcccattgccttgttggatgttaatcagttctgcaactaacctcgtgaatttactctgatattctttattaaattgcttatttaaactccagttgctcaaatgtgctttaaactggttttaacatcttagtagtttcctcataaattgatgggttgaacaacatctttcataagtgctctatttgtaaaagaattcttttgaaaaaaatatattttgaaagatgaaatatgcattgaaaaaattcagggccaggctcatgcctgcaatcccagcactttgggaggctgaggaggatggattgcttgagcccaggaattcaagaccagcctgggcaacaagggtgaaaccctatccctgaaaaaaaaaacaaaaatttaaattaggggacatggtggcatgcacccatagttccagctacttgggaggctgaagtgggaggattgcttgagcccaggaagcggaggttgcagcgagccgagattgtatcactgcactccagcctgggtgagagtcagagagaccctgtcccaaaaaaacaaataaataaacaaacaaaaattaaggatgatacttttaatatggtaaaaacagtttcaatacacatccattcttgactgttataacatttaagaaaattgtgcattaagaaagcaaaccaaagagattattgcatgtctcccatttctgaactggataaaaaggagacactgtttcccgtgttattggacattacaggcacttccggttttcagaatttctagtgttttacttttgaagaaaaagaggattaccttgcaaaagcctgcctcccctatagagatgaagagccagggcagcctcgcagttctcagccaagatgaggtttgcaatctcagatcggctttcaaagtcaaaggcatctttcaaaacgcacacgtgccctgcagcctctagatgggccctttatcaaaaaatacagagaaaggagaagatgaggggaaaatgttaatatgtaacaggttgctgctacagttaagactttttttttttttggttgttgttgttgttgttgttgagacagagtttcactcatgttgcccaggctggggagcaatggtgcagtctcagctcactgcaacctccgcctcctgggtctccaagcgattctcctgcctcagtctcccaagtagctgagactacacgtgtgcaccactacgcctggctaattttttgtatttttagtagaaacggggtttcaccatgttggccaagctggtctcaaactcttgacctcaggtaatccacctgctttggcctcccaaagtgctgggattacaggcatgagccactgtgctcagctactatgattaagattttaaatgaattccacaagatgacttatttactgaatcaccctttgtaagcaccctgccttaaaatacaaaagaaggcctagaatcaatgacattagccattcatctgccagtctcagatacccaggactgtggctggaaccgaggccattggaaggaagattgacccaggaggccctgacagccttcagacatggggcacacactgccacctccagtggcatttgccataccagacagcagctccttttctatttccttaattccacattttctctcctgtccctgaattgtggtatctaaagattgtttttgggcctctgttgctcggttctttgaaaagacttcaaaagtcacctattatcatagcttcaaaaaaaatacttcctggtttttccattctacctgctacacacacacacacacacacacacacacacacacacacacaatatttatgtctttcaaacatgtctcttctctttgtctccaccttagtttcagctcctggtaacataaatataaaatacctcataaacaaaaaagaaattttttcaatagtgacaacaacatgaacaaaatcagaagacaaatgagaaactggggaaaaaactatttacgactgttactatagaaaagggctcatctgcttaatatataaagagcattcgtaaatcaataaagaaaaaaggctaacaacacaataggaaaacggacatgagggctgggtgaggtggctcacgcctgtaatcccagcactttgagagttcgaggcagacagattgcttgagcccaggagtttgagaccagcctggtcaatatggtgaaaccctgtctctataaaaaatattttttaatgcactgggcatggtgacacatacctgtagtcctagctacttgggaggctgagatgggactactgcttgagcctatgaggtcgaggctgagtgagctacgactgtgccactgtactccagcctaggtgacagagcaagaccctgtctcaaaaaaaaaaaaaaaaaaaagccagccacagtggctcaagcctgtaatcccagcactctgggaggctgaggcaggcagatcacttgaggtcaggagttcaagaccagcctggccaacagggtgaaatcctgtctctactaaaaatacaaaaattagccaggtgtggtggtgcatgcctgtaatcctagctactggggaggctgaggcacgagaattgcttgaacccgggaggcaaacgttgcagtgagccaagatcgtgccactgcactccagcctgggcaacagagtgagggaaagagagaaagagagaaagaaagagaaaaaaagaaagaaagaaagaaagaaagaaagaaagaaagaaagaaagaaagaaagaaagagagagagagagagagaaagaaagaaagaaagaaaggagggagggagggagggaggcagggagggagggagggaggaaggggaaggggaagggaagggaagaaggaaggaaggaaggagaaaagaaaagaaaaagacagaaacagaaggaaagaaagaaagaaaaagaaagaaagaaaaagaaagagagaaagaaagagaaagggagcaagagagaggaaggaaggaaggagggagggagggagggagggaaggagggaaggaaggaagggggaaagaaagaaaagagaaaaagaaaaataaagatgggcacaaaattgcagtccatagaaaaagaaatacaactggactcttgaacaaagaaaatgatgctcaatatcagccatctttttaatccagaaaatctgtaaagattaaaatgttgacctgaggcctcctgaaataaacactcctatacattatctgtgagagagcaaattggtacaacctctctagtgggcaatgcaacagcagctagaaaattttaaatgcacaaaccctgtgaccaaataactccacttctagatatttattccaaagatggacttggatatatgtgcaaaagcatgcacccaggaatacgcactgcagctgtgaagtagcaaaaagaccaaaaaactacctcaccgtgcatccgcagggccctcgttatattatggtagatggacctaatcatgttcttttgccatcaaaagaatgcaatagatcactatgaagtattaagaatgaattccaagattcactattaatgaaaacagagcacagtgaagaatacttttgggtatatacactgtgtgggcatagaatatctctagaaggatacattaaaaagagataacaatgattgtgtccaaagaggagagtcaggccaggtgcagtggctcccacctgtaatcacagcactttgggaggcagaggtcggaggatcatttgggctcaggagttcgagaccagcctagacaacatgatgaaactctgtctctacaaaaaatttaaaaaattacctgggtgtggtgacatgcacccgtcatcccagctgtttgggaggctgagatgggaggatcgatgagtccaggaattcaaggctgcagtgagccatgatcatgcgactacacttcagcctgggtctcaacagagcgagaccctgtctcaaaatgaaagaaagaaacagagagcaagagagagagagagacagagaaagagaaagaaagaaagagacacacgagcttttgtattgttggatagtttttaccacatgcatatattatctttttaaattgtttgaggtgtgtatgtgtgtgagtgtgagcgtgcgtgtgtatgtagatacacaacaaatgggaccaggtctcttttctgattaaaacctgcaaagagctcaccgtattcagctcaactgtcagtggcatgagaatggggaccatttctatcctgcttagggaatcaactaatggctgagcgtgtctctgggataaatgcctcagcccagaacacagctcaccctgcatggcagaagtgcactccactccaaccaccctcccacagcaggacctctggcacatcacgcttccttcttgagtctccacgccgctgacatgacacttcctagtgccagctccttccagagaactctcctgacagccccagttcctacacaccacagtctctcaaaattcccattttgttttgagcctatctctgttataacccctctgcactgcatttatagggaagatggagtcacatcttacttggggcactgattacaaaatcagcacatacatgaaaatcaagtacacttaaaagtacccttgaatcggccaggcgcggtggctcacgcctgtaatcccagcactttgggaggccgaggtaggcggatcaggagttcgagaccagcctgaccaacatggtgaaaccctgtctctactaaaaatacaaaaaaattagctgggcatggtggcatatgcctgtaatcccagctacttgggaggctgaggcaggagaatcgcttgaacccgggaggcggagactgcagtgagccgagatcgcgccactgcactccagcctgggcgacagagcgagactccgtctcaaaaataaataaataaataaaaataaaaaataaattaaaaaaaaattacccttgaaaatctcttaaatcatccagacagtactatagaacaaagttcaagtccaacctagcccttttttcttttgtaattccagcaatgaaatagttatttattcagctgaacaccaggtgaattaactggtgtgcatttaggagcaatattgcacaaaatcatgagtaaaacaaagaagaggaggacaaagatcagaggaggaggaagtagggggaggtctagagcctttaaacactgtgttcataaaatgaccaagttgctaggactgtgggagccacagagaaacatgaggttcaaatcgtctgaccctggggcatatggtgagattctacactgtactaatatgtggatgatatttttctctctctctttctgtttctttttcataatgtaaagtgtcacaacatcactgtgcaaataaagaataactagggtcttgagacttaggttggtttaacttactgaagtgcatcgtgtatcttgagcctaccattttcactgttaattttgatccagtcattgtgggtcagtaacattccttctctccccaccaaacctagtatcctttggaaatgctgaaggtaactgaccagcaggatcaggaaagatgcctgcagcagtcaagctatcagctcgcttcagcctaaaaaaatataaaatacatcacacaaaaataaggattcaacatgcttctgaccatggttgaataattgctattttatgttcttcgtaaagctctaagaaatgagaagccaaaaataaacactgatagatggaaaaggggctgaattctacttggagagtccattcctgagggactcatgacttatgcagaatcgatacagcagagtgcgtggaatgcaggtggttacatagagacaatcggtagtttctgatttattaaggtgtttttgtttgtttgtttttgagatacggtcttgctctgtgggccaggctggagtgcagtggcataatctcagctcgttgcaacctctgcctcacgggttcaagcgattcttgtgtctcagcctccagaatagctgggattacaggcacgtgccaccacacatagctaatttttgtatttttagtagagatggagtttcaccatgttggcaggctggtctcgaactcccaacctcaggtgatccgcctgcctcagcctcccaaagtgctgagattacatgcgtgtgccgccgtgcccagcctattaagcatatttttaaatggcattttgacactaactttgcaatctcataaatattctaaataaatttgtctaatctaaattattcatgaactaaaattgtacccttgtttctggctgacttgcaacacctttaaatcgatctatgttctctccttctgtcaagtaataattcaattcaactaataaattcactaagcacctattattcccaaataattctgatttgatttaaaaaggctttcttgaaaacaaaagcatctcccatagagattttgggcacttggcaggtccacaaagagaagaagcctatgtgtgcgcgcctgactcaagattcacagacgctctgtggctccccggccagcaaccagactctttacttgagtgtacagtagagtttggtcatttctgtgttttggttttgtttttttgttgttgttgttttgagacagtctcaaaaatatttgctggagtgcaaatttatttactttttgagatggagtctcactctgtcgcccaggctggagtgaccgtaatcccaacaggctgaggcaggtggatcacatgaggtcaggagtttgagaccagcctggccaacatggtgaaaccccgtctctactaaaaatacaaaaagtagctgggtatggtggtgcatgcctgtaatgccagctattcaggaggctgaggcaggagaattgcttgaacctgggacacagaggttgcagtaagccatgacagagcaagactctgcctcaaaaaaaaaaaaaaaatagaatacacacaggaactcttttttaaaagactgcaaaaattcaatcacctaacaggcaaagtgactagatcaggaagtgtcttgaactcaaatgtcaattgagatcaggtgaaattcaatgaactggaggtgaggatggtgaaatcataagacaggatgagctctgcaccgaacaggaggggacgcccatctgcagggtcaggcccccatagtccagtaagataaagaaagccacctggggcagctgagcactaaaactgtgcctaatccaaatagaaaggcactcagtgtgaaagacacacgcagctcggttagacatgcacacgtataatatatattactacttatacgtaaatatataaattatatgtatacacatatttataatgtgtatttcaaatatgttttataaatattctatttatatcataaatatttcaaatatataatttatttcaaaatagatggggctgggcatggtgactcacaactataatcccagcactttaggaggccaagacgggtgaatgggttgagcccaggagtttgagaccagcccgggcaacatggcgagaccctgtctccacaaaaaatacaaaaagtagccaggcgtggtggttcacgcctgtagtagtcccagctactcgggaagctgaggtgggaggatggctttagccctggaagacaaggctgcagtgagtcaagacggtgccactgcactccagcctggacgaccgagtgagaccctgtcaaagaaaaaaataaacgaggctgggtgcggtggctcacgcctgtattcccagcactctgggaggccaaggcgggcggatcaactgaggtcaggagttcgagaccagcctaatcaacatggagaaaccccgtctctactaaaaatataaaattagctgggcgtggtagtgcatgcctataatcccagctactcgggaggctgaggcaggagaatcacttgaacccggcaggcggtggttgcagtgagctaagatcgtgccattgcactccagcctaggcaacagagcgagactccatctcaaaaaaaagaaagaaaacaaacaaaatagatcaaaatcatgtttagacatgttgagtgaaagagaatataatattaaagttgattttatctgtttctttttgctatgtttaatgtgactactggaaaatctgacaggacccatggggctcacattatgcttctaggcgagagtgcaaggtcagaccccactggctctggcagtcggcacccagctgatcgaggagctactcactgctacaaggtcaccaatctacccagagaagccaggcatttcaacatctgtgagaatctccccaattccaacctccctaatggtatttctcactccttcaagatccacaacacctgttagtcctctacatcttcagaagttcccggaggcctgcgtttcccatttcccttctccatacggacgagtgacgcttttgggcggggtgttgcctctagtgtctgttcccacacgctccttcctaatacctcgaccctccctggcacttacttgaggaggacgagccccatctccagatccaagggtgctcctgcaggctcatgccaatcaaaacatccggctctccacacacccacccctagacgttcaattctgggacctgggtcgtgttttcagagactcaacctcagaggttctccatgggcctgacctgggattcagggagacccaggaggggctggcgagaagattctgccaggagagggaagcagatgcaggagacggagataagtggactcctgtccctgtcctctgctggaaaaccaccctgaggaggccctgcctccagccttcttatggcaaaagccattacattccctttattgtccaagacaatttaggttgggttttcaattcaacttagctttcaattcaattactcaaggctgaagatctctaagccacaccacagtaatagcttagcgcccttattgttagtttatacacaatccatcgcagtctctcatcccctcaatccttccattatgagtcctttggcctcctcggaattccagaccattgacctctgccccctcggacccacagtccctccgagcttttctcccagttctggggagattccatgctccgccatttcaattactttcttgtcaacaccttaaccactcccgtcccccagtctttctgtagtaagcgtgtgagcatttggaacaacgccagccctggagagtctccaggtcagctttctccatggcagccccaggcactggcgcctgctgggggacccccgaggcagagggtaagtggagatctgtgagatgggatcccaagttgctcactactgcgtcggaacctttcatgcattttcagtgaccaagcgcacctgctgtatgcccagcaccgctggggcaacgagggttcagtaaagaaaaaaacatgcacaaatccctgccctccaggtgccaactctcttttttttcttttccttttttttttttctgtttttttttttttttttttgagaaggagtttcactcttgttgcccaggctggagtgcaatggtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacacaaaggagactcgcacagagagagacccacataaagagacccctggggagaccccaggagtgcccctgaggctcacagccagcagccagctttaacctttagatgcataagtgagggaccctttagatgcataagtgagggacccttcagaggattgcagccgcccatcttcggatcttccaggtgaggcttcagccatccatggagcagagacaagcagtccccactgtgtcctctccaaattcctgagtgaagaaatctgtgagcataaccaatggttgtttgatgccactttgtgtggtaatccgttgtgcagccacagtaactagaatagtcagatttttttaaggaagtacactccagacaatctatacaagatgttgttattctgtgtggtataaagagggttttttgtttgtttgtttgtttgtttgtttgttttttgagacagagtctcactctgttgcccaggctggagtgcaatggcatgatctcagctcactgccacctctgcctcctggtttcaagcaattctcctgcctcagcctcccaagtagctgggattacaggcacacaccaccatgtccagctcatttttgtgtgtgtgagttgttagtagagacaaagtttcaccatgttggccaggctggtcttaaactcccaacctcaagtgatccacccacctcagcctcccaaagtgctgggattacaggtgtgagccaccgcacccagaaaaaaaaaaaatcatttaaagagttgcttcttgagacttcttgggagaagatggaaaatagattccaacaactgctttcaagaagttttcagccaagaaaaacaaaaacaacatataaatgtctcctttcaatttgtcaaaagtgggtgattccataccaggcaagtacagaggggagtcccctccaacaaggagaagcacattcagaattcctgcattatcctccagctccaagtggctcgaacagtaggaaaaatgcattgctgtctaggaaagaagacctgaagtttgcaggattcctgactcagccagccagcaatgccactgaggaagcagcccttccctctttctgctctgctgctgttcgagcatggattcccctctggaatctcccttcctggtctcaggatggcagccaaggtctcaggcatcactgatgggtctgactgaaaggagggactgttcattcctctgcttcactctttaaaaaaaaataggagcatttctcaggtgcctccaagcagcctcatgtgtcccccttcggctggaatcatttcacactctacttcctcaacctgtccctggtgattaaaatgagattcctatgactggcttagggaagcacatgactccggagagggggctgagcattaatccagtaacattaagattcctttagaaaggagttggctgtttgcagagatttcttttcttttcttttcttttctttcttttttgagacagcgtctagctctgttgcctgggctggagtgcagtggtgtgatctcagctcactgccccctccgcctcctgggctcaagggattctccttcctcagcctcccgagtagctgggattataggcgcccgccaccacgcccagctaatttttgtatttttagtagacacggggttttgccatgttggccaggctgatctccaactcctgacctcaggtgatccacccacctcagcctcccaatatgttggggttacaggcgtgagccaccccacacagccacagtgattttaggtgggttccttcaggagctgtgaggagagatgagagaaggcttcatgcaggtggtagctgagctggtccctgaataatgagcctaatgcagatgaaaggtcctgggagaactatttagtggtgagttctgttgacactgttaaggctaaaaactcctaaacctttcttccccacttgcggcctccaatagtttttcctgaccgacatctcaagatgtttgcctgtggtcagcattttaccaaccttgatcagatgtccacagactactgcactgtttaacttaagtacccaaacagtgacactttcttatctatgaacgtctttagcaggactggggactgtgtgaatctgattgaattgtccatcagccttgagcttaaccttagcagtaacaaccagctcccagggagagaaatcgatcaagagataattaaggatcatgtagtattggaaaaataattattgggggaggagggccccagacagtagttctcagaagtgacagtggccaagtaactcatcggcaaacaaagagcagaaggttgctccctgggaagaaagaaaatgatgcggtaatgacaatggaagaaattagacattggaaatggagttgtcattgtcatgggaaagaaatcgcccctcttcaccgatgcgctggaaacctcagggcttcccccgctgtaagaatagtagagtggggttggcctaagagagggttgaatttagaaatagctggtatttggaggaaaagaaaatccactgtatgctaagtgcatttcacatggaatccagatagcagctgagccccactgtccttcagagaaaaagattaaattcgacctcaatcctattttattttatttagttatttagagatggagttttgctcttgtcgcccaggctggcgtgcagtggtgcaatctcagctcactgcaatctccacctcctgggttcaagcgattctcctgccctagcctcctgagtagctgcctgccaccacacccggctaattttgttgttgttgttgttttatttttaatagagatggggttttgccatgttggccaggctggtctcgaacccttgacctcaggtgatccgcccacctcagccccctaaagtgctgggattacaggcgtgcgccactgcacccagccctattttataaccgtaaaattttacccacactttttgtaagttccccatgttttgctctcgtgtggtgtgtccatgttggatacttggggtataccctgataccccagacatttgaaactctggccctttgctagagaaacccattcaaggtgaaccccttggatttcacagatgttgctgaatatgatgaagaacaccaggaggggccgctcgtagagcacaggcgagaacagactatgctgtgggggtgaacccctgaccttggagtcttcaggcggctcacactctcacgcagtgcaagacaggaagtcctgcttatggctgcgctgtatagagcatgtggtctccacaatcatcacagcagaatgtgagtgtggtcagctcgcgatggcccccagggatgttgtcctctaagtcctggaacctgcagacaggttaccttacatggaaaaaaaaaaggggggctttgcaggtgtgattgggttaatggacaatgttggtgagattatcctgcattatccaaggcaagggacgcgggaggacctagtcacaagggaactcacacatgggaggcagagagatgaacggcacagcagagagtcagagaggagatggagcgtggaagcagaggtggcatgagcccgggaatgccggcagctgctagaagctggaagagggaatgacagagcctcctctggaacctccaggagaaaccagccctgctgacatcatggcttttgtcctgtgcgttagtttcctagggctgccagaacaaattatcacaaactgagcggcttaaatgacagaagtccgtggcctcatggttccagaggccagaagcccaaaatcaaggcttcgctgaggcgtgatccagcttctcagcatcttccctttccccactcaggatagctggaaacggtcgctcctcctcctaaacagggaagaaatgcagagaaagctccaagcagagggaaatcccacccaaaaggaaatgtgtgattcagacccacgaagtggcgagggctgtgttgacacttggtgcctcagtttcccctctgaaaatgtgtattataataacaggctgtatctcatggggttgacaggaggattcagtgagttagcccatggtaaagggtttagtgcctggtgagcatccaacaagcaagtgctttgatcgtctgcatagggatgttatttggagcatccctgtgtggccagtgctgggctgggcactgcggggacagacgtgagcagagccagactctgccctcaggcttctcgccctccaggttaggggaggaggtagaaccaccaccgcacctccacacgagctgcccatgcctggcttgaggctcagccagggcttatcctggagagttctgtagaaatgaaccccaggccgggagggatgtctcacgcctgtaatccctgcactttggaaggctgaggcaggcagatcacctgaggtcaggagttcgagaccagcctgggcaacatcgtgaaaccttgtctctaccaaaaaatacaaaaattagccgggtgtggtcacgcacgcctgtagtcccagctactcgggaggctgaggcacaagaatcacttgaacccagggggcagaggttgtagtgagccgagatcgcaccactgcactccagcctgggcgacagagtgagattccatctcaaaaaaaaaaaaaaaaaaaaggaagaaagaaagaaacccccaaccaggagaagcaagtggccgatgccacagcaagcggtggtttaaagcttgagtgatggtttcaatcatttctcactttagctaacctcatcttgcaaatcctcagtgtacaaccaacctgaagaatctgatttgggcagaaataactccatttcaaagatgtttgggattcaggctctgaaggcagcagagctgtggctctggatgtgcccagatgccactctgtgggctgccaccttcagtggaggagggggcagggctggcagacagggcccaggtgaaccagtgaatacatatgcgtgcaagtgtcacccgccccttgctgtgtgtccccggacaggccactcagactcccagaggcttagtgcttcctcctgtaaagtgggcccctggtgggacccattccatgctgctgttgcaggatttacagaagatccctgacatggagtaaactcagcagagtcgctgttattgggtggaagtgtcaaggagaagggggcttggctgagcattccagaagtacaacagtccatgtgcatagcgtgagaggttgtggctgccgtaagacagggcactgtgagctctaaaagaaaggccggggcttatgggctgccttgacctccggggaaactgcgggggaaatggcctaactgcaagccccctttcccactctgctcccacagatcaggccccccagccactccaccctccttaccatggacaccaggcacgatgcctgcccgtcccttagccctgggctttgttccgttccctgcccccatggaattacggaaacaatgacaccctcctgtgggaaccaggggacccacaccttcttgtcactatagagctggcccccaatccctgccggcacagtctgcttccaacgacaacctccatgtggccccatgtggcatgtgatgccctctcgcctgcggggagtacaagtggccaacaaaccattgtttatctcatccatcttgtgccaggtgtcacgtttgctatccttatacccaagggtggcagttccctcacccatggggtgaatagcaggtgatcaaaggagacaggaatgggatctaggttcacatgaacctgggtctgcaccctagccctgctaccagctgcatgtccctgagcaagtcacccaccttctcagaacctcagtttccccatccttaatgtggagaaaataatgcccaagccttatgacaggaatacacatgcactaatccatgcataaccacgcaggagaggcatggaaccacacacactacatggaatggaacacttaaaatgggttatatgtagattacatctcagtaaagttgattttacaaaaacacacagaaagagctgggtgcggtggcatgtacttgtaatcccagccactagaaaggccagggtgggaggatcacttgagcccaggatttcaagaccagcctgggcaatatagtgagaccctgtctccaaatacaagcagagaagatgagtccttctacaggtgatggctgggtgtggaatccctctctctctctagtgcctaaggaaatctgctctggaatctgacggctcagttcaaaacccgggctgccccctcatcagctttgctaccttcagaaagctgctgcacccacctgtgcctcagtttctctatccctaactaggggatattaacaagtcttttcccattgggctgctatgaggatgagacgagacgacacgccaagtgctttccacggcgctgggaacacacgggttttgtaaataaccgcaagctcacaacatctccctctgagggatgcccaagccccccatgctccccaagccttcagccagaaaagggggacactgtgctcaaggtgccccaccttcctgagggctcctgcctgaacatcttgttttaacaactatgtggtgagctcctactgtgtgcacggcacgaggggagaggaaagaagcggtgagcagagacaagcactgctccagaaggtccagtggggtggggtggagcacggagatgacagttaattagaaagaaagctgggggtgggagggatgaagggaaaggaaagaacaaaagaaaaagggaaaagatgaaggaaagaaaaacaaagggaagagagagcaagagaaaagagagagggaatggatagagagaaggaaataaagaaaagaaagataaagaaataggggaaggaaggaaagaaggaagaagagagggagaaggaatgaagagagagggataaaagagaaagagaacagaaagaaaaggaaagaaagggaaaggaaaggaaaggagaaaggagggagagaggcaggcaggggggagggagggaggaaggaaagggaagagaatgagttgctttgtgttagaggcaaggtctttcatgaaattctgagcagggctcaggagggagcctagagtttgcgggtgggtctcagactaaaagattaacctgctccaaggtgtacaatcttatttgagtgtggacctctgtctccagattgaaatcatcaaagctgtcttcaccacagcaataatctgtttacaaacctgtagacatgtccctcggctcagaattcattaaagagcagtggttctgctgacacgggccgccccccgggatgcagcggccagtctcagaatgagagggatggctccgtctccacctcaccccagactctccccaccgccccgcgctgcctcaactaaatcaaaccactacttttctctggttgtcttctcaagatggggaatctgccactaacagctgtgcttgcaaaccagctttctttggaagaaactaagatggatagctgtaaactggttgtaaaattgcttagccacagagagggctgaagcaaagccgtgtgtccaggatgcatccagatcactgaaagaaagaccaggccatggggagtcccaggaagaataaattcgtgaagtgaaaagaaagaaatgcctctcttcgtttgtttttctaatatttcttttcaatttgtcgaatacaaacagttcggcttttgcaagacagacaattttctccttcttcccgagtttcctcctgggcttctaatgtaaggatgtctaactccgggacagaaagcaaggaaggaagcacccgttctctccccgccctcctcacgcgccctctgcggaggactcccctgcggctgcttgggtaaatgggtctgagctgcagagccgtactactctgacgagggtctgtcagagaattccatttgagggaaggaagtaggaagcccacttggccatggactaccttcctaagtccacactctcaaatccaccagtagggtgaaacggtcgctaaattaacaaatcctatcacaccttatgtgctatgtgcaaggtggtaagtgctatggagaaaaatcagggaaaaaaaagcagctagcttcagtgcagggacaaagaggttgcattttttttctttttcttcgtctttgtttctttttaaacagagacaaggtcttgctctgacccccaggctggagtacagtggtgtgatcatagctcactgcagctttgacctccgggctcaggccatcctcctaccacagctcctgagtaggggagactacaggtgtgcaccaccgcatccagctattttttaaattttgggtagagatggggttctcacttagttgcccaggctggtctcaaactcctgggctccaataatcctcccacctcagtctcctgagtagctgggactacaggtgcatgccagcgcacctggctaatttgtacattttgtatacagatgggctctgactatgttgcccagaactcctgggctcaggtgatcctcccactttggcctcccaaagtgctggaactgcaggagtgagctgccgcactcggccatcgcagtgcttcctgcacatgtgccatccgaggtggaggaaacgtgacatggaacggacactggtgatgcttgccaccgtcagtgtcttctccttcctcattgtctcagtcacctgttgctgcataacaaatcatcccaaacttcagtggcctcagacaaccatttaatatgatcatatctcatgtgtctgtaggtcagtccttcaaacaaggccccgctgagatggcttagacggtgggggcagaacctgctgggtctaaccgagcatctcccactccctcagcttccttacaacatggcaaccacagagcagttgggcttattctatggaggtttagggctccaacaaggtcaagccaggggctgtctttcctgttcatgctgaactcagaaaaagcagtgccttccttccactgtaccccactggtcaacacaaacacaggccagcccagacccaaggtgaagggagacagttcccttgcaatggaagtgtcaaaagatttgccaccatctttcatctgccacacatgcatacaaatagatggcacgttctggctcccttgcaatgaggtgtggccatggggctgagcttcatctcataaaagtgatagggccagtacgcttccttgcagaattctatttatttatttatttatttatttatttatttttgagacaaggtgtcactctgtcactcaggctggagtgcagtggcatgattatggctccctgcagcttccacccgccaaactgaagccatcatctcacctcagcctctatgaactcctgggctcaagccatatactcacctcagcctcctgaagtgctgggattacaagtttgcctctgtcctcccaacacttaccacatcccctttcctcactaaaccacattggccttctttgtatccttcaaacagacctgatagaagatctttgttcttctatctgcctggtggactcttcccccaaggaagggcaaatgggggcctgttttgtgggttctagacatttctcagctcccattcccctctcctctgaagcttccccaaatctaagggagtcgctcctccactaccatcgtggcgcctttttaggctcccatgcagcactaatctctctgtgacattgtctcgttttacctctttcctggttcattgtctctccagctcccctccctcagccgccaactagattttaagctccatgaaagcagaattggaaactgtgttctttcccgcaccttccacagtgcctggcatatcacaagagctggacaaatatttattgaatgaataaaggttatgcaaatttatctgcgctcaaatgtcttctttggtttcctgaaatggatactcctgacccctagcattgtgtataaacaatagaggttacaatatccacatcatatagtcgtaagagttaaacacactcttgcctgtaaaagtcttgcaccaatgaggtactcacgaatgctggcagccctgctgcagcccgtcctctgtcagcactggaggttttgtgtgtatgttgctttgtcacttctctgagagcaactttgcctgctgaggcttttcctctgattattcaattttcttcccaatttattcaaagccacctgaatggtaaaggctggtcccagaggtgtataagcccctcatgcgtatttgaaatttgtccagcctcatctcccaggctttggtacctctgtgaattgccagtctgacaaagaagtcctccagatgaagcacattctctctctgtctctctgttttcactcaatgcacttcaacaaaatatttgctctcttttccaggagcttccttagtctgaagtgattggaaagaaggttgttctagcatctactgcttctagagagagtcaatatttaggctagacgaaaacaaaatacaacaacgcagccacaatgcacccactgctctggggagagggaacatcgctttgctggaccgaaacattctggtgctggagagaggcaagtcgctggcaggaactttaaggcctgaagcagcccaggacctgcagtcaaagtcttggcctgatttttaaaaagggaaaaaaggccgagcacgggggctcacacctgtcatcccagcactctgggaggctgaggcgggcagatcacttgaggtcaggagttcaagaccagcctggccaacatggtgaaactccatccctgaaaaaaattagccgggtgtggtggtgagtgcctgtagtcccagcaacatgcgggtctgtccatgttgcccaggcttgcttcgattaaaagcacgagccactgtgcccaccttagatatatttctatacagcttcagttaggccagtggcctgtgatcccaggatgtgggagaattgcttgagcccaggagttcaagaccagcctggcaacatggagagacccccgtctctacaaaaattttttttaaaaagtagctgggcactgtaatcccagctactcgggaagctgaggcaggagaatggcgtgaacctgggaggcggagcttgcagtgagccgagattgcaccactgcactccagcctgggcgacagagcaagactccgtctcaaaaaaaaaaaaaaaaaatagctgggcatggcagcgtgcacctgtagtcccagctactcaggaggctgagtcaagaggattgtcagagcccagtagttcaaggttgcagtgagccatgattgcaccactttaccccagcctgggtgagaaagagaccctgtctcaaaaaataaaatgtttcagttagataggaggataggaggaataagttcaagagatctgctgtacaacatgtgactagagttaacaatgtattatattcttgaaaactactgagagattttgtgttctcaccacaaaaatgctaagtacgtgaagtcaaggtcatgcatatgttaattgcccaatttgccagtgactgaagactccgattccatttcacaatgtttacatatttcaaaacatcatgttgttacacaataactatatacaatgtttgttctttgaaattaattatgttacaaacccttacagaggagatcttagttggtttgattgaggtgcatacacggttcataattgtgtccaatcgagttgcaatggtctagcaagtaaaagctgtgacagaccgacttctaaggtggaccgcaatggctcccactccccgtgtccacacccttgtaccattcactcctcttgattatgggctggatggagtgacttgcttctaataatcaaatctagcaaaagtgatgggatatgacttctgaagtcggttacagtcagtctctggcttccatgttgcacaggctctctcactacttcttggggtatctctttccaatctctcgctctggggaaagcaagccgccatgttgtgaataccctatggaggagtcggagtcttcagtcaccggccagcgagactgtgtgtcctaccaacagctctgtgagtgagcttgaaagcggatcctccccgccactgaacctggtggcagactcagccaacaacatctcgattgccacctatgagagacgctaagccagagaacccagctgagctctctggattcctgacccacagaaactgtgatataatgaatgcctattgttttaagctgctaaatttgggagtaatttgttacacaataatagataacaaatagaaagctctagccataaaagatatatttctcttctaaagatatatatatattttaaaacaatattttactttattaatagagatgaggcctcactatgttgcccaggctgatcacaaactcctaggctcaagtgatcttcctgccttggcctcccaaagtgctgggattacaagcatgagccactgtggccagcttagatatatttctatacacgcagaataagtgggccgcaaaatgtttcaataaagttgaggtggatacaaaaaaattgtcaaaacagtgatcagtttctgtttggtgctatgattcaatcaggtttgagaagtatttgagtctttgaagagctactttgtaaatccacctaagtgtcctacaatgatagagaactgttttgtaaaagcttgagattagaattgcattctgctcacaatcagatggaaatctttcatcagagtattcagacaatgacacatcacaaaccttagctttttggagcttttagcaaataacaatccttgagaaaaaaaaaaaaaagctgcaaagcaaaaaaacattgaattttatccctgtggaaggacgggaggaacaaaacaaattgaatgataagagtgtaaaactgcagcgagatctcattttgaaatcatgggattgtgttttgaaatatcctgacctggaggaagaatcttttgaaagagttcctatatttaattagataaatttctattctgtgtcagaatgaagtataaatgagaaagcttaccattcagaagctggatctaaatttggtaaaatgtatcaagaaaccttaaatagaggtaatttgtttgataggttttgtattgtaaaaatatttgtccgagaaaggttccctgaatagaggcaaaaagaagtttgcctgtgaaaatatttgggctgaatattttattattaatttaaatattttaaaagttagtgaaagaaattttatgtagcagctcttgttctgagcttatattagacagattacattgaaaaaatgtattctctagaaaaataacactggtatagtattagagacacgcatgactcagaaaataatgaaagagtgtgaatctgcagtaagcataattagtcagcttatgttattttattatttctttatttaaagacagggagggcctcattctgttgcccaggctggagtgcagtggagcgatcttggctcactgcagcctccacctcctgggttcaagtgattctcctacctcagcctcctgagtagctggaattacaggcatatgccaccaaactcagctaatttttgtatctttagtacagatggagtttcaccatgttgaccaggctggtctcgaattcctgacctcaagtgatctgcctgcctcagcctcccaaagtgctgggattacaggcatgagccaccatgcctggtgtgttattttaaattaatactaaaaatatattttttttgagactgagtcttgctctgtcatccaggctggagtgcagtgggaccatctcagctcactgcaacctctgcctcctggattcaagtgattctcctgcttcagcctcctgagtagctgggattacaggcacaatttaccatgcctggctaatttttgtattatcagtacagatggggtttcaccatgttggccaggctggtcttgaactcttgatctcaagtgatccacccgcctcggcctcccaaagtgctgggattataggtgtgagccaccatgccaggccaaagtattttagttaacataaagaatttaacattcttttccataatgtacacaggtatgatttttttagaatagtttttcaaacattatgttttttaaaacagtttttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccaaaaagtagtggaaccatagatgtgaccaccatgtgggctattttttgtattttagtagaagtggggtctcactatgtgtacaggctggcatgagtcctgggctaaagcagtcaactcaacttcacgcctccccagagtaggaattacaggcgtgagccactatacctggccaagccaccattttttaattgggagctttcatatagaagttggaatttctgatatctgttaaaaaatgagagatctgattaaatgaagccaccatcctgtggctgactgaagctgggaagcagctgcctgcttaagatgaaatctgaatgtgccatttcacacagtgcttgaaggctcacttcaattccttgataacctcgatctgtattcttgtgtttagaaaaaatttgaagtttatttttacgtaaattaagttcagaagaaggtggcccaagcctaatatagtggctgtaccatcaccaggaacccagactttcctctgtctactccatcatgctagtgtttagcttctagtctcaagatcaccttatcaaggaattgataaggagtaggactgctacagctccacccatcacatcaacattccaggcagcaggaaggaaggaaaggcaaaagtggtgcactccagatggtgtattttattttaaagtgtcttcctaaaaatgcaaacagccctatgcctttattgtgttggccacgtggccatttcttgcatccaaggaggctaagacatgcggtctattaactgggtacactgccacctaaatacaatcgtggttactaaagaaaagtggcagaataggtttgcagtaagtcacctctgccatagcaatctaaattaatagattaaaagaggaaatggcagaggcatttgaatcagagcaactccctcttgaataggggctgggtaaaatgaggctgagacccgctgggctgcctcccaggaggttaaggcattctaagtgacaggatgagataggaggtcggtacaagatacaggccacaaagatcttgctgataaaacagtttgcagtaaagaagccggccaaaacccaccaaaaccaagatggcaatgaaagtgacctctggttgtcctcaactgctacactctcactagcgccatgacagtttaggaatgccatggcaacgtcaggaagttaccctatatggtctaaacaggggaggcatgaataatccaccccttgtttagcatatcatcaagaaatcaccataaaaatgggcaaccagcagccctcgggctgctctgtctatggaatagccattctttattcctttactttcttaataaacttgctttccctttactgtatggactcgccctgaattctttcttgtgtgagatccaagaaccttctcttggggtctgaaataggacccctttccggtaacagaaatacatatgaccctctcaatgggtggaataagaacattcagtaggattcaacactcattcttgatgatacaaaagaagtaataaaagtaagaagaaagaaaggaacaaaggaaggaaggagggatggggagggaggcagggatgaaaggaaggaaggaattcagtaatataagaaactacgaagaactttaaaaactctgttttttaaaatcttgcaggtaaaaattgcctgactctgtgattatctcttttctagtctctctacagcttatgagtggttgaaccagattcagaactgctctccagaggacttttggaaatttggggatggagaaggaaatttgttgtcagaatgattaaggaatgtcgtcaatatttcacaactaggcccagaagttttaacaccttgcaacgtataggacatccctgcctaaagaaaaaatgcttttccccaaatgccagtagatacctgtattagtcagggttctccaaggaaacagaactaatgggaaattcatattcgtaaatggagatttattatgaggcattggctcatgtaatcatgaaggctgagaagaaccctgatctgctgtctgccatacggagaaccaggaaagctggtggtgtaattcagttccagtctgaaggcctgagcaatggtgtaaatcccagtttgagggaggagggggaatggtgggggtggttgctgagaagatgacatgaaatgtgcccgctcaagcagtgaggcagtggggaaaatggaggggggtggggaagggggggcaaattcctctttcctcctcctttttttcttgagaacagggtcttactctgtcccccaggttggagtgcagtggtaggatctccgctcactgcaaactccgcctcctgggttcaagcaattctcttgcctcagcctcctgagtagctgggataacaggcacacaccactatacccagataatttttcatttttagtagacacggggcttcgccattttggccagggcagtctcgaactcctgacctcaagtgatccgcagaccctcctcgcctcccaagtgctgggattacaggcgtgagccaccgcacccagcctcctccacctttttcgctctactcagaccttcaacagattggatgaagcccagccacaccggggagcgcacttgctcaactcagttcacggacgcaaatctcatctggaaacacctgcccaggtccaccttgaaactacgtccaatgtgggcccctgatatgggtttggatctgtgtcctcgcccaaatctcatgtgaaattgtagcccccagtgttggaggtggggcctggtgggaggtggctggatcatgggggtggatttctcatgagtggtttagtgccatccccttcgttctgtcttcatgagagtaagcaagttctcaccagctctggtagtttacaagtgtgaactcgccgcactctcttgctcctgctcccaccatgtgagacgcctcactgcccatctgccttctgccatgattggaagcttcctgaggcctccccagaagcagaagctgcagtgcttcctgtacagcctgcagaatcgcaagccaattcaacctcttttctttaaaaactacccagtcttaggtattttttttcttttcttttttttttttttccttttgagacaagatctcactcagatgcccaggctggaatgcagtggtacagtctcagctcactgcaacctccacctcctgggttcaagcgattctcctgcctcagcgtcctgagtagctgtgccaccatgccctgctaatttttgtatttttagtagagatcacatttcactgtgttggccaggctggtctcgaactcccgcctcagcctcccaaagtgctgagattacaggcgtgagccacggcacacagctttcaggtatttctggtttttttgtttgtttgtttgtttgtttgtttttgagatgaggtctcgttttgtcgcacagtctggaatgcagtggtgtgatctcggctcactgcagcctccgcctcccaggtacaagtgattctcctgcctcagcctcccaagtagctgggattacaggcgtgcaccaccacacccagctaatttagtatttttagtagagacaggattttttttttttttttttttttgagacggagtctcactctgtcgcccatgctggactgcagtggcgcgatctcggctcactgcaagctctgcctcccaggttcacaccattctcctgcctcaacctccggagcaggggggactacaggcacccgccaccacgcccagctcattttttgtatttttaataaaaaagggggttcgccgtgttagccaggatgatctctatctcctgacctcgtgatccgcccatctcagcctcccaaagtgctgggactacaggcacccaccaccacgtctggctattttttaaatattttagtacagacggggtttcaccatgttagccaggatgtctcaatctcctgacctcgtgatccatccacctcggcctcccagagtgcttggattacaggcgtgagccactgtgtccggccacttttttgttttctaaaatggaagtagttcttcaccgctgggcatggcctccttcttctccacactgacctttccctccctcaaggcttcctggggctgcaaagcaaagaaccacgaacttctctgtggcctaagccacggaagctctggaagacagatgtctgggctcccggtgtcacagagtggcccttcctccggctccggaggacagacgtccgggctcacggtgtcacagagtggcccttcctccggctccggaggacagacgtccgggctcacggtgtcacaagtggcccttcctccggctccagaggacagacgtccggctcacggtgtcacagagtggcccttcctccggctctggaggacagacgtccgggctcacggtgtcacaagtggcccttcctccggctccggaggacagacgtccggctcacggtgtcacagagtggcccttcctccggctctggaggacagacgtccgggctcgcggtgtcacagaggggcccttcctccggctctggaggacagacgtccgggctcgcggtgtcacagaggggcccttcctccggctctggaggacagacgtccgggctcgcggtgtcagcagagggtcccttcctccggctctggaggacagacgtccgggctcgcggtgtcagcagaggggcccttcctccggctctggaggacagacgtccgggctcgcggtgtcagcagagtggcccttcctccgcctctggaggacagacgtccgagctcgcggtgtcagcagagtggcccttcctccgcctctggaggacagacgtccgggctcgcggtgtcagcagagtggcccttcctccgcctctggaggacagacgtccgggctcgcggtgtcagcagagtggcccttcctccggctctggaggacagacgtccgggctcgcggtgtcagcagagtggcccttcctccggctctggaggacagacgtccgggctcgcggtgtcacagaggggcccttcctccggctctggaggacagacgtccgggctcgcggtgtcacagaggggcccttcctccggctctggaggacagacgtccgggctcgcggtgtcagcagaggggcccttcctccggctctggaggacagacgtccgggctcgcggtgtcagcagagtggcccttcctccggctctggaggacacacgtccgggctcgtggtgtcacagagtggcccttcctctgcctctggaggacagacgtccgggatcgcggtgtcacagagtggcccttcctccgcctctggaggacagacgtccgggatcccggtgtcagcagagtggcccttcctccggctctggaggacagacgtccgggctcgcggtgtcacagaggggcccttcctccggctctggaggacagacgtccgggctcacggtgtcagcagaggggcccttcctccggctctggaggacagacgtccgggatcgcggtgtcagcagagtggcccttcctccggctctggaggacagacgtccgggctcgctgtgtcacagagtggcccttcctccggctctggaggacagacgtccgggctcccggtgtcagcagagtggcccttcctccgcctctggaggacagatgtccgggctcacggtgtcacagagtggcccttcctccggctctggaggacagacttccgggctcgcggtgtcacagagtggcccttcctccggctctggaagacagacgtccgggctcacggtgtcagcagagtggcccttcctccggctctggaggacagacgtctgggctcgcggtgtcacagagtggcccttcctccggctctggagcacagacgtctgggatcgcagtgtcagcagagtggcccttcctccggctctggaggacagacgtccgggctcgcggtgtcacagagtggcccttcctccggctctggaggacagacgtccgggctcgcggtgtcacagagtggcccttcctccggctctggaggacagacgtccgggatcgcggtgtcagcagagtggcccttcctccggctctggaggacagacgtccgggctcgcggtgtcacagagtggcccttcctccggctctggaggacagacgtccgggatcgcggtgtcagcagagtggcccttcctccggctctggaggacagacgtccgggctcgcggtgtcacagagtggcccttcctccggctctggaggacagacgtccgggctcgcggtgtcagcagagtggcccttcctccggctctggaggacagacgtccgggctcgcggtgtcacagagtggcccttcctccggctctggaggacagacgtccgggctcgcggtgtcagcagagtggcccttcctccagctctggaggacagaagtctgggctcgcggtgtcacagagtggcccttcctccggctctggaggacagaagtctgggctcgcggtgtcagcagagtggcccttcctccggctctggaggacagacgtctgggctcgcggtgtcacagagtggcccttcctccggctctggaagacagacatctgggatcacggtgtcagcagagtggcccttcctctggctctggaggacagacgtctgggatcacggtgtcagtagaggggcccttcctctggagcctctagtggggaacctgttagttgcatcttttggcttctggtggctggtgtttcttttttcttttttcatctttttttttttttaatttaattagagacagggtctgcctgtgtagcccaggctggtctcaaactcctggcctcaagcagtcctcctgctctgtcctcacaaagtgctgtggttacaggcgtgagtcatggggcccagcctgttggtgtttcctgacttgtggccccatcactgcagtctctgccttcagggtcacatggccttctcctctgctggagcatcccctcctgtaagtttcttttttttttttttttttttgagatggagcctagctctgtcacccaggctggaatgctgtggcgggatcttggctcactgcaacctccacctccagggttcaagcaactctcgtgcctcagccccccaagtagctgggactaccagtgagcaccactacacctggctaatttttgtatttttagtagagatgaggtttcaccatgttggccaggctgatctcaaactcctaaccttaggtgatctgcttgcttcagcctctcaaaatgctgggattacaggcgtgggccagcacgcccagcctcctgtaagtttattgtaaaggcactcatcatgtgatttcgggcatgctgggcaatctaggatgatttcctcatcttaagatccctattttagttacaacaaaaatcactttttctcataatgtcactgttgtggtttgaatgatggtgtcctctctaaaactgatgctgaaactgaatcctcaatgcaacagcattaagaggtggggcctttaggtggtgattaggctattagagctctgccctcatggatatggttagtgtcttatcaaatgtcttcgggggtgagttcattccttctacctcctctgctatggaggatgcagcgttcatcccctcaaaggtcttcgggggtgagctcattccttctacctcctctgctatggaggacacagtgttcctcccctctggaagatgctgcaataaggcaacattgtggaagcagagagcagcctcacctgcccccaggtctgctgctgccttgatcttgaacttcccagcctctagaactgtgagaaataaattcccattgtttgaaaatcacccagtctacggtattttgttacagcagcacacatggactgagcacatccgatttacaggttctggggattacagtatgtacatttctttcttggggccacccttcagaccaccacaaaatccctcttcaaagatgactgcattttgttgttgttgttgttgtttgttttgtttgtttgttttttgagatgacatcttgctcagtcacccagtctggagcgcagtggtgcaatcttggctcactgcaactgtgcctcctagtttcaagcaattctcctgcctcagctccccaggtagctgggactacaggtgcgcaccaccagacccggctaatttttgtatttttagtagagatgaggtgtcgctatattggccaggctagtctcgaactcctggcctcaagtgatccacccaccttccttggcctcccaaggtgctgggattacagggatgaatcgccacgcccagccacatcactgcattgatgaaggcccccaatcgcctcatctgggactattcttcaccttccctaaccctgaggctctttggccctgtctgctgtcctgatcccgttctgcatttagccacggagcagtcagccccttcccctcaactggatagtgacctcctcgacagccaagtcatttgtgcctataacctcggcttgcctgggacagtgacatgcctgggtaaaggcagtcaatcaatgtttgttgagtttcatcaaatctttaaatgtgcactgttacaagattttattcctataagaatgtatttctgacttttttgagatggcgtctcactctctcacccaggctggagtgcaatggctcgatctcggctctctgcaacctccccctcccaggttcaagcgattctcctgcctcagcctcccaagtagctgggattacaggcacatgccaccgtgcacagctaattttttgtatttttagtagagatgaggtgttaccatgttggccaggctggtctcaaagtcctgacctcaagtgatccacctgtctcagcctctcaaagtgctgggattacaggtgtgagccactgcgcctggcccatttctgactttttaatgggagtcagtgttacaaggggatttgctgaactgaaattcacttatatttggttgttctggaatacacctgttccacaaggtaagatattctcacatctcctttgggacccattactttacacattcatggcttcagtttacccatttgtaaaacaagaaaaaacgataaacaatatcatagttaattagttcttttgatggagtcttttatgattctctcaagtaggtaacataaaagggtacaaatgcaatgtgttattatgggataatgtagaaataattaccgaggaggagagcagtagaacagaaaaagttgtagacatctctcataagatttctccagatgcttctaacataagggtcttacaataaatgtaaagcaaaacctgtttttttctttgatcatagtgtttgctcagactatttttccagttcctagcaccagggaaaataaaactttattatctaccctgtacaaaaatgatagcattttcaagagaaagcatggtgggcatactgactttagaagtggctctgtgacaaaaatcaacacaacttctctccttttttcctttagagcattaacaggaaaggcactctgtttctttgtttctatcagagtttttagtttttgtaccatcatttctccccatggtacagcaaactatgaatgctgtgtgtgtgtgtgtgtgtgtgagagagagagagagagtgagagagagagagagagagagagagagagagaaagagagagacagagagagacacacagagagacagagacagggacaagagacagagaggggtaagaagagagggagagagagagagagggagagagagatacaggagacagacaatgacagagagacagagagggggaaagagagggagggtgagagatggagagagagatagagatagagagagagaagaggaaaaagagagggaggaaagagaaatccgcatttgaataaagcaggtgcatgtggaattgtggtttctttgccctagttatgtttccttttcctgacttttattaatagcacttgaaagtgaccaactgcaaaaaaaaaaaaattctgttattctggaagtatctagttcctgcgagggttgtttaatgaacatgacgaagtcagtcaaccagaataagtggtttcttccctttgagcttttggcaagaagtcggggtttcaattcccactgctgttctgatgacagtgcagacccaattcttaactttgcagcacaaagccgctcatcccaaagacggtcgtccctgcaaaggagacagtgagcttaacagtgcatggcacagccgtaaggatcagaggtttactcaagggatgatgggctgcatttgaacagctttcagtagcaacctgttgtgggcagagactcgtatttattcttttaacattttaacttatttttattaaataataagatatgtttaagaaattcagataagcaaaaaacaattgtaaaaatcacaaggttgggtgcagtggctgacgcctgtattcccagcaatttgggaggctgaggtgggcggatcacctgaggttaggagtttaagaccagcctgaacatagggaaaccccgtctctactaaaaatacaaaattacctggatgtggtggtgcatgcctgtaatcccagctacttgggaagctgaggcaggagaatcatttgaacccaggaggcggaggctgcagtgagccgagatcatgccattgcactgcactctagcctgggcgacaagagcaaaactccattaaaaaaaaaaactcacacaatttcgtttccctgagataactactatgaatattttggcatcaagtttttcctgacttgacatacaatcatcgtaatagtccactttactgggtgtgcaccgggagcctaatatttttctaagcactgttcagtgtccttcaatgaatcctcccgaatcctaaactctggggactgttctcaccatttcacagtcgaagagctggagacacaggaaggtgcgatgcctcccagaggtaatacaagcagtggaaacgctacagtgcttcttcagcggggctgtatggacacagcaggtaatacaggcagtggaaatgctacggtgtttccttggctctgctgtatggacacagtaggtaatacaggcagtggaaacgctacggtgtttccttggctctgctgtatggacacagtaggtaatacaggcagtggaaatgctacggtgtttccttggctctgctgtatggacacagcaggtaatacaggcggtggaaacgctacggtgtttccttggctctgctgtatggacacagtattcttgtcagctcttgttctgttttgtttgtgtttttcatttttgctacaagaaatagaaacaccctgtacattttggtattatgctctttattacttaataattgtggtaggcaaaattctaacagggcccgctagagttcccaacaatggtgtacacacacacctcctcccaaatccatcacatgtcagtccaggggctggcagggagagaacttgcagatgagacttgaatccccaaatgggttgaccttaaaataggaaggttacgcaggatgagcctcacttaataattgtcttcttgaaaggactgagcatttcctcaggtcagaaagattcaaagggtgacttgatgtcagggagattctctactgctcctccaaagatgaagaggacagcgtgatgagggaggcaggccgactccaggaactgagagcggcccccagccatcaggcagcaaggaaatggcccttcaacccatctcctcgaggaactaccttctaccacaaccacatgagcacgaaagagagccctgacctcccgatgagatctcagctggccaacactttgattgcagctttgtgagaccctggacagagaggccagccatatcaacgcctagacttccagcctcctgaagcctgtgaactcatcagtgggcattgttttaagctgctaaagtagtggttatttgctacgcagcaatagaaaatgaatacaataatatgtcatgaacacttttccaactcataatcctacctctgcagtatcatttgaataacgacgtagcattccagtatatgcatacactagaactgatttgatctctgccttgttgttgtacgtctttgccatttccaatcattttgtgatttttatgcaacattgtaatgaacattttattggtaagtctgggcacacattctttaatttctagaagtggaattgcacattcaaagtgtaagccagtaagtttttgatacaagtgactaattgccctccagaagagctgtgccggtttactttccgttggtcatttatgagcatatttatttcccagaacatagccaacacgggctatttttcaggtcaagtgacaaaccatgtctcctctttttgcattttaaaattattggtgtaatttgccttttttttttcatgaaaggcatctgtatttttttctgtgagtgtgtatgcttatattggttcaaactgtttttaaaatttttaaattttttatttttaacttgtatggtacatagtaggtatacatatttaaggggcatgtgaaatattttgatacaggcaagcaatgtgtagtaattacatgagggtaaatggggtctccatcaccttaggcatttatcatttctttgtgttattaacaatccaattatactcttttaattattttaaaatgtaaaataaattgttgtttattgctgtgctatcaaatactagatttgttcatgagttattttcttttcttttcatttcttttcttttttgagacggagtctcactctgtctcccagactggagtatagtggctcgatctcggctcactgcaacttctgcctcctgggtttaagtgattctcctgccacagcctcctgagtagccgggattgcaggcccctgccaccatgcccggataatttttctattttcagtagagacggggtttcaccatgttagccaggctggtctcaaactcctgacctcaggtgacccacctgcctcggcctcccacagtgctgggattacaggtgtgagccatcctgcccagccagattcctttattatcatacactgagatttttcttttttgcttttatttttctttattttattttttttgagactgagtctcgctctgtcacccaggctagagtgcagtggcatgatctcggctcactgccagctccacttcttgggttcaagccattctcctgcctcagcctccccagtagctgggactacaggtgcccgccaccacgcccagctaatttttttttgtatttttagtagagacgggggtttcaccgtgttagccaggatggtctcatctcctgacctcatgatccacctgcctcggcctcccaaagtgctgggattacaggcgtgagccaccgcgcccggcctatttctttatttttttaattaattattatttttcttttgagatggagtctcactctgtttcccagactggagtacagtggcacaatcttggctcactactacctctatctcccaggctcaagcaattctcctgcctcagcctcctaagtagctgggactacagatgcctgccaccctgctgtgcaatcaaatactagatcatattcattctatctaactatatttttgtacccattaaccatctccattccttcctttccccctactacccttcccagcctttggtaaccatctttctactgtctatctccatgagttcaattgttttaatttgtagcccccacgaatgagtgagaacatgcaaagtttatctttctgtgtctgtcttatttcacttaatataatgtcctccagttctatccatgttgttgcaaatgacaagatatcattctttttatggctgaacagtactccagtgtgtatatgtaccacattatctttatacattcatttgttgatggacacttaggttgattccaaatcttggctattgtgagcagtgctgcaatagatatgggagtgcaaatatctcttcgatatactgattgtctttcatttggctatatatctagcagtgggattgctggattatatgatagctctatttttagttttgggaggaacctccaaactgttctccacactggctgtacgtatctacattcccaccaatgacatacaagggtttcttttcctccacattctcaccagcatttgttattgcctgacttttggataaaagaaatttttttttcaagaaggagtctcactctgtcacccaggctggaatacagtggcgtgatctcagctcactgcaacctccacctcccgggttcaagcgattctcctgcctcagcctcctgagtagctgggactacaggcgtgctccaccacacccagctaattttttttttttttttttagtagagacggagtttcaccatattggctgccgagaccagcttggttggggagaccctaacccagcagcactagaggaattaaagacacacacacaggcatgtagaggtgtgaagtgggaaatcaggggtctcacagccttcagagctgagagcctcgaacagacatttacccacgtatttattaacagcaagccagccattagcattgtttctatagatattaaattcactaaaagtatcccttatgggaaacgaagggatgggccgaattaaaggaataggttaggctagttgactgcagcaggagcacgttcttaaggcacagatcgctcatcctattgtttgtggcttaagaatgcctttaagcggttttctgccctgggcgggccaggttttccttgccctcattcccataaacccacaaccttccagcgtgggcgttagggccattgagaacatgttacagtgctgcagagattttgtttatggccagttttggggccagtttatggccagattttggggggcttgttcccaacaattggccaggctgctctcgaactcctgacctcgtgatctacccacctcggcctcccaaagtgctgtgattacaggtgtgagccactgcgctggccaagatgaaagccattttaactagggtgagatgatatctcattgtagttttgttttgtttgagacagggtctcactctgtcgcccaggctggagtgcagtggcacgatctcaactcactacaacctcggtctcccaggttcaatcgatcctcccacctcagccacctgagtggctaaaatgacaggcgcctgccaccacggccagctaatttttgtatttttagtagagacggggtttcgccatgttggccaggctggtctcaaactcctgacctcaagtgatctggctgcatccgcctcccaaagtgccaggattacaggcatgagctaccacacccggcctcattgtagttttgatttgcagttctctgaggatcgatgatgttgggcacctttttgtaacctcttcgccatttgtgtgtcttctcttgagaagtgtctattcagatcttttgcccattttaaaaatgggattattagaatttttcctattgagtcatttgcgttgtttatatattctggttattaatctcttgtcagatgggtggtttgtaaatattttctcccattctgtgggttgtctcttcactttgttgattgtttccttttctgggaagaaggcttttaatttgatgtcatcccatgtgtctatttttgctttggttgcctttgcctgtggtggagttttactcaagaaatcgttgccctgaccaatgtcctggagcgttccccccacttttggtatttgttctgttttgtttttgagacagagtctccctctgtcccctagattggagtgcagtggtgcgatcttggttcactgcagtctctgcctccagggttcaagagattctcttgcctaaacctccggagtagctgggattacaggcacccgccaccatggccagctaatttttgtattagtagagatggggtttcaccatgttggccaggctggtctcgaacttctgacctcaagtgattcgcccgcctcagcctcccaaagtgctgggattataggcatgagccaccacacctggcctgtcctgtcttttcttttctttttttttgagatggagtttcgctcttgttgcccaggctggagtacaatggtgtgatctcggttcaccgcaacctctgcctcccgggtccaagcgattctcttgcctcagcctcccaagcagctgggattacaggcatgcgccaccacgcccggctaattttgtatttttagtagagacgaggtttctccatgttggtcaggctggtcttgaactcccgaacttaggtgatgtgccgcctcagcctcccatactgctgggattacaggcgtaagccaccgcgcctggccctccccagtgttttcttgtcatagcttcagagttttaggtcttagatttaagtctttaatccattttgatttgatttttgtacaaagctggttgggactttttctattgcaattgacagaatgtcacatttgcttaaccaaaaggagaatttatggactcacaattaaaatgtctaattttaaagaaaaagctacttttagctatgatcagaaccaagatctataaacagtccttttttctttttttttttttcttttgctctgttgtccaggttggagcacactggcaccatctcagctcactgcaacctttacctcccgggttcaagcgattctcctgcttcagcctctcaagtggttgagactacaggcagaccccacaattagcctggctaatttttgtattttagtagagacggggtttcaccatgttggctaggttggtcttgaactcctgacctcaggtgatccccacctgcctcagcctccaaaattctgggatttaaactgtctttttcaaacaagtgtctctctcatctctatctccttctgggatgcttacttctctggtttcacaagatggcctctggcaactccaagcttatatttccatgatctcaaactcaacagaaaagagaatcacttcttcctgctcattcgagagtaaattctgggattagctttgaccaactaggatcacatgtccatctgtgaatcaatactttatttttgtttattcatttatttttttgagacagaatctcactctgttgcccaggctggagtgcagtggcatgaactcggcttactgcaacctccgcctccagcgttcaagcgattctcctgcctcagtctctcaggtagctgggattacaggcgcgtgccaccgtggccggctaatttttatatttttagtagagacggggttttaccatgttggccacgctggtctcgaactcctgacctcaggtgatctgcctgcctcggcctccgaaagtgctgggattacaagcgtgagccaccgtgcccggcctgaaccaagtactttagctcaatagatgggatactgctaattggataggcataggtcaactgcccactcttggactggaggggtcaagccgccagacctaaatcacagccgccagacctaaatcacagcgagcattgattagttaaggaaaatcaaggtgcagttaccagaagggagaatggatgctgaataggacccaacaatagctatcctctaaagagcctggccactcactgtgccaattttatgtgttgggtgtttatcctttgataatattctttctttatttatttatttatttatttatttatatttatttatttatttattttgagacggagtcttgctctgtcacccaggctggagtgcagtggcacaatctcagctcactgcaagctccacctcccaggttcacgccattctcctgcctcagcctcctgagttgttgggactacaggcacccgccaccatgcccggctattttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaacttcccaggtgacttctactcacaggtaagttttagaaccaatgttataaagctccatgccttactgagctacatgcaagtaccatgaggcaccccacaaatatgcttaggccccaaagagagacatttgttcagtgaggccaagtcaccacccacaccaattgtatctggtctcctgagaatcagagatctcagtaaacttgaagcaaagaggaaattatagactaaagataaaaccacatgctatttttagattagacaggctatcaatggaatcggagaaattctgataagggtgggatttccaaaaggctcaaaaatcactgacttcctggactcaaacaaaagcactgaggtaataacgcaacatctaggcttatggagttcacgaggctacttcaatggagcccaagcggtgggaacaggtcatttgggggcagacacaccagaagccttctctgcccacctggatttttacgtctaaataagatactgtgcaaatgaaccctgtactagacagagacatttctagtgagtttcatttcataaatttatttttaacaaacttatgagaggctgatactggatctcataaaaagactctcttgctgtcttaaaaacttctactgtctcattcttaagtcacaggttatgaaagagttagaaaattcttattctaataatagatctagtttctggatccatagaacaatctgctctactgaataacacattctcaatggggccaaaacaaccaattacggttgggcatggtggctcaggtctggaatcccagcactttgggaagccagggcaggcagaccgcttgggtctaggagtttgagagcagcctgggaacacagacagacccccatctctacaaaaaattacaaacatcagccaggtgcggtggtgtgcgcctacagtcccagctacctgcgagactgaggtgggaggatcccttgaactggggaggaggtggcagtgagctgtgatggcaccactgcactcctgcctaagcgacagaggccctgtctcaaaagaaaaaaaaagatatggtatgtaataagcacatgcatctttttagcagtcatatatttgatatggtattttaaactctattttttaaagattaaatcagaggagtaaaatttatagttaaaattgtgtgttcctctctaaaggaaatagagcaaaagaaaaaaaattgtgtgctcctcaaaaagagatttgtttgaagtccaaatgattaagcatggccactatggtggcaggtaattaattatatatagtaacaccacttcaaacgaaaaatctaaatttaaaagaaaatcacttattctcaagagtttaaacttttctcttatctattacaatactgaacagaggtcctagaccaaatgcagacatctctactgaataaagagtttgaggtgagaacttcacagacatctaagacacttcttcactaggacacaatgcatttaaatattgctcaacagtggacaccaattctcatgctatactagacatggaccaggaagaaaaatgaaaaatgtgagcagagaaatggttactgagaaaacaaaactagaagtgcgaaaaaataacaaacaaaaagtaattttttgacaagcataaaagaggccagtaaacatagtatataaacttaatagaggcacaaatgatttcctaactgaaatgtactcggaccttcccattacccacagtgacactgcacacaccttcccacggtctcactcgggccttcccgttacccacagtgacactgcacatatcttcccacagtctcagacttatgtcctcttcagatgaagcatgaaaatatcagcatttgattactctgggaaaatcctaaccttaaaatgccattcatcctcatttcctgtgtaattgtggtggtcaatttattccaactccaagagtaatccatcaaaattactttataagccaaaattactaagccctaaataaccacacagcaggcatttctgtaccaagggaacctggctgctgtgaagggacatcacatgcttcccagcccctggcgagcaggccacaacctcctgcccatcgtttgcatgacatcactgtgtgagctgcagctacgtgccctaccaagggtaaacaaggttttcacatgactggccaaaagataccaccaaaatcaatttggagaagaaaagctaaaagaatagaattgtgtacagcataccaaacagttggctgacagaagaattccttaaaatggggtgtcagtttttcctctagaaaaaaaaaaaatgcatcatttgctcttttcatctgtaacataagattttcgtctttcaggtcactatttcaaataatccatccaccaagaacgattgtgacctttgaaaaaggtgaaacactgggggaagatacggcctgacatgatttacacgaacatacgtctcccttggactcacagctcacacatcctctttcagaagccaactaggcctccttctcaaagctatgcagcctcaccccattgtctctcctatcagaatgtttcccagaggctctacctgggagatgaagaggtaagtgacaaagaaccataaaaagcaccttaaaaatacaaacaggtttcctctaaatgaaaaggaccaaaccaggacaaattaaccctcgcctggggcacaacagagtgtacttcaggcctgcacacctcagggtccccagccaggcctcctgccatgaagcagccgcacctggagggggacctgccacctggtcacgggcaagcaccctggcataagggtacttttcccttcaaatgttttttcactatgattcacataccataaaattcacccttcaaaagtgtacaattcagtagtgtctagtatattcagagatgtacagccatcactgccatccaagtccacattctcatcacaccaacaggaactcctgttccctttaagtcagtcccacgcccctctcctggcccgtggcaacccttaatctacttccagtctctgtggactcgcctcttccgggcattccacatcaatggaatcacacaactggggccttatgtgtctggcttccttcatgcagccgaatgttttcaaggctcatcagtacttcatttcttttttaatggctgaaaaatatgccattgtatggatatactatatttagtttatacattcatcagtgaacattttcttatctttcatttaaaaaaattccaaatgtatagaaaagttgaattgcaaaatgcacacctctctacccttcacttggagcctcagcacttttttctatacataaaaaatactggccgagcgcggtggctcacgcctgtaatcccagaactttgggaggccgaggcaggtggatcacctgaggtcaggagttcgagaccaacctggccaacatggtgaaaccccgtctctattaaaaatacaaaaattagccaggcgtggtggctcacacctgtagtcccagctactcaggaggctgaggcaggaaaatagcttgaaccaggaggcagaggttgcagtgagctgagatcataccgctgcaccccagcctggacaagagaataagacttggtcttaaaaaaaaatacttctgggtgatctacatacaaataagctccagcaaccaatttcacccccaaaatttcatcatgaatctcctggaaataaggacattcttttaacggcagtgaaattaccacacctaagaaaggcaacattggtccattattagctaataggcggtctacaaactatcccaagcatccaagaagaacggccatgaaagcagctgggatccaatcactcagcacgcgctgcagggggcggccaggtctcccgagtagcctttcatccacaaggtcctcttttaacatgacagcattacgtcggaagagatcaggccagctatctttcggaagaaggcacatctcctttcaacatccacatttaattatggatgaaagagcgcatattctgtcagattcatctgagataaccgagcaccatttcctcctcattttaagaagtatcaattactcgcctgttatatcctggagagcaccagcttttaagtcaggctgccagggccccaaaccagctcccctaggcacctgctgtgcagccttgggagctaaccctctaggcctctgttccctggacaacaggcttaactgcagcacacacaccagcaactgtggcgaggcttaaataagatcacgtgggaaaggcacaagtaagaggcataatagaagctttccagtacacctgtgtggggtggccaagtctttaaaagatagaggctgactgtgctaccagccccgttccttcatgagccaatggcaccccaaggccaagagcctgggccttgagatccagccctgcagaaccattacggaacgcacgcacactgggcccatcttagtgtggtagctaaaaaagaaccagagctgggatagaagtccagcttgaccactcactacctacaggcagtaagaaagtgatctgtttttgtgcctgtttcctcatcagtaaagtggatctaagactcctgtgaggttcagatttcgtcacatatgtaaagcatacgccactgtacaaaaaacccagttccaattcagtacattagaaactatcatttctaacgtcattctaaggtgtctcctgactgtaacggatagccttacacaggcagagtgaaagctcacattcaaaggacaggcttttgaatcctggctcagtcacatacaagctgtgtaactttgggccaatgattaaacctctcaagcctcagtttcctcatcagtaaaatgggcaccgtacgtgtcatgtagactaagtagtcgtgtagacatgtagacatgtagcatacgtgtcatgtggactaaccagatactgtacttaggtacttagcaagcactgtgcctggtgcacagtaagctctcagtaaatgttcctaaaaaacaggcactcacagatacttaggcaaaagcctaagagtcgccttccctactgctcacatgccatggtttccatatctgaccctccaaacctcatgaagaaatgtgatccccagtgcttctcgtggggcctagtgtttgggtcatggggacggatccctgaagaaaggcttggggctgtcacaggagtgaactctcctatgagagaggtcgtttacaagcctggcacctccctcccctctctcacttcctctagtgcatgtgatctctacacagctggctcccattcacaaggccctcagcagtgcagatgctggcgccctgcttcttgtacagcctgcagaaccctaaaccaaagaaacatctttccattatagatgactgagcctcaggtattcctacataggaacacaaacagggagacaacctgccagtacttcctgcccattctacttccatagctgaactccatccatccacttcacccacctccactgcctccactctagttaggagagactcccacctcatgtccctaatgtcaccacttcctacacaacccattctctacaagcatccgcacacttctgtgaaggggcaggcagttcacattttgagttctatgagacatctcgtctccatcacagttactcaattctgccactgcttagtgaaagcagccccagtgtagtggctgtgttgcagaaacaggtggggctatgttccaataacgctttatttatggagattgaaatttgattttcataaaattttcactggtcacaaatgatcccgtttccgaccacttaaaaatgtaagaactagctgggcgccgtggctcatgcctgtaaccccagcactttgggaggccgaggcaggcagatcacaaggtcaagagatcaagaccatcctggccaacacggtgaaaccccgtctctactagaaatacaaaagttagctgggcacagtggcgtgcacgtgtagtctcaactactcaggaggccgaggcaggagaatcgcttgaactcaggaggtgaaggttgcagtgagctgagatcgcgccactgcactccaacctggcaacagagcgagactccgcctcaaaaaaaaaaaaaaaaaagaaagaaagaaaatattaagaaccattcttagcttgtgaatcctcagaaaataagaagcagacctgacctgctaccccagctgtagtgcctgctctgcacaaatcactccctgctggaacccagtaaagctctcgactgtatccccaacgctttaacactcctcacatgatccggccccagccttccacctcacttcccacttttttttatattttctgaaacgatctgactttgctattgctcttaaaggcggcctattctgcatataatacttggtggccacgtccttgcccctcctgaagagctgcagtggttcctccctcacttcttggcagttacagttgcaggggagcagcttgatgctaacttgattcaaactcattttcatctgagctttccgacccaacctagcccgtaactcctttaaagccacgaagacgcaatatgagtgttttcccacttctttgtaaaggaagctaaggcaacaacgggggcttccccttccctcagcttcctggcccagggccctgcacctgcgaatccccatgtctggaaagctcctcaaacaactgctctttcctagccttctggtctgaacttacagggcctgaacatagaagggtcccgttcatttattttttatttatttatttatttttatttggagacagagtctcgctctgtcgctcaggctggaggagtggagtggcgcgatctcggctcatcgcacctctgcctcccgggtgcaagcgattctcctgcctcagcctcccgactagctgagagaacaggtgcccgccaccacgctcggctaatttttgtatttttagccaggctggtcaggctggtctcgaactcctgaccttaggtgatccacccacctcggcctcccaaagtgttgggattacaggcgtgagccactgcgctcagcgtattttttaaattttatttatttatttttttgaggtggggtctcactctgttacccaagctagagtgcactggtgtgaccctagctcactgcagcctccgaaactcgtaggctcaaggaatcctcctttctctgctaggactacaggtgtgcgcctccacggagggcaaatttttaaattttggtagagatgaggtctcactgtgttgcccaacctggtctcaaagtcctgggctcaagagatcctcccgcctcggcctcccaaagtgctggaattacaggcgtgagccaccgcgcccggcctctcttttctttaaagccactgtggccatcactgtgtgtgtagacctcaccccgccccaggcaaaccccttccagcacccatcacaccggtacctccagtcttggcccacctgctggcgggattcctcggcactagacagaagccccccggggcaaggggctccctccgcggtcagaggcagggactggggcaggggaagaggctggggctgggcaggggctggacagggacagggacagcgcgcgggggcgcggctcacctggtcggcgccgaagggcgtgatgttggccttgacggtggccacgcccaggcccaccagcaccagccccgcgaaggtggccggtgagcagcagcgggcggcggcgtcgggaccaggcgccgtgcagttgagcaggcgcgcggaaccgcagagcgcggctcgcgtggcgggcgcggccagcagcgggaaggccagcatgcccagcaggtagagcgccaggctcagcaggatggcgcgcgcccggcccagccgcgcgtcggccagccagcctccgaacggcgagcccaggtaggtgaggcccatgaagagcagcagcgcctcgctggcctgcgcgccctcccagcagaacggcgccccgttcaggaatagcaccaggttggacgtgatgccgtagaaagcggcgcgctccagcagctccgtcagcagcacggccccgcacgccgcgcgccggcccgcgaacgccccagccgccgccgcggccgccgccgcccgccgcgcgcccagcagcggcgcccgctcgcccgcaccgcccccagagccctccatgcgacgccgccagctgcctcgccccgccgccgggtcacctgtcccagaacccagggccgccgcccttctcgcgagactgccgggcctgagatgtccctattgggcgggctcgccgctgctcaacgccccactcgccggaacttccggccccgccccgggcactaggcgaggaggtggccggtattctggatcactgcgtgtcttggggagcttgggattccgcagcttggcggccgagagcctttgtttgcctttttgagacagggtttccctctctcgcccaggctggagcgcagtcatgcggttacgcctcactgcagcctcagcttcccaggatcaagcggccctcccacctcagcctcccgggtagctgggaccgcaggcgctcgccgctgcctgtggctaatttttaaacagttttttgaaatggggtctcgctttgttgctcaggttggtctcgaactcctggcatcaagcgttcctcacgtctcagcctcccatagtgttggaattacgtgcatgagccactgcaggcagtcggactaagggagtttaaacaaagaagccggagcctggccctcttcgggcttcggtggggcccagtaggcagccaaaactcacactgagacggcggctgctctccaggcgggtttgctcaggctgcccccgtgctccctgccctgggcttcagtcctggagaggacccggtttctcaacccgtgcatcgttggcactttgagcgacgggactgtcctgtgcgttgcacgatgttcagcagcagctttggcctctgctatccactaggggccagttccaccccctagcacctcaggttaacaaccgaaaatgtcttctagactttgccgaaggactcctgggggcaaatacgcccccattgagactcactggcttagaacaaggcaagctccagcctgtttcaggctttcccagagactgcccctacaccatctatggttgcatggctggcttctcatccttcaaccttccaccgaagtgttgacttcagagaaacatttttttcactagcctgtccaaggcccgagtatcccattccatcatgttactcttttctccttattacctgttacattttttaatttattcgtttatctccccaacctgcatgtgttaacaggtgtaagcttcctgatggcaggattctcttgtgttttgttcctcactgtgccccctgcctctgggacagcgcctggcacatagtggagtgaaagagtgccgcccaaaaatggccctcagcatggcttcagaaattgagaccccggcctgggatggtggctcacgtctacaatcccagcactttgggaggccgaggcggacggatcacgaggtcaagagatcgataccatcctggccaacatggtgaaaccccgtctctactaaaaatacaaaaattagctgggcgtggtggcaggcgcctgtagtcccagctactcaggaggctgaggcaggagaatcgcttgaaccagggaggcagaggttgcagtgagccgagattgtgccactgcattccggcctggtgacagagtgagacttcgtctcaaaaaaaaaaaaaaagacaaaaaaaaaagaaattgagaccccggcctgggatgatggctcacgcctataatctcagcactttgggaggctgaggcaagaggattgcttgagcccgggaggtagaggctgcattcagcagtgagggcatcactgcactccagcctgggtgacatagtgagaccctgtctcaaaaaaaaaaaaaaaaaaaggcaagaaagaaaggaatcgtgatccacagctgctgcaatgattcaattagtgtaagaccacctcctcttccttcatcattccctccagctaagatgagggtggagccagtagctgggaagttggcttgccagtaggtcatctggagaagtaatcctgccagtaagtcttgaagttgcatgcattctctttttaaaaaacttttttaaatgtccgacagatagactgatggtcagcacagtgctgccacacagcaggcaatatatatttaatcaatgtctaaggagagaataattgaatgcccgaattggacctttgccacctgtctgttgatgcttgtcatttccagctgtcagctcaaatatcactttcctaaccctgccacactaggttagctccccgtttttatggccttggaactccctatacttttttcccacagcaccggttataatttatacttattttgtgcaactattgaatgcctgtcttcaaagctgggatggccgggatctttgttttaaccacgattgtagttctagaggctggcacagcacttgccaatgataaataggtattagattgaactggatgagtgaatgactgaccatttgttgaatgtaaatgatgcaagtcaccttatgttctcatatatgtgtgtgtatacacatatgtatatctgtgtgtatatatgtatatatgtgtgtatataagtgtgtgtatatgtgtgcatgtatacatgtgtatatatatgtgtctatacatgttcaagggcatatattagtattttaacttattattggatactaatatatgtccttgaacatgtacatatagacacacacacacacatatgtgccattttttttttttctttttgagatggagtttcgctcttgtaacccaggctggagtgcagtggcacagtggctcatgcctgtaatctcagcactttgggaggccaaggcaggcagatcacttgaagtcaggagttaaagaccagccgggccaacatggtgaaaccccatctctactaaaattacaaaaattagccaggcggtagtgttgcgcacctgtaatcccagctactcaagaggctcaggcaggagaatcgcttgagcctgggaggtggagttgcagtgagccgagatcacgccactgcactccagcctgggtgatagagcgaaactgtctcaaaataaaaaataaaaaagaaagcaatagaactcagacttcaatgaaaggcttatatctaattatgagtccagtgctgcttccactttgcagttggtagaggagacagaatctttgagtattttttctaagactgataggtttgacgctcaggcaaagtctagagtaaaattaacattaaacatggaatgaaagcaaagcaaatgatttgaatcatgtgataacccagtgtccaaacagtgctcaatacactctgccatttttgaatgatagtaaactaatccgattgcattgcctcatttgagaaaactaaagctaagtttaaaaaaacaaaaaagtgagccaagaccacatctggcaagatcacatttatatgcaatggccagaataggcaataggcaaatccatacagacaatgcagattagtacagtttcctgatactgggggaggggaggggaagattggtgcacatctctgtgaatgtactaaaaaaccactgaattctacagtttatataagtgaattatatggtatgcgaatatgtctccataaagctggtaccaaaagaaagtgaactaatagttacagtttgaaaggtttcacatataaatttggatgccttgctatttggggaaaataaatgtgagctctggcaatgctggacttgtgattacctgttacattagtatgatcccatcactttgaaccatgccccatagtattcaagcctttatgtattcctcagagatcacaccacagggcctgtcctgtgacctgttttgaccaagagaatacatcaaaagtgtctctgggcctggtctgggcacaggcttaaagtctgacaccttccactttcatgactggggtgtccggagccatcatattagacgtccacctgccttccatcatatgttgaggaggagtctgcaactatgtggagaggggattctcagcattccagatgacctgcctactgaatgcagccatgtgaagaccagcagaagaaccacacagctgagcctcaacccagatagcagaattgtaaacaaataacatggttgttcttttaagccactaaattctggggcagtttattatgtagcaacaggtaatggaaacacatttgcttccccctgtagccacaatctgctgacactcagcagcagccactgtctttagatggcagacactttctagctttcctaaaccctccccactcactattgtcttatttttgttatcatagagaaaattctccatatctgcatagtccagcgcaggagccactagctatgtgtggctattgaaactagttaaaattaaataaaatgaaaaattctgttcctcagttacactagccatattgcaagtggtttgtggctagtggctaccgtattggacagcatagtctatttcacaccatcattgcagtaacttctatcagcaaccccattctttttttttttttttttttttttgagacggagtcttgctctgttgcccaggctaaagtgcgatagtgccatctcggctcaccattacctccacctcccaggttcaagtgcttctcccgcctcagccccccaagtagctgggattacaggcatctgccatcatacccagctaatttttatattttttatagaggtggggttttaccatgttggccaggctggtgttgaactcctgaagtcaggtgatctgcctgccttggcttcccaaagtgctgggattacaggctagagccaccacgcccggccagcaactccattccgtactaaaatgtaatggatatgattgactaattagccaacatccatactctttctttttccaaacaatcctgattctcttcacatatttgtcttccttaacccacccctgtccccaccagcttcccatgtagctcaggagaacctgacttcatccttgttcccagatagaactagcccacaccagtactagtctcatgcctcttcatggtgaccagttcaggaacgcagactctaacctttcaggacacgaaatttccctggtgcctgcggttactgacccagcagtggacaaatgaggtaagttgacccagtcagactagaggcaaggccacttattggctgactgtgggcgaggcacatgctcccaaactggatgtgagttaggaaacctgcagctctaatagctcctgatggctattgacaaccatgagatgaaccagcttaggatgagactgacttgggggatggcacaggagactcagggagaagtgagataataagtcttaacattgtttaagccactgtgttgggttttctgttatttgtattacttgtggccccaagccacctatcataattctatcaaaaatggaaaaaataaaagaactggaaggctagggcaggagaattgcttgaacccaggaggcagaggttgcagagagccgagatcgcaccactgcattcagcatgggcgacagggtgagactccgtctcaaaaaataaaaaataaaaaaattaaggaacaagagaggccagcctgatttttttctcatgcctgacccatgagttttctgctgggcttctgtaatgattgggtttgcagcccctgtactgagcccccagtgatggtatagctaaagaattgatgtaaggtgattcctcccactttattggatatgctcgcaatatacttctgccccaaaaagtgatcctatgagtctctcctttgcagctaaaattaataaatgacccaacccatacagtaggcatctaagggataggtaaccgtgtcttccaaaataacatttttgtctattggctcttcacctcaagggccctctagaaaaggggcaaggacactctttgcaaaggtgcctgtggtgtggactagacttggaaacacagggttctcccttctctggtaccactttgtctcctgagcctcacccagtgcagagctcgagtgggtgtgatttaaggcagtgaactgagaaaccgtcacagacaggacattcaggggactgcctgactcctctggctgtttcatgacatttctgccgtagtttcacatctctgttgagttgctcactcctcaccgccagacagttgcctctccttactgacagtttcagcttcctcaaaacttcgggttagaagcagctgtcatagcctttctgtgccatctgtacatcactaactcactcaacaaacaactgttgaacacctgccccctgagtcatgacagctcagcctcagctcagctcagcctcagcactcacggccagtgcttcagcttctccaatttcccagatccctagggagggactcggataggccccctcacctttgtgcatcaggccatagcataagtcattagccatagtacagccacaggccatgccacacatcttttgaatctccttgggtacagagagttgccataaattctatttacttcaaggagtcactgttgcaaccactctttctggctacaaatactcttgatagaagcagaaggtataaaaagtgaaatcaataaaaacacaggcaaccaacggaatagaatcaggtgttaaatccttgatcctaaaccaaagccacactaatctacttttagtatgaactaattcagctcccagaatgacttgcatttattttaacagaggatgtgagagtgtacggtcaggaagctgattttgatttgacttgtttcaggcactcattttatttgacccttgcgagtagcaacgtctgtttcttgcgtacttttccacctgtgtttaaaaaacccccaagacgtgcaaaagttgggcttcgccaatagaagcagggaggtgaagagagagagagagagtaagtgaaagaaaatgaacttctgcttccttctattgcaagaagcgcaagatggtgtgaccacacctaagatcctattttaaccaccactttcacaattccttgtaagcaaccttagcctaaactgtaatcatataatagttcgttggtaattataagtgtatttgttttctagattaggccttacaggaaagatcaaggaagatgaatacaaagaacaagaacagaagcactaatacaaaataactgattgtatgaagtgaaatcagccaggcacagagagatacataccatgtgctctcactcatatatagaagctaaaaaagttgatctcatagaagtacatgtttcaaaatcctaccttatgccccataattatgaacaattattatatcaattaaaaataatgaggccaggcgtggtggctcacgtctgtaatcccagcactttgggagaccaaggccagtagatcacctgaggtcaggagtttacgaccagcctggacaacgtggtgaaaccctgtctctactaaaaatataaaaaattagccaggcgtggtggcgggtgcctgtaatcccagctactccggaggctgaggcaggagaatctcttgaacccgggaggccaaggttgcagtaagccgtcattgcactattgcaccccagtctgggcaacaagagtgcaactcagtctcaaaaataataataataataatgaaaggctgcctggtatggtggctcatgcctataatcccagcactttggaaggccaagctgggcagatcacttgaggtcaggagttccagaccagcctgaccaaagtggtgaaagcctgtctctatgaaaaatacaaaactcagccgggcatggtggcaggtgcttgtaatcccagctactgagtaggctgaggccggagaaatgcttgaacctgtggaggttgcagtgagctgagattgtgccactgcactacagcctgggcaagagagcaagactccatctcaaataaataaataaataataataataaaagcaaaaaagaaaaatctcagtgtatgataataaagggatctggtcgggtgcagtggctcatgcctgtaatcccaacactttgggaggccgaggcaggcagatcacctgaggtcaggaatttgagaccagcttggccaacatggtgaaacccaacctctgctaaaaatacaaaaattagcctggcatggtaacgcaagcctgtaatcccagctactattcaggaggctgaggtgagagaatcatttgaactcgggaggcagaggttgcagtgagccaagatcacgccactgcactctagcctgggcaaccgagcaagactccatctccaaaaaaaaaaaggtggggccgggtgctgtggctcacgcctgtaatcccagcactttgggaggccgagacgggcagatcaggaggccaggagatcgaggccatcctggctaacacggtgaaaccccgtatctactaaaaatactaaaaattagccgggcgtggtggtgggcgcctgtagtcccagctactggggaggctgaggcaggagaatggcatgaaccctggaggccgaacttgcagtgagccaaaattgcgcccctgcaccccagcctgggcgacagagcgagattccttttccaaaaaaaaaaaaaaaaaaaaaaagaatcagtaattcatcaattcatggggaaaggatggattgttaaacaaattatgttggaatgaatgttgaaacataggggaaaacagtcttcatattttgcaccaacataaatttcagatggattaaatattaagaaaccaaaactataaaagcactaggagaaaatattggcaaatagataatcgagagaaaatgccttcctaagcctaacactaaaggcagaaggcatgcagtaaaaaattagtttgactacatgaagatttaaaacttatgtgtataaaaaataataattgctgttgagagcacacaaactaagaaaaaaattgaagtacataagacaatgttctttttttttttttgagacagagtcttgccacccattctataaactctgttttcagcagaacttttaatctccatattcctgagtcctatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggggagactcgtatttcaaaataggcacataaaatgatgtcgtttatattttgatgacaaccttgtctcagtagcgtcaaatgccagtgttgggacagcagtgacagctagtgccaggctccaggaagctggggtttgcatttcccctgagtgcccaggacagagcctggtaggttgtaagggttgaacgaatagtgtaaaacatctgttgaaaaaataaagctttagtttggtagaattcagggtattagcagctgtctttttaaatcagtagacccaggaaatgattttttttaattggtgtgaatgagccctctttaaaaatgtgtgagatctccccatacagatggggggggttttttttttttttttttttttttttttgagatggagtttcacgtttgttgcccgggctggagtgcagtggtaccatcttggctcactgcagcctttcacctcccgggttcaagtgacaattctctggcctcagcctcccaagcagctgagattacaggcgccagccaccacgcctggctaattatttgtatttttagtagagacggggtttcatcgtgttggccaggctgattctgaattcctgacctcagttgatcacccaccttggcctcccaaagtgctgggattacagtcataagccactgcgcctggcccagacgtgtattatattgtgtttatttgataaatgcactgttgaacatgcagtatatgttcagatagaaaaaggaagtgccagaataacccagctttaaaaaggtcttcagaagaaaggaagtctcactttttaaaataaacaaatgagaaagtgtttttgaagaggagcagaaaatggagcaacttgattccagagcactcgctcccctcgtgatgttgccggccacacgcacctgcgacctcgtgcagaaacgtgcagcagtgctttccagctggtggcaggtgatgtacatggtacggagacagagggacgccatggtggcaggagcagccgtggtggagagcacagggcgacactcggcttggcctggatgaccagtcatgacgagctaaaagtcctgccgttttctgctcacacgtcgttcccacgtctgcacattgagtggtgatgttagccggtgctggctgaactctgttctctggcggagagactgccagtttgcagagtggacagttccagacctctgtgaaagggggatcatgaccgtggcacgtgttgctagcaccctcaccgcgtccagactccctcttgagtgcctttctgaaatgctgctcctcggcgctttccccattttacagatgaggaaactgagcacagaggtctcagaggccggattcaagccttatagcttgagctgcatggcccatgatcttatcctctgtgctgtccagcctgcttgggatgcagacgttgcgtgtaaagtgcctccatagtgcccgggactcggttgggtattcagtgtatgctaactctttgtattaaagtatgcagaggtatctgcttgtgtcagtttgaggatgctaaaacctgaacatgtttaagacacattcagaaaccagctcatctcttcctttgatacattgcccagctgtcggccctggtgtgttgggtgtgtcagtgacccatgcagtgaatccagaattcacgatgttcaggctgtgtcatagtgcaatctgtgatgctaaaaagtgcacaggttccatagccaagttacaaagacgctcacctcaggattcgataaagagatagtcaggcgctcttttgttatcttcgcatctgccttcctcaacaatgcagttccaggccaatcataactataaatggaggaagttcccctgaagtagttgaggagaggaacactgcctcagaaaaggcaggaaggaaataacaccagaccggctaacacttgtttctggtggcaagaacacaggaaggtaattttttactttgcccagctgttctggtgtggggggattagcagtcacaggaggctgggttggcaggtttccccttgctcctgatttgcagccttgtcgtgcggccttaggcacactctccgtcgacactgtccccttcaccaccgcatgtgtgtctgcaggccacgcagggattttcctgagtactggggagctaccttttctagtttcctcagggaacctcctccttttaccttacagaagagagggatgggctgctaggggcaggtggggggctgcagacagcccacctccagagcccccggtggcgatgtatctgacttcagggagcttcttcagtggttttgaaagcaagatgcttgtgcattttggactacagagacaacatttgttactttttttatgactccagttaaaccttagtgggaaccagattaaatagtaaagtcttgaaaaaatacctgtagcagcgcagcttacctgccgctttccttttgttttctccaggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatccatgagccggttctttgcgtggtttgtcctcagtcgctgctggtgtggcgtgtggattcctcccctgtcgtgtagaaggcgcagagcttcccgagtcgggaactgaggggagggtggggaagtgcgctcctgcacagccctcggatgctccggcgcgtctcctgattctgcagcctcctctgcatggaagggtagtttcagcatttggagaagacaaaaaacaaaccaaaaaaccctcacgttgttgttcgttgtgtaatagaaagtatagaaaaactatagaaaaatacaagacatttcaaccagtggaagtaggatagagtgaatacagatgacactcatggtatcactggatctcagaggggccggagttgtgagcccaggttaaaaaaaacggggcaggtttcgaaaagccttgtgctacgaaggataccactttccggagacagaactcatgtcttcaggatatatcacatgtaaaaataacccatggtgtcaaacagattttcttcataaggcctttgcacaaaaggggaaaggcaggtggcgtcgggagagctctcggatccttcctccggtgcgttgtgcccttgatgccccgggctgtgtgaacggtgagtgagtaaccacatccatccgctccgtctgtcccgccagcccctgctcctagctaggtgcaccctcgatgttacgagggaaattctctccagaaagtcagttggagggttgacagagtcatcagggtaccagcctgtgatattgtgatgagataagaaacagatgtggtctgggccctaaatccctgggacagaactcctgcaacccctgtagatagggcacgaggagaagcccacattttcatatttgctctttgaccccttgaccccagctcctggcctagagctgctaaggcctttgtaatttcctgggtgatgggagcatcttttgttctaatgaggccatctgtggtggctcctggacagcctcaggagagggggtgcttgctcggggaaccagtctggtgattggagtggggggactttcagccctccccctcccccacctccaggaagttgggggggtgggggtagaaggtggagtcgatcaccagtggccagtggtgtgtcatcagtcatgactacgtaatgaagcctccataaaaccccagaggcctggggttctgagaacttcctggttgctgaactcatgggggttccccgagggtggcacacccagcgggcatgggagcttcccggtccccttcccacacacctcaccctgcacacctccatctgccgttcctctgtgcccttgtcacagccttgataataaacgggcacgcgtgagtaaagcgtttcccgagctcagagctgctctggcaaatcagctgaacctggagagggagttcctgctctgtagttggtcagaagcgtaggtgacagcccactacttgcgcctggcatctgccggggcgggcagcctcgtgggcctgagccctcagccctgggatcctgatgctgcctccaggtgggtggtggcagggcatatgccaggatattataggatgctcagtgtccgccggagcatcgtgtgacgtggggaaggagagccactttcccatcctgcatcagaagtgttctgtgagagtaaagactgtttttttatcagacaactttttacattttcttctgaatttagatagttgatcaggttcaccctacagcatgaagcggtgattgaataaataagcatgaaacatgtgcctgccctgaagacgtcggtgtgtgtgtaactggcttttcttggcctcatgaagcaaacgtcttctcgctccatgtgaagatgctcagccagactttcttttcggggaagctgggcaggacagagcttttcatttctccacagtgtcatgggcagatggggagaaaaagttcttaagactgacagggacccactgggcctgtggtcagtgatcccagggtgagactgcgaccgcatgtcctgcctgaatttgcggacgggctgtacaagtacagggtccctggggccggcctcgtgccccccacccccaggggccgagatgctgcttcccggaggattggagagcgcacagtaccacatcacatcacacttcccaacagcccatcatctcagagtcacaccaggcccgtcctgatcacttctgaattctaggtaataaaaaatggatgatcctcaatattaccaattatttcacttggtgcaaaatcccatcacctggaaaaaaaagcacattaagcaggagcggaatgctgcaataatgtgaaactgctgtgtgccgcagagtgatacacactgttattaacacgggccacatatgttaatggggattctcaaacaatgaagtcacttgagtaactatttttaaatgttcattctcacatgttcttcttttggaaatagggccttttaaaggagataatgcctacaaagtgatttgttggactagaatctattaagcaaatgaaaagtacagaatgtaaagggtgaaagaaaaagcagccgaatgatggaaagctggatagtaacaagaaaactcagcatttgctggtttccaaatgagctaagcatgctcaggttgtcaaagggctgcatggagaggaagccagcccagtgccagggaccttgttttttctctgtttgaccgaatcccaaaccaatgcatcgtgagagacgtgtcttgagacgagatgagcagacacccccagacgttcagggactaggcctggtcacagcctcccagtggtgaggacggcacagaaacctgtgttctggtctctgtgccgggctgtgtctctagtgacatcaaaattcagccacagaacgcatagggagttgaggaggccgacaggtagcacggcatttcccagaaacgcaggatgagccccttgacctctagggctttgatggtgggagttgaagttgggcaggtccattgcataactccccttacccatccctagcatctccctgttgcttaatcagagctgctgtcagggcagattgctggaggtcaggagtttgggaccagcctggccaacatggtgaaaccccgtctctattaaaaatacaaaaaattagccgggcgtggtggtgcatgcctgtaaccccagctactcaggaggctgaggcaggaaaatcacttgaacctgcgaggcggagattgcagtgaacccagatcgcgccactgcactccaacctaggtgacagagggagactccgtctcaaaaaataaataaataaaaactgtattggtatattaatccttttctggaactctcaagtcaatcacgaatcccttctttcaagcctaaaggacttctccagacagctgtccaaaagcggctctgcacgtctgattgcagtgattggggttgggaaggatgcatttggagtcacctgcgggtgctcggtgagggcctggatgttgatggagtagggacctgaggttcccaggctaaggaggtgtcttggaagccaagtgaagggagtgtttccagaggatggggtggtccacgtgtcacaggctcctgccggcaagctgagctctgtgtggggtcctgacaggttgcagacagctggaggagagaggagacgccctcaagggactcacagaaaagaggaatgcagggcaagggaggtttccacttttaagaatggagaagtgaaaataagcttcttcctgaaagtctggcatcggagtaaagtgacttttttttttttttgagatggagtctcactctgtcgcccaggctggagtgaagtggcacgatcttggctcagtgcaacctctgcctcccgggttcaagctattctcctgcctcagcctccctagtagctgggattacaagtgcccgccaccaggctcagctaatttttgtatttttagtagagatggggtttcatcatgttggtcaggctggtctcaaactcctgacctcaggcgatctgcccacctcggcctcccaaagtgttgggattacaggtgtgagccactgcacccggccttttttttttttttttgagacggagtttcgctcttgttgcccaggctggagtgcgatggtgagatcttggctcaccgcaacctccgcctcctgggttcaagcaattctcctgcctcagcctcccgagtagctgggattagaggcatgcgccaccaccccagctaattttgtatttttagtagagacggggtttctccatgttggtcaggctggtcctcaactcccgacctcaggtgatctgcccacctcagcctcccagtgtgctgggattacaggcatgagccaccacgcccggctttttttttttttttttttttgagacagggtctctctctgtttcccaggccggagtgcagtggtgcaatcatggctggctgcagccttaacctcctgggatcaagcaatcttcccacatcagcctccagagtagctgggactacagacacacattacacccaattacttttttattttatattttgtagagtcacggtctcactatgttgcccaggctggttcaaattcctggcctcaagtgatactcccgcctcaccctcccaaaacactgggaatacaggcatgagccactgcacctggtcaggaatttagtagagatggggtttcaccacgttggccaggctggtctcgaactcctgacctcaagtgatccactcgcctcggcctccccaagtgctgggattagaggcgagagccaccacacccagccatgtgactattatttttgtgggaaagggctggattcctgacctagctctctgtgtttggtgaaggctggggtttggatttagtgagtcaaaagtgaggtgtaaatggtgcagatgcttttactggcccttacacacagcaggatcctgagcctggcaagaggatgccattcagggagaaagaagcctccaggtcctcactgttagcaaagcctaaggggtaaacagagggggctgtgaacttggaggagaaaaagagggagtggaaaaagccatgcatccacacggctctgcaggacttagggccaggcaggcccaacccagcatgaatgttcgaggccatgggagccagccctcctgtgacatagccacctctcagcatcagagaagtagatggctgctgtactgggctgactaataatagccccagccttcatgtccatccagaacctgtgacctcatttggacaaagtgtctttgcagatggaatcaagttaagatggggccacactggattcatgtggggcctaaatccaatgtgactggtgtccttggaggaagggaattgggacctccttaggggctgtcatcctgcctgctccagtggcacagaaaccaaactttgctgcctggcagccaaattccagggtgttgaagccacctgcgtgaagccctggcatgttgtcacaggagaagctcatcgtcaatcaacaatgccttcctcacaaagctggtaagaatgctaaaactgctccctccaggaccggcagtgctaatagcttataaaattaaacttctttcctacagatctagacatgaaattttattctttatattactgcacaaatttacttcatgggtacagatacggacatgaacaaaattaccaactttagagaactgaattaagaaaagagccctccccgctctgaagtcatccaaactccccgagcagagaaaacaagccccagcgggccaccttatttccttttcattttttggtctaggactttaatttttctacatcctgaacacaaaagtcgtatgttcctgaagtcagaaaaaccgcaatagcccatttatacccaccagaagttaaacctgtgctctgcgtgttaaggctgatgaaggagcacttcattacgccactcaaactggaatcccatctccgccgggcagaagctcttctggagagctgcttttcatgctcacactgcaatttcacatccatcagggaaatgggaaagaggcactcggagctgtcactcagggatgggccacaggatttggaccgagagtcctttctggaggggcatggccttctacacagaaacctacagtaggcgggaagacgccgtgagatgggacgagggagtgagtgtgcgtgggatgggcacaacttgcctcgtgagcaggtggacccttgagggctggtgcccaggaccactcctgcccagcaccaaccactgagccccacccctgggccctcgcacctccccatgcccaggccaggaaatcgtcccctccacataggtttcttggagggattatgaggttggtgggctggggaggggcgcccatttgtagatgcctgatcctgctcaggcactttgcagcatttgaccaccagtgtggatggtgaccaaagtgaaaacacctgctccaggagccagctgtgccccctctccaagctggagcagtctccctgggccaggaggactcgcctctggcgttttttgccagcagcctccgggatcccctgatgatgctgtcagcattcaatttggcggatttgtcacccactgagagcccctcatgtatttattttattttattattttttgagacggagtctcgctctgtcacccaggctggagtgcaggggcaaaatctcagttcactgcaacctccgcctcccggggtcaagcgattcttgtgcctcagcctccgaagtagctgggattacaggcacctgccaccacgcctggctaattttcatatttttagtggagacagggttttgtcatgttgtccaggctggtcttgaactcatggcctcaagtgatctgcccacctcggcctcccaaagtgctgggattacaggtgtgagccaccgtgcccagccaggagcccctcatttaaaatgacctgctggccagtgccaggagccctgccctaagcaagcgcctcacagggtccttcacccaaggcagcctcttaaagtgagttagtgttgggagcaggcattagatcatgagcttgttctccattaaaaaaacttactaaattgacacaaattgtatatattaatatttattgtgtaccacacattcggaaacgtatacatggtggaatggttacatcgagctaattaacgtgcattactgcacatattttacttgtgattaataacacttgagacctctcatcaatttcaagaacataataccttgctattaactatagctgtgttatgcaatagatctcttgaattttttccattttaattaactttgggttaggattcagaccagctttgctgtgggctgaataattaccacccccgcccccaacccaaggtgtcctgccctgatcccggaacctgtgattgtcacctcacatgacagagggcatctttcttgtgcgattatgttgatgctgtggagatgagcagattgtcctggactagccaggtgggccccaaggtcacaaggctcattatgagtgaaagacggaggcaggaggtcagaatcagaagatgggaggacaagatccaggtgggagtgacgtgctctggaggagggaggggccacaagctcaggggcttgagcgcctcaggggtttgggcgcctctggaagctggaagaggccgggaaataggttctccccctggaacctgcagggggaacacggctctgtcagcacgcttgattttagccagtgtgttaattcgttcgggctgctatgaccagaatattattgggacggcttcaacaacaggaatagattcttcagagtcctgggggctgcggcgtccaaggtcaaggcactggctgattggatggctggtgaggcccctcctgatttgcccactgcctgtttcatgctgtgtcctcacgtgaggcagagatcctctccttcctatcccttctcataagggcactaaccccatcacgagggtgccaccctccaggcctgattgcctcccaaagccccacctcctgataccatcaccctggtgactgggctgtcacataggaattttaccaggcacagtgtctggagtgaccagtgagtcccatttcagactctgacctccagaactgaagaataatacatctgtgctgttttaggccaccaggttttcgatacttcgttgaagcagcaataggaaatgaatggaggatattggtttgaatgtagtaaaacttccaggccgcactcacgtgcttcgtcatgtttttgaagctacagaagtaagtgatcatctcacagccctaaggtagttcagcattctctcctgggtcttttgaatttggggaaaccagggactggttccctaccccagctcccccgtaggcagcatggtgaagctatcctatgccccagggctgagatggggcatgaagttgaatggagtgccaaaaatcttggtagccaggataaaaaatatttaactcaatattttaaaaactcaaaattaatgcaaaaaactccatgatgaaaaaaaggctgcaacagtgaacacaggcaggactgtttctgccctttcagactcagccgcccccacctctcctgccaggccctgctgcacgtggtcactccgtttctcagcccttggacttgtctatttcagactgtaacatccctggcactcccccacgcgcagcacaatctctggctactctgaaatgtaaatgggtgacttatccaaagccacctaaatgagccagaatttacaacttcacttctatgtaagtcatttgtcttttctagagggaaggaatggacacagttcagggagcatcagagaagcttcagggtggatttatgctcagcatttaaaatctttaacccaaaccaagcccggtatacccaaaggacttcccgcttactgctctttagggctcagatatttcaaagacataaagcaaaccacacaggtcagcatttttctaatgttctggacaccatgctgagttcaaatcgactcattcacaatgaatcataataacatcggaagcaatgccaagagagtcagagaggccgggcacagaggctcacacctgtaatcccagcactttgggagggtgaggcaggcggatcacttgaggtcacgagttcaaggccaacctggccaacagggcaaagtcccgtctctactaaaaaaacacaaaaattagccaggcgtgatggtgagtacctgtaagccaagctactcaggagattctcaagtctccgctgaggcaggagaatcacttgaacccaggaggcggaggttgcagtgagccaagatcacaccagcgcactctagcctgggtgacagagcaagactccctctcaaaaagaggaaaaaaaaaattagccagacatggtggtgagcacctgtaagccaagctactcgggaggccgaagcacgagaattacttgaaccggggaagtggaggttgcagtgagcagagatcgtgcctctgcactgcagccttggccacagagaaagactctatctcaaaaaaaaggagagtcagagaagaagattcagcctggttatcattgtgcatcagaggtcgttcattcattcactcccatcattcagtcactcaacaaatatccctcagccacctgtatatttatgctgtagctccattttagacagggacacagcagtgaactaaacaggaactcagctttcctggagcccacattttcatgcaagagacagagaataaacgtgtcatcaaacagtcacatatcagaaagtgaaagcgttttgaagaagcaatagaagatgatgtgatgcatgatgaagatggaggagggggtctgccttaggttggcttgtccagggacgccgagggaccaggagccagcttgctaatatcgaaggacagagtttcaggccaggagaactaagggaaaagcccaaagtcaggagaaagcttgatgcatgcagtgaacagaaagaaggtctgggagggagatgggggaggcagggctgacgtgtagaggcggtgagtaactccacacagagcaggactccggagcaaaccactttctttttttttttttttttttttttttttgagggggaatcttgctctgtcacccaggctggagtgcagtgtcatggtcttggctcactgcaacctccgcctcccgggttcaaacaattctcctgcctcagcctcccaagtagctgggattacaggcgtgtgccaccatgcacagctaatttttgtatttttagtagagaccaggtttcaccatgttggtcaggctggtcttgaactcctgacctccagagatctgcctgcctcagcctcccaaagcgctgggattacaggcatgaaccaccgtgcccagtggcaaaccacttttttttttttttttttgagacagagtctcactctcgcccaggctggagtgcagtggcgcgatctcagctcactgcaacctctgcctcccgggttcaagcgattctcctgcctcagcctcccgagtagctgggattagaggcgcctgccaccacacccggctaatttttgtatttttagtaaagaggggaatttgccatgttggccaggctggtctcaaactcccaacctcaggtgatccgcctcccagcaaaccattttttaaggatagcccccaccttccgtcaagcagttggtgagattcccattagatgtccagcatttcttattcagcctgctatctagtggccgaaacatagaactacaggctattttcaaaaactgcaaagaaattttcttgaatgcctccaacaacgaaattgtgcagagaagaataccgttagcttttgccagaatgttcgtatggaacctggtcactcaagttgtttttccaaaacctcttaggttcaaagtcaatacgatttttgaacacaccagtcgtctgtcatgtacggggacatacgcccttgcagatttgctcccgcactttgagagaatgaacatgcctcaagcctgggcttccctggaagacagcctgagatgcggcctcaggagcaggagtgaggaacagggagtgaaaccggggagaaaggagagtaggagaaagagaagttccggagctggtggccaccctgggtgcctggggccggactccctgggtcctttggaggagccttttcaaatgcatctcagagctgtctgcttgggcacaagacagggtaggcgggggaagctatccattggtctcatcctccctccacgagcatgattccttgagcatagctgccagctcccgggttatccaagggccagtgctgagcaggtttccaggcatccccactgtggagtcagaggtgagttctggaaagtcatctaggtgaactgagggcactcctcgcatgggaagacccgaacagagacggccaactcagaggcgctgacctggacagacgccttgcacacacgctggaatttttcccaagacagaaatggtctgggaaccgccaatggggcacttcccagagcgttggatccagacaccctcccctcattcacccggttcttccagggactagtgttggcccctgtgagttccaggagccggcgtttccaaagctgcttgctgtgctggaggagattttcatcctgagccttggaccaggttggggcgggtcagatcctgaggctacaggaggccgagatcaccaacaggcactcgccggccgtgtgtggcatttggggacactctgctcagcttggagattattttcttcagttgaactaatagctcggtgtcctcgctagggctgctgcaggaccagatttccactgacttcgtggcttacccaactggaatttatgctccctgttctggaggccagaaatctgaaatcacagtattggcaggtctggcttcctccagaggctctatgcctcttccatctcctggtggctgccagcgtcccttggcttgtggcggcatcgctcccatctctgcctctgtcttcacttggcctcctctctgtgtctgtgtcctttcctgtctcttaaaaggacacttgtcgttggatttagggtccactcaattacaaatgatctcatctccattctctttttgttttttatttttatttttttctttgagatggagtcttgatctgttgcccaggctggagtgcagtggtgccatcttggcttactgcaacctccgtctcctgtgttcaagcgattctcctacctcagcctcccgagtagctgggattacaggcacccgccaccacgcccggctaatttttgcatttttagtagaggggttttcaccaagttggccaggatggtcttgaactcctgacctcaggtgatccgcccgcctcggcctcccaaagtgctgggattacaggtgtgagccaccgtgcccggccctcatcttcattcttcatgacacctgcaaaggccctgtttgggaatgagaccacattctgaagatctgagtgagcatgaattttgggggaacaccattcaaaccactaaacacactggagaaagaatcaggggatttttttactttagaaaatccagacttctggccaggtgtggtgggctcacacctgtaatctctgcactttgggaggccaaggcgagtggatcacctaagattgggagttcgagaccagcctggccaacatggtgaaaccccatctctactaaaattacaaaaattaaccgggcatagtggtgggcgcctataattccagctactcaagaggcttaggcacgagaatcacttgagcccaggaggcagaggttgccatgagctgagattatgccactgcactccagcctgggtgatagagtgagactctgtctcaaaaaggaaaaaaaaaagaaaaagaaaagaaagaaaatccagacttccaaagacatcagaaaattggtcaagattggattctaggccctaggctgtctcctttggaaggggcatctcttctgaattgctgcagttctggtggctcagaagaggcacacctataccctctccctggctggttagtgcattggcatcacctacctgggctgggcagggtctgagtgtctggccattgatgtgagagaagttaatagttggcagaaagtgctgagtaagctgctggcttcactatggcctttcaaaatgaaacaaaattgctgtgctttgaaaagtccagcatcaggggagaatagacccttcacttcagaacctttataatggtaggtcacaggttagaacagaacacctccatgaatttctgtcttgtgcagacaattcacattacagcaatttatatcactccaattaagtaaagccattacttcccttactcattagttcagatggctcttatcttgttgagagaagttcatccaagacacagagactttatgtggtctaaccttgcctgaagtaaaaagaaagtctgtctgctgttgcatgtaaccctataaaggttcatcagtactggagagatagatttctatataaggttagaagcatcagaaatccaacacagtctggcttaagcatgataggaaactaattggtgcaagtaaatgaaagcctacatgtggatttcaggtatgggtggatccagcagctcacatcatggtaccagcactctgtctcttcccatcttttgggtatggttttatctgtgttgacttcactctcaatttattctgcaaggctgcaagagcttctgatccaggaactccatgcttttattctaccaacattgacccctgtgaaaatcaggtttctccttcccacaagttccaataagagtctcagaattgatctcgttggttctgactggaaaggttacagacacatgctcatcaccacagccaggaatgtgcaaacctcccactggccaggactggttcacaccacagccctggaaagcagatcaggaccggctgtcccaaaccacatggataaagactgggggactgtggctccctgaggaaattctgggatacagtttttttttgtttctaggaatggggtcttgctctgttgcccaggctggagtgcagtggtgcaatcgtggctcactgtaacctcaacctctcaggtgcaagcaatcctcccacttcagcctccagagttgctggcactacaggcatgcatcaccatgcccagctaattttttaatttttattcttatttttgtggaaatggggtctcgctatattgtcaaggctgtcttcgaactcctggactcaagcaattgtctcgcctcagcctcccaaagtgctaggatcacaggtgtgagccattgcaccctgccttggaatagtgtttccaaagtaacaggaaggaaacttaaacaaattaacagatgtctgttacatattgtgttacccattgacatggtttggctgtgaccccaaccaaatctcatcttgaattgtagctcccataattcccacatgtcatgggagggactctgtgggaggtaattgagtcatgggggcaggtgtttcccatgctgttctcgtggtagtgaataagtctcacgagatctgatggttttataaagggcagttcccctgcacacactcttgcctgccaccatgaaagatgtgcctttgctcctccttcaccttctgccgtgattgtgaggcctccccagccatgtggaactgtgagtccattaaacctcctttcctttataaattagccagtctcgggtatgtctttattggcagcgtgagaacagactaatccaccaattttacctatttggacttttgtctggatctcaggccttcctccaagtccacagccctcaacagccaagctcccagcactctggggagtagtttaccaacttaacacacaaccctgcccacattgctttatctcaacacccataggtggtctctgatccagggaatggttcacgccagtcagtttcacctagacatgaatttcaggcaggaccactttgccagagggttggtttgatggtggcttttgaatggaggactgaccagatcctgcccagagatagtcacaagctgatgtggggcacaagcctcagaccctcagacagtggggtgtgagctgggtcatcagaggggaccatgcaaagaggtggtacaagaaaggggacccagggaccacctggaatgcagcgtttctgaatcagacccatccgtgccactataattgttgctatgtctgcaagtatgagtttactggggcttccctaacaaagtactgccagcttcatggctcaataccacagaaattcaatctgttctgcaggcagacacgactattctcatttacacagacaaggtaacatgcatggagatatacagccccttgcctgcattgctcatgtgggaagcaggagagcaggaatttgacccaagagagtctgctctgaagaccatgtttcttcttgtttcttctttttttcactttatatatcatttttattcattttaaaagtatacatttaaggcatacaacatgatgttttgattactactgtcaagcgtattaacatacccattatctcaaatagttacctgtttttgagtgtaaaaagcacctaaaatctgtcatcccatttttactacagaaaacactattattggctggcgcagtggctcacgcctgtagtcccagcactttaggaggctgaggtaggtggatcacctgaggtcaggagtttgagaccagcctggccaacatggtgaaaccccgtctctactaaaaatacaaaaatcagccaggcatggtggcacacacctgtagtcccagctacttgggaggctgaggcaagagaatcgcttgagcctgggaggcggaggttgcagtgagccaagatcacaccactgcactccagcctgggtgacagtgagactctgtctcaaaaataacaataataacaaagagaaacataccaaagatgaaaaataattgtaacattaaataccatgaaaacagctaaactcagttgcctgcctatttcaaaatagctaaaagagaagatttgaaatgtttccaacacaaagaaatgatgatggagatcctaaataccctgatttaatcactgcacattgtctgcatgtattaaaagatcccgtgtattccataaacatgcataattattaggtatcagttaaaaaattttaaagagaaattagccagtgttgaggaggtgttaaactatacgtgtacctgagtgagacttgatttccaaaacaggattgaaaagaagctttctcattatctgggtggatgttatttcatgccacaaatgtgcagctgtaaatcatttcccaatgatggtggcgtgcatcccacctgtgtggagactggaatcaggcttcattcagcttccagtctccaatggttagggctgtggtggagggtggggtgctgtctgagtcctcattccagaggttataagaatgaagactggcagcctccttccagccaagctgggttagcgggtccacatatcaaggcccgctcagctgtctcctgggggacttttcagggcctcaggaagaggggatcctcactgaccctggagtggggcggctgaggtcagtccacagcccctccaatgccagctgctggagcctgtacaaagacccccctttcgtctcccgattctgcagcgagtataggacctgccagtggcgcaacctggcaaccacctcttcgtgtgtatacacatgcatgcatatgcttacacacatttgtacacacacaaactcacacaggcatgcacacacacacaccacacacagcatgtgtacacaaacacatttgcacacacagaaacaacacacacttctctctccaagtgtcagttttattctctggctactttttttttttttttttttgagacaaagtctcgctctgtcgcccaagctggaatgcagtggcatgatcttggctcactgcaacctccgcctcccg

SEQ ID NO: 697 - DNA, 189268 bp, Homo sapiens
  misc_feature (1)...(189268): n = A,T,C or G
attctcactcacgtgtctaatctttccatggcgacagatcattgtggatctctaatctagccacggtgtgtcgtcaaggggaccgcatatacaccattgccccaggttatagattaagctctatctgtgctcacggtcccttatcaatctcatctcctaatccgaagcccttttgtttgcaccggggagcaggctgctgactgtggatatctatcaggggcaagtgcttctgttgcctggttactcttggagactgcacaggcctggggtggacagccggtcaaaacacgtaaagggacagtaactgtgtgggcgaagaggtggcactgcagacacatgcagtccttggatatctgtaccagggagacagagggtcaacatggagcaggtgtgcgactctgtgcagagatctgctcagtgacacatggtgtgcagacttgacttgatgtagagaaagaggctcctgcagccctgcgggaaccagttgacaagggactccgaggtaatagcacactagttctgaggagagcttcgagactctgctttgaaagtggtctgctgagggcagtcatgtgcctcaccctctccagccaagggatggcacaagaccgaagtggtggcagttaaacaatcagtcccctcgaatttaaatcttgagcagagggacccaaggacaaaaaaaagaaccagcagccagagcatgtctcccactccctcccaccccaggcgggtcatcctgcagctctcctcctccctgaggctcccaatccctgatgcttcgctggccctcgccattggtccttctagcaaatccccttcccctttaggtggccagcaccaggttctgctgcgtgcaaccagagacctcacgttagtttcctccagccgccgtgacaaagtacgacaagccaggaggcttgaagaacaggcatgcacggccccacagtcccaggggccagatgcccaagctcggggtgtcggcagggctgctcctcaggtcacaggcaggctctgcccgtgcctgtccccggcttctgtggtggctgacattcttggtacttcgtggctcctagaagcaccaccccaatccctgccaatgttctctgcatccaatccccctctctgtaaggacaccagtcatagtagattaaggcctaatctaatgaccttgctttaagttggtcacctctataaagacctcgtctccaagtaagatcacattttgagggggctgggcctccaacattctttttgtagggaacacccctcaccctgtaacagactctgtgacccgcagtcaaccaccccacccagcagtggtgagcacctggaacctgcagacctggactccgggcctggggcacctgtgagccatccttggcatggttacattagccatgggcgggcgagcaacctgccttgagatctggctgaatggggaggcctgaaaatatgcacacacctctgtaaggagatggagtcaccccttagtgagggtgggttcatttttttaccagcaccctgggagctggtcattcctacgtggaaagtgaccttaggtgagttggaaacccttgagttcagtcaccaggctctggagatgggtcttctgaaaggtgagggttagggtgatggactccaggtggatcctccccatgagagaaaagcagggggcacgtgccatggtcgtacacagccctgctggctttttgggcctaactgtagatatgataatacaatgtgggaacagcgccaggcctgtgaactccaagtgcaccattaagggactctgattaaagactgacgccaacacagaggaaaaggatggagattcccaaaacatcggcagagttcctggacgtagccgttcctgaagctagaatctcctctcttcaattacacctgtcaagagctcccgtttttgctgaggctagtttgagctggttctctgtcatctgaaatctgaagatcgcgacacacataatataataccacggggcatagcaagccccaaggcctctctgagcccacggctatatcagcagcctcatttatgtgtcctgcagaacaaaaggagcaagtaaatgacatcccagggcccgagtttaccaagagacacgagtgaaatggatgataccgagacctgggtaccatagctggaagtgtgactatttcctcgacatttccaaaactcttgccaaacacatttgtactctacccttttactgcccttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcaacatgagttcatcacccacatttaaaacttacaagataaatccagaaccaaactttttggattctcttgaaaaataaggagctcctgcaaccttcctaaatggcagccaccctctcttatctcccccacaccggggacaatgtctgctgccttctctctctagccccactctgcttcattaataataatatggaattacagtaatgataggattaagaagaaagagcatttttacctctccgtctccagatggtggagatgttcctttgttttactacagtaacccctttatatacggatctcataacatcatgttgtatatcttaaatatacacaataaaagctattaaataaataataaaattgaaaaacagatgttaaaaatggaaccaggaaggctgcatgattccagaacaatcggagacagtatgtccctttggagaagtgaagaagacgactgggcaggcgcagttgccctatgatgtcatccgcctgaccctgtgagcatttggttcaaaatctctgcccctggaagactgagtggcccggcagccactgaaaagcctcatttccaaaaagcccaggcaggaagggagccgtgtggccgccgtggctcatggcaatgctggagtcactgggcctcgtgcttctgagcccttgaacggctcaggttaaagagatcccgcgactctttatgttctaaaagcagatcactccaaacagcccccttcccctcaggcctgggtatgagattcacagatgccctgctctgtttacctatgacaaggccagacacagcccctccaaaatctcagcctttgccttctcagagatgagctgaactgcgtgtccgctgtgtggaccagaacaaaatgcgcatcagccaatctttctttaagctcctctccttcccctaggtccgcccagcccgcccccaaagcatgagccccagaaggcccccagcaatcccccgggagcagatgcaccccaaggcaggactttctcccatctgctgtccggtccttgccaccgtggccccaggcctcacaccgcacaccgcccggcacctgctcttcctagctggttttctcctccctttaaagggaaaatcccaggctgcctggccctggagactggcagtcatcgccagagccctccccacattcccgttgccccttcctgccgccatagggatcagttacaataaaacccctccttctggagtccaggatttcttctgtggcctcatcatggagctatggtcactcaggaggacaatggttaagaaacgcctctaccacgcttcactcccctctgcaaggtgcggcagcacagaccccagcgccccaggctgtcagattgctcaaaccctccccaggaaagcgcagcagcactgagaagcgcggcccagacagaaacccgggcacctcgtcccctttgtcccacacgaggcattcttacacgggccaggcacaccggagtcacgttgtgctgctggccccagtggctgaaagtagaggctgataaatttaaatcactgctgagatgacagcccatcgctgtgccaggagaggagccaagtctgccaagatcaggacttgatggtgaagcaaacgctggcacagccgtgctggccccgggcacgcgcacatggccagggcgtttagcactcgggcctccgcaccagcaggagcgaggccgtgtcttccaactccctcgacaggcgtgaggggcacctgccagcgccgtcgggggcctggggcaccagatggctgcagggccggaggaggaaggggtgtggactggaaaaggtgtcgaggcgggaaggggacgctctgctgggaggaagaggccgctacgagcccagaaggcagcggggagagaacagcgcaaggcacaggcggctgtttgcaccaactcatttgccggcgtatacctcgcgctcgctgggaagcatttgcacaggctgcaaagcgcagcgattagagacccgcttccaaataaaatcaccgtggagagactacattttcttttcagctaatcctttcattatctcaccttgttaaagtgaaaatgtcattatagcttttttcaggtcagcgcccagatcctgctgctaaaacctcgtctagttcctgatactttatgaatcagagacccatccgccaaagccatgttcaaagggcaggatcgagagtggcaagtatcactggtcacatccaagcgcctctttcagatgtgagtatcgctgtctataagcagaatatttgtccccgaaagatgtataagtaaatcatgtttaagagatcagtggccctattgtattgcataactatttcagagatgcctcgcgttttaatccacctgtaagatgtggtataggaggttaaccagtcgcccacgccccccagcacatctgggtggtggtttctgcacgtttcactgtataattatttttataaactaaaggaaaactaaacaaagaagatgtgtgaaaggtggtctttgtgcctttgttctgcgtggttctgtgatgtgtattttcctagatgtttgtttctttgggtaaagcttctaggtgactgggcattgaacaaagtagatgaataaatacaagttgtactttcagaatggaaaatcatttaggcaatacagaaaggtaaggaagaaaatgcttaaaaattaagaaactcccatcatctgaagcatatagactttcagacatctttctacccatattcacatatggaagaatatatgggcttttactaagaaagtataataatggcttatttttaattcattgatttgcaaatgttcattgaacatagagtgtgctttgggcacgtgcctcaggaaatgagcttgcagcagcatgataaatgctggcaattacttcccaacatgtatccacagatgaattaaaatagtgctcaaagcaatctgcgattttagaaattattaccacgagagacagtgaaatgagcccaaagacctgacaatctcggccaacagctcagatcaactattgttaaaattcgtactgtgggaaagaggggcacatcacagaagtcaccagagagcttacaaaatgacacactcggtgaccaggctctgatgccattccaagcatggccccacagctcccggcccagcctgcactgttcatgctgcttggctttgtgaacagttgcgtggtggcttctcagcggccttggtggcatgggcaacacgtgcccagctctgcaccatgggcacccggcagaccctcctgctgtttctgaactcctcacctccagcctttctagcctcactagcctcccaagcttgctcccggtctcagggagccacaggaacactctagaacactctggaacactctggggccattggataacacatacgtttgcttaggtatcagatctaatgaaagagaaagagaagtaattgacattgagtgaacatacacaccactgtccctccgtgggggcggccatgtgaccaagagctcccccaagcatgagtcgtcttcacccctccatccgttaccccctgtcagttaccccgggtgacccttaggactctgagcatagctggcgagatttcttccaggcctgtagcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactatatttacataattaaaataataataaatcaacaaatagagattctcaactatgcagaaattattttttaaaaggagccaaactaaaattctagagttgaaaagtaatcaccaaaatgaaaacactcactaaaagagttcaacagtagacccaagaaggtacaggaatgaatctgtgaactcgaagttagatcagcacaggttacccattattaagaaaagacagaaaaaacactgaagaaaaacaaacagaacctcagagacatataggccagcatccaacatcccagaatacacacagtgggagtggcaggaggaaagaaaacaaaggcacagaaaaagcatttcagcaaatagtggcccagagcttccaaaatgtgatgaaaaacagaatatgcagatatctacacctaaacttctaaaagacaagacaaaatcttgacagcagcaagagaaaaatgactgatcacatataaaggagcatcaatatgattaacagccaaattcatgcatgagacagaggaggctggagagtggtagtataagatcctcaagggctgaaagaaaaaaaaaaactgtaaaccaagaattcaatatccagcaaaactatccttccgaactgaaggtgaaattgagaaattcccagatgaaaaaaagacagagaatgcgttgctaacagactgctttacaagagataccaaaggaagtccttgaggctggaagaaaactactctagagagtgatccaagcctgcaggtagaaatgaagagcaccagaaatggtcactatgttaacataaaacactctgcaaatatacgttctcctttattttcttaacttctttaaaagatataagattgcataagacaataactttatccagaatatataaagaactcttaaaattcaaaaataagccaggtacagtggcttacacctattatcccaacactttaggaggctggggtaggaggatcacttgagccctggagttcaagacagcctgggcaacatagtgagaccctatctctacaaaaaaatttaaaaatagccagacatggtgccacgcacctgtagtcccaactactcaggaggctgaggtgggaggatcgcttgagcccagaaggtcgaggttgcagtgagccatgactgtgccactacactccagcctgggtaacacagcaggaccctgtctcaaaaaaaaaaaaaaaaaaaaaattaaataaaactcaaaaataagacagccaaatttaaaatgtgcaaaagatttgagttaatatcttactttaaaagatctatgaatggctaataaacacatgaaaagatgtcaacattgttcatcagtaggaaaatgcaaatgaaaaccaaagtgagacaccactccacacccactagcacagataggtttaaaaacataacacaataccaagagttggtgaggatgtggagaaactggaatccttatacattcccttttacttggaagtaaaatgacacagcatttggaaagttcagttgttccttaaaatgttaaacataaatttacatatgacccagtatttctattcccagaaagctactaaggaaaatgaaaacataagtccatataaatatatgtacacagatgttcatagtagcattattcatcatagtaaaactggcggccaggcgcggtggctcacgcctgtaatcccagcactttggaagtccgaggcgggcggatcacgaggtcaggagatcaagaccatcctggctaacacggtgaaaccccgtctctaccaaaaatacaaaaaaatagcctggcgtggtcccaggtacttgggaggctgaggcaggagaatggtgtgaacctgggaggtggagcttgcagtgagccgagatcacgccactgtactccagcctgggcgacagagcgagactccgtctcaaaataaaataaaataaaataaaataaaaggcaacagttccatgtccgtgaggtggcaaagggacaaagtgtccccctacgataaaggacgctcagcagcaaaaggggaccgactacccacgcatgcttcaaagggacagcctcggtgacgctgcgagtgaaagaagccagatgcagaagactctcatacctgaccctactttcacgaaacgtccaaaagacaaactgatggagagaaagcatcgccgggggtggcctagcgccggggtgggagctgggattaacagcaaatgggcgtaacggtagttttggggtgatggaaatgttcccaaaaaagagggttgtgatggttacacaattctattaattactaaaatcatataattacacagttatgatggatgaatgtatggtagattatacctcagtaaagcactttttcaaacacgacgaaggaatggcagacaatacttccctccaggcctgctgctggcctgccagagaaagaggccgtccctccccacactgggccggccacccgcgcccagggcagggatctacacttgagtgtttccgcgtctgggtcctaattcctagtgggagcacggaaggacacagggaatgttgggagctgcacgggccatgtcttggtcccatgggacctggccctacttgacccaaggccacaccagcttgtagacatgagcttttgggggggctttgagtcctaagagacccagctgcccacgccacacagggggaaaggaagcagctggagagtccgctgcccacaccaccccgggctccacggcctcacccccaggccgtcacagagccccagtctcccgccacttcagtgcaaccctcgctgtctgcccactcctccggacatgacgcttaggaccttaccttgctctccagctcagagcccggcccccatggccaagaagcctgcccccggcctctcccctccgcctgagccacgccccggcttcctgctcaccaggcctgcgttagtatctgcagctgtgcttcttcaggccgccgcaacaccagccttcccgcactgctccaagacactgagcctggtgcatgctcaggaaattcaacaatttcaaaacattgtcactctccccgcctgacgaccagccttgtactctactcacagggcaacctgctttagcaaactcaacgacacattaaaaagtacaatttgcaaaggagagctaccacctggctgggtgttctgcgcctagagactgggccccgggagagcgctccacagtgaacttgcgaaggatggaatttacataaagaaggcaccgtctttagtcctggaaaggcaccctgggattctctacctccgtccgtctttttcacaggcagggaactgaggtcccaggaggcccaggtcaccccacccaaggaggcaggggctccctgcactctctggaacctctccctgccaagaagccagaggcctgcttttctcaggcttaggaatctgcactctcttgttcaaagactgtgagtcagaagaggagggccaagtgcgcctgtgaatttctcttactgctcaaatggaaaacaatgatatagggctgtccgcaccacacgctgccacctgccagtcatttagagcctgggcgcatttccacagctcctctgacgccaggataatcagcctcgtctccgggctatcctgctctcgcactgtccaaatctccttgcctcaaacccggtttgacgctccagccctcccacaccgcacacatgcgcattttccgagaagctcgcacatgtgcacttcaccaccggatgcgtgctcacagcgtctatcgggctccacgtcgtcacaactcgcgccttccccccccggctcttccccacccgcgacctggcatgtctttcctacccacttcagacactctctcgcgaccctatactgctccttgcctcccttaccgtactctcccccaccacgcacctacaccttctcgcacccactctccgccgcccgacactgcacccccggagccttcacatcagccacctccccatgtccctcccacgctccactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccctgtcactgactcaaggtcttgagtttctataattaatccctctctcttgcatataatttcttcccttttcagtatctattatttcccatgtaaaatactaacaccctccactgacctcacattccctccagttatcctccctgtataacgaagccctcggcagggcacggctcacctcccacctcagcagggcacggcctcacctcccacctcagcagggcacggcctcacctcccatctcagcagggcacggcctcacctcccatctcagcagggcacggcctcgcctcccatctcagcagggcacggcctcacctcccatctcagcagggcacggcctcacctcccatctcagcagggcacggcctcacctcccacctcagcagggcacggcctcacctcccatctcagcagggcacggcctcgcctcccatctctgcagggcatggcctcacctcctaccttagcagggcacggcctcacctcccatctcagcagggcacggcctcacctcccacctcagcagggcacggcctcacctcccacctcagcagggcacggcctcacctcccacctcagcagggcacggcctcacctcccatctcagcagggcacggctcgcctcccatctctgcagggcacggcctcacctcccacctcagcagggcacggtctcacctcccatctcagcagggcacggtctcacctcccacctcagcagggcacggcttcacctcccacctcagcagggcacggtctcacctcccacctcagcagggcacggcgtcacctcccatctcagcagggcacggcgtcgcctcccatctctgcagggcatcggctcacctcctaccttagcagggcacggcctcacctcccagctcagcagggcacggcctcacctcccatctctgctgagtccacttcattcaggcttccgtccccagctccctctgaaaccacacctgtccaggtcaccagcgaggtcagtgttgccgaacccggtggcccctcttcctggccttcccaggggcagcttccctgactgaccactccctccttcttgaaccttttttttcacttggacttgaggaccccgtactctttcccatccttgccctcccctcagttccacctcaggctcctctgctgaaccctcgtcttcctccaggcctctagttctgcaatgccccagctcccagtcctgagccccttctctcttcccacgttctcccgggttggtctcctctagtctgtggtttggggcacatctacacagatgcttccctgattttccgtcatcagcgcctccttcccgagctctagcctcatatcttcaatggctgatttaatttttgacttctatgtccaggtttaccatttacaaagcacaactcttgattattcaccagcaaacacactttcccctgcgttttctcctcctagcaaatgatctcaccactgacctgtctgcctgggccgacacctgggaccacccctgagtcctcagcatccccgcaggaaacaagccagtgagaaggacgatttacatgaaaaggcctgactggaagggctactctcagagatgggggcagagataagcaacaaaggacagatgttaaggacccagagaccagcgacagcaggaagtccccaccaccctaggccagaagggaccagagagaaacagaatattcggaggccagggaaggtgggtctcttcctggtgggaactgtggtcaggcagtgaccaagcccggggcgtgggtccaaagcaagctggcagtgaaggcgcgccctccacccctcctgctgcttgttcttcccaccgcagagcctcaggaatccgagcgcagatgaggggtggatgcggccctcaggcctggcacctgggcacaaagcaagaggaggctgagggtggcgggaaaggggatacagatagagaagaacaggctcacgcctactccctcatcgaccatgggggtacaggagaaagtaagggcctaggcggactcaaaaacaggctcccctctgaagacgctccccaccctcacacaggtgcatcagcagaggctcaagggcatgcagctcaacctctgtcagctattggctgaccgctgacatatgtagacaaggggacaacccctgggaagcagacgtaaaatagaaacaataaatttaaaaactgatgagggacatcaacgcctacgtaccagagacaggtttcacaggttgagcctgggcaagttaccaacgaagaaaggaattaaaaatgaacaatcaaaaacgcagcaacaacaatcatcttcgcggatccaattccagaattactacattactaaaaacatccagctttaaacaaatgatacatgcaaagaaacatgaaagtggaactcatccatgaaagcataaaaaagcagcgaatagaaactctctccccgtgtctccaggtttctgatttagcaaagacttcaaagcagctgttataaacaggatcaaagaactaaagaagaccaggtgtggtggctcacgcttgtactcacaacatttcgggagaccaaggtaggaaagtcacttgagcacaggagttggaggccagcctaggtaacataacaagaccccatctctaaaaaacatttttaaaatgatggctcatgcctgtaatcccaccactttgggaggctgaagcgggaggatcacatgagcccaggagttcgagactagcctgggcaacatggcaaaactctgtctctacaaaaagcattttaaaaatagccaggcatggtggcatgcacctgtggtcccagctacttggaaggctaaggttgggggagtggggatcatctgagcccagggaggttgaggctgcagtgagagtgattgggccactgtactccagcctgggtaacagagtgcgaccttgtcttggaaacaaaaagaaacttaattttaaaaagaactaataacgcttaatagtttaaggtagcaggtaaaaaaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggtgtagcttgggccagagttctgagggtgcaagccattagcctttggggcttccacatgttgttaagcctgcgggtgcacagaatgcaagcatgaaggaggcttggtggcttccacctagatttcagaagatttatgggaaagtctgggttccaagctagaagcctgccacaggggtggagccccacagaaaagctccgctaggacaggctgaggggaactgtggggttgcagctcccacacagagtccccactggggcactgccagtggagttggtgagaagagggtcacccttcaggccccagaatggtagatccaccaacagcttgcattctgagcctggaaaagccacaggcacttaactctaacctgtgagagcagccgtgggagctgcaccctgcaaagccacaggagcctaccccttgcaccagtgtgcccggatgtggggcacggagtcaaggattattttggagatttaagatctaatgactgccctgctatgtttcagagtggtatgggccttgttgcccctttctttggccaatttgtcacatttggaatgggaatctttacccaacgcctagaccaccactgtatcttggaagtaaacgacgtgattttacaggctcataggtagaaggaacttatctgcaaatgagacttagagcttgggacttgagacgtgggacttctgagtaaatgctggaatgagttaagactttggaggactgttgggaaggcatgattgtattttgcaatatgagaaggacatgagatttgggggaccaggggcagaatgatacggttgggatgttggccccctccaaatctcatgtcaaaatgtgatcctcactgttgggaaggggccttgtgggaggtgattggatcatgggggtggatccctcatcaacggcttagcaccattgtgagtcctcacttggttagttcacgtgagatctgattgtttaaaagggtggcacttctccccttgctctcttgctcccattcttgccacgtgatgtgctggcttccctttgtattccaccataattgtaagttctgtgaggtctcaccagaagcaggtgctggcacatgctgcctgtacaccctgcagaaccatgagccaattaaaactcttttctttataaatcacccaggttcaggtatttctttatagcaatgaaaaaacaatataatacatatggcaaaacctaagagccctgcaagaccactgagatgctccatatcctcaagggaatgcagatacggcccaatataatcctttaagaaattgataatagaaacccccactctgcaaatctaaccattggacaatattaacaaaaatgagcgtaacagatgaaaaagtgagggcaccaaagagggaaacaaaactacaagccatttagaagttaaggacaaggatcttacattctaagggttggcaaacttttttggaaaaaagtcagatggtaaacatgttcagctttgcaggctagaaagtctttgtggcaacaactaaactttgctgccatatactaaggcagccatagatactatgtaaacaagtggtgtggctgtgttccaacaaaacttcatttacaaaaacaggtggtgggccagatttggcctaaaggctacatagtttcctgggtcctgctatataccaatacataaggttatgccaaagctacactccaaggaaaatacatagcttcagatcctcttatatgaagaagagtatttaaaaaacccaaattaatcaaaacattcaatgctagaaaccagaagactaacaagataaagctgaggcaggagggaagagtaaataaagagaaaagcagaacacaatgatttagtagacaacagcagaaccagcaaacaacctcaaagcctggtgctttttaaaacttctatgaaataaaatgcttttaattcctaaacattttttttttaacatcaaaaagctttccaaaagctataatatgataactgctaagacacaggacttgttcagtctctcaacgaagagtagagctggtacataatcctgcagataattaaattccaagcacaaattcataatgtgaaatgtgttaaattcatgaatgtgcatcactagaaatctttaacttaagactctcacaaagggctggttctttgaaaagacacacagacatgaaaagattcagctcgaagggtgtttccagatcccacccaggtgaagttttgctttcttctgggttcatcgctgcgttttccattagcctgaggaccgccatgccaggacggctgtccgtgggcaggctccagggctgcccgtggttttctcctctataaagtgggaatgaccatctcacctgctcaataggggagtggtgagcatgacacggcttcatacatacgcatcacaggctcagcaccctgccttgcacatgggaagaactccgagatgttgacagcctcctcaacgccatcgccctgccatctatgtcatcatagtccttacgttcccctctaacaatggatgctttggaacctgtctttcagagccccctgaggtctcctcaggccgccagcagggcccgctgatctctctcacacctgcctgagtgccctgcagaataaaattgaaaagtgctgagctttgtgggaccccagatgttggtcttttgcagaaagcatccctgagaagctttgcttggaggtagagatgctttaagaagccaggagtggagcctcagtcctgacccaggctgtagttcttcattctcaacagaaataagtggctcggaagctttctcagcctccgccaagcatccttcctgtgacatttacaaagcagtttcttttcttttctcttcttttttttttttttttttaaaaaaaacaaggctgtgtaaatttttgttcaagaaaatgctgcttgaaatctctctgatattttcctccaaggtcagcaggcttgcatttattaccagcgattttcttttagggcataggcctaatttaaattataaaagcaattgcttgttttgaggggaaaaatctctcccccgacgctccactttgccccccagaaaacaatgatcggttaagaaaacaactcagagtctcccttgtttactgagttggtggaaaggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctggagtctctccagtgacaggagagctccttctacatcgccatgtggcagccagcaaagagtttggccagcacaagcaggccacaggaaggagaagtcagagggtgactttggtttccagcacagaggcctggagagctctgccagaggcctgagcaggaaggaaaggttttcggggactgcttgtgtgggctgtgggtccccgcaacatgggccttggcgtcagctgctgacctgaagttggggtgcagggtcccccctcctcctctgcagaggcccccatgtcccactgatgagaggttccaccccatctctcatttttccaggactgccagccttacatctcatgttctgagcttcctgtgggccaggcctggtgctgagaccctaccagtctcttctgtgtttcattgtcaccaacgatcccccacccccgacccccgccccgagttagtgctgccacctccatccagcacacaagggatgcaaggcttagggaactagagcccaggcccacgccctgcagctgggagctgctggaccaggcttagaacccaggtccatcctcatgcaaatggcgtcatccctgccctttgcctctcactgacatttcctctccctcctcactggaaggagtgagtcaccatctcccttcaccagactccatttttttcctagcacacattgccctggggcaccagctgagagttcagtcaatgctgtggccccacaggcctaggccagctacagctccaggcagaaacgacaagcaggtttcagctgacaccagctttagatactgctagaagctgcttagtgggaggtattgagaagggcctggaggcggcctttcctttagcaaaggtgggctgcttcttatttcagctgaagcttcagaaagtaacagagagggccttgggctgagtgtctatgacctgacgctaagcagcccagcaccttcagtcctcgaaggtccgcagatgcaccccagttctgaattcacagaatgcacgcaaattagattattctggtagaacaggaatcactccgttgtctgggctacttagagatgttgtccaatcattggaaaactttgattgcatcagctgattttcagattgccaggtctctttagaactgggagattcttagaaacatctaactcggccgggtgtggtggcccacgcctgtaatcccagtaccttgggacgctgaggcgggaggatcacttgagcccaggagtttgagaccagcctgggcaacatagaaagacctcttctaaaaaaaaaaagtaaaaaaggggaaaaagaaagaaaatctaactctcataagagtcacggatccccaaagcaattttgcaaatgaagagttaatgatgttctccactcccctagatggcaggttgcttgcccgtaactatgcgtcaatgccaggcctaatattaatgtattatctaaataatcattcatactgcatatgatcagcactcaacgccttcctctcatcacattcactcctggtttgatccagtcaacacaaaaagctctttccagagaacatcagattagaaggttacacgtgttaattaaccttttttatagacaatgtacagcactggatatatcgtaggatcttcatctcactccatgggccctggtccaaggagcgagccccacagcggatcctactggccccctcctcctggtaaagacaaaaagatcaggttcccttcagtcttaggtttctcgccctccctgaaacatcccggtgttcagcaggtggggaaggatgaggtttgccacatccaggggctagtgtatttgcccttttgcctagtgctgtgggctcccaggagttctgcggctcttcctgctcacagccacacctgaacaagcatcctgaaggcaggtgggaggctcctcaggaagtgattcaggcaaaatgccttccatggaaagtgcctagacggaaacatctttatagctctgtaatgtaaataatcttaaagtcaaaatttcaacaacataaagcaatgtaaatgggagactgtgcacgaacgggatggagaagagattttagctgcacccagttgtacaaggatctggctaatagtgcaagcctcagcccacctagaaagagaggaccgaagaagggatggagggaggaagagaggacgaatgttcggacctctgtccagactttcatcacaaatgggtctttatctaaaagccagaagttagttaacagctttattgctgatggactttttatgttaaacacacacacacacaccccttactttatagcaagcaaccttcaaattatggcaccaaataggcaaaactgaagaaataagttttcccattatgttagtgttaattaatccacttcttccttcagtcatccaattatttattccacaaacttctgcgctattttcagagcagctttccaggtactgggaatactacgcgagcaaaggtgaaatcccttcctcaatgaggtccacattacagcaggtcacacagaccacaaacgcacacgatttcaggccgtggagggttacgcaacagtcactgctttacaaaaccaacctctggagctcagtcagagctttcattccctcacctcttccaggactgaaatcattatgctctttactgatcacgttattgatttttttactccttgggaagctggtccttcaaattcagatatctaaaactttccagtgtacagagtggagatgctgcatgtgagtcacccatgctaaacnncaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaaacagacggagcctaagtgcgaacgccttgccatagcctgcaggctcggactcatagacggatcccctgccgagaatcaatccccgatggcccaccagctactgacctccagaggctggggaagcgccacagccagaggccacggagctttgggaagaaggccaggtgggcgtgccacttgtgggtcaaggcctgccagaaatcctgcttcgagcctggatgaaaggccattgcagtagaactggaactgcattcatggaacctcagagggtttgggtctgtgttcctgcccaaatctgaggtcaaattgtattccccagtgttggaagtggggcctggtgggaggtgcctggatcatgggggtggatttcccttttggtgctcttcttatgatagtgagttactgtgagagctggttgtttaaaagtgtgtagcactgggccaggcacggtggcttacgcctataatcccagccctttggaaggccgaggcaggtggatcacctgaggtcaggagtttgagaccagcctggccaacacggtgaaaccccatctcttttaaaaatacaaaaaaaaaaaaaattagccaggtgggtagcacgcacctgtaatcccagctactcaggaggctgaggcaggagaatcgcttgaacctgggagttggaggctgcagtgagccaagatcgtgccactgcactccagcctgggcgacagagtgagactctgtctaaaatttaaaaaataaaaaaaatgtgtgtggcgcctcctcctttcctccttcactttttctctaagtgtttggcgccttctccttcgcttctctctctcctgctccagccatgtaagacatgcctgcgtccccttcgccttccgccacgataaaaagtttcttaaggcctccccagccatgcgtcctgtacggctggtggaaccatgagccaattacgcctcttttctttaggaattacccagtctcaggtagttctttaccgcagtgtgagaatggactcacacagaaccagaggggatgaggacgtagttgtgcagagcagggctgcttcctgggggacagagcaggatggcagtgtggtgacacctgtgtgcacctgggcacctgggcagttctgcatagctgggcaagccagggacatagcggcatacaccaacacccctgtaccatccctaacgtgatcctttacccctcacgtgggttattttaaaattagggtgaaatgcacacagcctgaaattgaccatttttatacaatacagtggcatggagtggcttcacaatgttatgtgaccatcaccattgcctagttccaaaaccttcttatcaccccaagccgaaaccccatatccatgaccggccgctccccattccccacccccgcccctgcaccctccatcagcatgctttccgtctgtgtgggttcgcctgctcgggacgggtcgtatacgtgggatcctgtaacacgtggccttccgggtccggcctcttccacacagcgtgtccgcaaggttcatccgtgtggtggcgtgtgtcaggcttcattccttttcgcggctgaatcagattccatcgtgtggatggaacacattcacgtttcgtttatctgctcatctgtagaggggcgtgcagtgagctttttacagatgttcccacccattcgtgtcaaagagagcatccttgatccaaagacacaaactacaaaagggcacagccgggactaggaccccagttgtcccgaaggacctgttggccgccagatagtggttgaaggaagggacgcaagccctggttgacggagccgcggcctctgctgagacaggcgggtttgtccgcaggcttcgggaacgatgggtgtctcacgcttctacctaaggccaaccaccagtcagtcctccctctctcctcgtcctgctccacacagcgccccgtggagcaggcctccccacccagcacttgtcctcatttgtgtctgtgcccacaggctccaccgccccagctctgcctgatccaccacccgccagcctgctctgcacagaggcaaaatctgtccctgctgggttcctgcctccccttctccaacagagcccctgctcctgcaatgcccaggcctccttcctgtccccactcccttccgtccacccccatgcctccaggccgtccacccccatgcctccaggccgtccaccctaagctctgggtgtctaaagagaatcctaggtttcccccgaaactgctctctgagagccacaccaatcagatcggtttcagctttatacaaagaaagaatccacgtgactttgacacaattacagcactccgatataaagtctggaggttcatggtacagccagtgtattaaacagctgggtggtttcttatgaaactgctgtgcttatgacccagaaatcccactcgggtatttacccaaaacacatggaaacgcactgccatggtctgaatgtgggacccccggctagacctcgcatgctgcaattctaagcccctaaggtggtggcatcagcaggtggggagctgtaggacgccacgagagctagagtgtggggctctcacgatggcattagcgcgccataaggggctgaagagaccagagctcccgactgccaccgcgtgaggacacagccttgaagactccatctgtgaagcaggaggtggccctcatcaggcaccggacctgctgatgtcttgattctgggcttcccagccaccagcgctgtgagcaaccaatgcctgctatttatcagccaccccgttgatggggttttgccacagcagccttgatgaactgggacacacatgtgttcacacaaaaacctgtaggtgaatttttttaggggctttattcttaactgcccaaaattggaaaaaaaatccaaatgtccctcagtggaggatggattaaaaaaaaaaaaaaaaaaacgggggccaggcacggttgctcacgcctgtaacaccagcactttcggaggccaaggcgggcagatcacaaggtccagagatggagaccatcctggccaacatggtgaaaccccatctctactaaaaatacaaaaattagctgggtgtggtggtatgtgcctgtagtcccagctactcaggaggctgaggcaggagaatcgcttgaacccgggaggtggaggttgcagtgagccaagatcgagccactgaactccagcctgggtgacagagcgagagtctgtctcaaaaaaaaaaagaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcggtattggggctgggggataggggggtagcgggcagggggctccggtgggggtggggggtttagggggggctggccggtttaggggggttgcgggagcgcctgagtgggcgagggagtccgaaaagggttggttgctggggggagcttgtaagttggaaatgtgggtgatgagcgcggggtggcggaaatggagctagggagtggtcctaatccaggcccccggagagggttcgtggatctcctgcgagaaagaattcagggtgaggtcgcagtgcagagtgaaagcaagtttatgaagaagtgaaggggtgaaagaagagctactccatagacggagcagggcagtcccgaaagtaagagaaggaaggtgtccnacctaagggtaatactcgtatatatatgggataaaaaaagatcatggggagatgtctctgctgtaagggtttgtgataaaggattaattttcttaattactacattttgcaagaatcgatattattatctttaaagcaaaattaggaatgtttctgttctcaagatatcgggatatcaggacactcctaagtctgggtctttttagtaaatgttatcaaactgttatcttaaccgtaaacatctacagcctggaaacacctcacctcctaaaaatgcagctcagcaagccccagcctcatttttcctagctctcactcaagatggagtcgctatggtttgaacgcctttgacaaaaagagtgaaactctaaaatatttgaagagatttattctgagccaaatatgagtgaccctggcctgtgacacggccctcaggaggtcctgagaacatgtgcccaaggtggttggggcgcagcttggttttatacatttttgggagacatggaacatcagtccaatgcatttaagatgtacgttgatttggtgcaactcaaagtgtgggtgggggtagggatggggacttccaggtgataggtagatttaaaaattttctgattggcagttggttgaatgagttcatctgaagacctggaatcaatagaaaggggtgtctgggttcagataaggggttgtggaggccgaggttcttatgatgcagatgcagcctccagacagcaggcttcagagagaacagatgtaaatgtttcttatcagacttataaaggtgccagactcttagttgattctctcctggatctggaaaaagtcctggagagggaaaggggattctctacagaaagaattcagcgtgagtctgtaaggtgaaagcaaatttattaggaaagtaaaggaataaagaatggctattccataggcaggacaaccccgagggctgctggttgcctatttttatggttatttcttaattatatgctaaacaaggggtggattattcttacctcccctttctagaccatatagggtaacttcctgacattgccatggcgtttgtaaattgtcgtagtgctggtgggagtgtagcaatgaggatgaccagagatcactcttgtggtcatcttggttttggtgggatttggccggcttgtttactgcaactgttttatccgcaaggtctttatgacctgtgtcttttgtcgacctcctatctcatccagtgacttagaatgccttcaccatctgggaatgcagcccagtaggtctcagcctcatcttacccagcccctattcaagatggagttgctctggttcacatgcctctgacaataccaccagagaatttatttcctagttcattcattgccagtgatcagagctgggggcctttacaacctgaatgcatcctctcgcagctctggaggctggaagcctgaggtcagggtgtccgcagagctgccttccccctggaggctctgtggggagcctggctccctgcgttccccggctgtccttggcatccttgggcttgtggccacatcactccgacctctggttccactgccatccgtgtgagctttcccgtgtctgtgtgtgtccttttctacctcttatgtggacactctcatcagatggagggtccaccccaacccccctggatctcatctctacccttaccttaattatacctgcacagaccctgtttccaaatggggtcatgtgggttttttggggaaggcactattcaactactacgacctcaccttaaagataaaagaatgagacatagtgcgcctccgacataattagacaacaaaataagcccatcagcttctagaaacatgacttacttataaaaatctttttgggacaaatgttttgctcatagctcggggtactcgtatctgaaagaaatacttggatgtgaacaatcttattagaaatttcagactcctgtggaaggctccttcccttgtgagcacggctttggccaatgagtctcgtcttcatcaattatcaccaggagcagaagtctgggaagcagagattgggcgctgcctcctaatgcctgagtgactggacccgtccctcacagctcagtgtcacaaagtcatacggaaatcgatcgtctgcccaccactgcacgcactccgtgtctgatatgttttgaattttttggaagatcaagttttacagcatacagctattttttaaaatttagctttttagcattcagcagtgacaacttttattaaacacccctggtgcgccgtgcatgatttgaatttcagttgctcacatccataagcggcgctgtcgttagtcaggttaatgtcagctgcagcaaaaatccaggaactctgggggctcagcacagcccgttcatttcccccttgcagggaggtgcaatgtcagtgagtgcttcctccacgtgtcactcaggaacccaggtttcttccatcttggggctggcggtgctccagggccccagaggccccagcatccagccggcagtaggggaagggagagcagacgaggctctctggctgggaaaggagatgcatcccttggcagtgggggaagggagggcggacgaggctgtctgtctaggaaaggagatgcatcccttggcttgggtcacatcccctcaccgggatacgggacaagggctgggagggtgtccctgggtgagccaccacccagcagcaatgccacactatggaagttgggccccacatttacgagggatagtgagatctgtctttgccacatgtatgcataagaaatacttgcatggctgggcacggtggctcactcctgtaatcccagcattttgggaggctgaggcgggtggatcacttgaggtcaggagttcgagactagtctggccagcatggtgataccctgtacctacatttttagtacaaaaattagccgggcatggtggtgagcccctgtaatcccagctgcttgggaggctgcggcaggagaatcacttgaacccagaaggtggaggttgtagtgagctgagattatgccgctgcattccagcctgggctacagagagagactcatctcaaaaaaagaaaaagaaagagaaatactcgcgtgaggttgtcatgtgagggatggataaagagttatcgcatcttaattaccaaggctggcaattaatttacacgaccttagttcatcttaaagtgttgcttaaacttggcttattaacatgaaatatgagattgatttttttaaaaaaaatcaacaaaaagtagaatagaggttactagggaataggggagggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataattacgagatcaagaagggtcagatggtcccaagtcctcttctggtttgccattccaaggacagaaagctaaatcgtgagccctgaccgcactgcaagggccaggtctcccaagactgcaggaagccttcatctcatggtgactgccggacactcggcccggcatcacggcgtggatttaggatggtgatgccggacactcggccggttcacgggtggatttaggatggtgactgccggacactcggccggcatcacggcgtggatttaggatggtgactgccggacactcggccggcatcacgcggtggatttaggatggtgactgccgacaatcgcccggcatcacgggtggatttaggatggtgactgcagcgctttgcctttcttctgcatcataactgccgccctcaattcttctctgctaatcagcctcatgggcagagagcccctcattagtgcctgggaattaactgccgtgcaaaacagaaaaacaaactgcgcctgtgttgttcctggagtcctggggaaggaagaggtggccgtgctgagagcactccgggaaaatgagtcagcctcaggcacctcatgccccttatgcttggctggagagtaaaccaggaggacagagtggtcaacacagcaaggggtgccgagcgtggctgcaccgggctgggcccctcaaagccataggtgacaatgacagctcgccagggccatccgaggatggggtcatacctcagtgctgtacgtcattaatccccaccctgactctatagataagccactacccccattgtacagatgagaaaactgaggcaaccagaggtcaaatgctgtgtctaaggtcacacagtttgtaaatagcagagcccagagtcaaagccacgtctctggtgctaaagccatgtttctaaccactgtacccccagcttcctgccactagagcctgaaagatctttgcattggtactcagggctcaggggacgggatgtgggaatcaaaggcagaccagaaagagaagatggcttcccctccaggacaccccaaatgatgccccacactccagggagaggccctggctccggctgggactctgggtttagtttagttttgttttgttttgtgtttttttgagatggagttttgctctcatcacccaggctagagtgcaatggcgcgatctcagctcactgtaacctccacctcccgggttcaaggaattctcctgcctcagcctcctgagtagctgggactacaagtgcccgctaccacgcccagctaatttttgtatttttagtggagacggggtgtcgccatgttggccaggctggtcttgaactcctgacctcaggtgatctgcccgctttggcctcctaaagtgttgggattacaggcgtgagccaccatgcccagcctgggtttagtcttataagtcagactatccgactaggaataataacctttattacttcgacaacccacatcgactaacatgcatctatcctcttccaagcaccaggcactgtccacgatgttttgcttaaagtcactcatttaatcctgatagcaacaaccttataagtcaagtcccatcattatctccaccttggggataagaaaactaggctacacattgaagctcacaccagcaggtcacaggcaccttgatctgaaccaggctggctctgaacgggtcacgtgccctctcggccaggccacactgccgctcactgagagaggggctagaaggagggaacctgcttccctcgtcggagcgccatcaattctttccccagaatggcatgaatttatatccccacctgctctggagtttgagtctcggactggacacattccaaatccctgcctctctaaacggcgatggttctccaacagctgcctcaggggtcctggctcagctggctgtgcttacacgaagtccccgcaacagccacctgccaacctgtgccaacctttcattttaagaggagagctaagccccggtgagagttcccccctgcacagtgacatgtaggcctcctgcctgtggaacgcagggagctcacactcgccctggccccgggtgcacgggccacagcagcagctccccactcccattggcaggtcctgtgatgtgtgtggagcatatgtctcctgtgtcagggagaggtgagccccacaagcgaccagcaggagaggatgaagggcaggaagcggagcccaaacctcctgaggaccaggaccatggaagcacagagatgaaagccggtccctacagaaatcactgggccatggacaggcaccccatgggactggggacaggagagctgttgcctacagaaatcactaggtcagggcaggtgccccatggaactggggagaagaaagaaatcactaggtcagggacaggtcccccactttacagataagaaaacaaattctatacatgcggagggaaagcaagcccacccaggctgcactctgcggaggcggggaccactgctccatgtccttccattcacatttattgaacacctgcgtgggacatgtgtcagtgaataacacggggcaagggtaaggtccctgccccaaggagcagacatgcccacagagcaacagaggcaagaaacacgcaagcagacaacagccagtttcagctcatgagagtgaaagagaacaaggaaactggagagcaagcagtggggtctgcgaggggcagcgattttagacagtgtggtcaaggtggccccccaagaaggtgtcctctgagcaaagcctagagcagtgaagcggaggtggccatgctgagacagagacagagagagatcccaggcggctggcacagcacatgcaaaggccctgaggcaggagctggagcccaggcagccaccctcccaaaacagtgctcaccaacagtcctgatggacatgaaggattccgctctcactggcagaaaagctatactgtggattcaggggcctgtagcctctcccattgagacgaaggaaaggaagtggagaggcagactccctaacaaggcctcgaactcactcacacacacacacttgctacaagactggaaggcagagagggtgctgtgaggaaacacaccacgtcctgccccgtggttttagacaaattagctttcatgagctgctcagctcttaatccattagggcagacacgtgtcaccttggttaagagcaccgtaagatccagccctgagacgcctgctgcatttaaaatacaatcgcacatcgatctggactctacctgtggccgaattcattatccagtctgggaagattaaccatcacaaagaatctatataaatgggatgggaagattaaaagtatccttacttcgaggagccgtatcatcaagtgcaaattaatttgtgcaaggtagcacacctgcgtctaagcccagtgtctgcgtataaagcccaggaattacgggagacattttgaagccaagtgatcctaatcaccgtcagacttcaggggcagcaaggctagcgagtgacgtcggaaaagccacaggacagagaccctgagccctcaggagcatatggccacaaccactgcgttacttaggtatgtctgaaatcatcctccggcctgagaacgtggcacagagtcactgggcaaagcacccaacggctctggctgacttcacatgctgactgacttcaagggctgtggcccactgggtttccccacacaggccccttaagcagcacctgccagcggcaatgaccaaggacattctcccagttgggtccgggagccagcgcctagtctctcaaactgtgaaatactcaggaacactgtgaacccgttggtaagtcacaggtagtttgaaatcagttgtggttggagtgtttacaccacagaaataggcaaagactacaaatcagaacttttttttttttttttgagacagtctcactctgttgcccagactggagtgcagtggcgcaatcttggctcactgcagcctccgtccacctcccaggttcaagagagtctcccgcctcaggtccccgagtagctgggactacggtgtgtccgaccgacgcctggcaaatttttgtatttttaatagagacgggtttcaccatgctggccaggctgctctctacaaatcacagcttttaccgagcacacgcgctcccgccaaaaccaacttctattatccagaggagaaaataaaccagaattgaattttgtatgctacagacattggagttactccctccaggcccctgaagttcactgctcttccccagcactggctggatgtgatatcgggttaaccagccagcaccttccacccctacagtcaggacacgggatgggcagagaactcaagccagttcaaagtgaactttaggattggtgaaagtcatgccctctctcactggagcaagcacatagcctgtgggacaaggtcagagccattttgtggctacaagaggagtcggcgttacgcaaagagcagagagaaggatgagacgatcaaagtctcgctgatgaattaagttctgatccaacgtgctgatctcttcttacgctggcttcagttattaatctaccatgctgttatatttagcacttgaagagccttcttgaatgaagatttcttacacagaatctgaacactcgttcagttagtctctcgctactaagggtcatagagcctttcagtactagcgctgagagctgttgcatctagccttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcactctcaagggcctaggaagaactcctgcagtctcgcaagagtctgtcctgctgcctggcctctccccactcctggcacccactctcacttttcggagcaacgttgtggccaagcctgggcactgtcatgacatagctgcggtatgtgcacgaacgtttgatgcccagcagcccttggtcttatttgtacatggcaacagctatagccccaaggcagcctcctgccacccagagcctccaatccacaattgccagcatccccactccctgatcccacatgctgaggcacttgtcatgtaccctgggctggcactgctgcttctgcccagtaaagaaaggtctctctgtgcccatgctctctgcttccggtgaggaaatgaaacacagaacctcctggcttctgggacgtcccctccctggctggccgctcctcccctcctaacttgggagcatcaggggtccagggctcactcctgccccttgtcttccccctgtcactcaccagccaggtgctcctgtcattcatcctgcggccctctccccagagccagtgttgagtgtccaaatgcttcccccatatccccttgcatatctgatcacagccgagacctaactgaactcctgggctaggcccagtggctcatacctgtaatcccagcactttgggaggctgaggcaggaggactgtttgagctcaggagttagagaccagcgtgggcaacacagcaagaccccatctctacaaaaaaatttaaaaattagccaggtgtggtggtgtgcacttgtagtcccagctacttgggaggctgaggcaggaggattgcttgagcccatgagttcgaggctgcagtgagctgtgatcatgtcactgcactccagcctgggcaatagagcaagacctcatctcaaaaaacaaaacaaaaaacacaactgaactcctgaaactcttagccctcccctaacacttgcccctcctctgtctgctttcctccttgaagaccatccttccagctgcccaggctggtcttccttgcctcctctccttctcagaccccaacaccaaatccatctgcaaatcctcatttctgttaacattgttgagacataactcatataccatacgattcaattgttcttaggatattcacagaattgtgcaactgtcaccattaattttagaatcttttcattaccccataaagataccccataccctctaacagcccagccaaagggcttttgactcaaacctcaaagtatattgataaagtgtccaacctcttttgccccaacttcagctgccactctaagtccccgccacctcctgtctagatggcctcaggaacctcataatcgctcttcctttttgtttttttgcggaagagggggacagggtctcactgtgctgtccaggctggaatgcagtggtgcgatctcagctcactgcagctttgacctcctaggttcaggtaatcctcctgcctcagccttctgagtagctgggaccacaggcacacaccaccacacccagctattttctaatttttcactatggtgtccaggctggttttcaactcctgggctcaagcgatcctcccgcctcagactcccaaagtgctggggttacaggtgtgagccgaggcacctggcttggtcttctatctttttctacccttttggcacatctacccacaggagtcagcacaacgcctttaacacataagtgttatcaattgtacgtatacaatcttctagtcactcccatttttgacagagtcaaagtcaaagtccatatgatggccccctagacccagagtgatctggccccccacccgctcacccaagcacacacgccctgtggtctctctccctcctgtccggtcactgcagcgacacaagcctccttgcagttgcttggacacaccaggcccatgcccacctcaggacctttgcatgtacctcttcctcagccaggaaagctccttccccagaaatccaaggggatcgcacgcttacctgccactggtcatcatccaaatatcacctatcataagagcttcccgactgccctacacatggatgtacaatccccacacagcattcttcatcccctcggagacttatttttctccaaaatttttatcaccacccagcacagatacatttgacttaaccattttgtttgtttcctgtctccctcctctagattacaccttgttgggacagtgattttaccgggaccattcactgctggatcttggcacatagaatcttccctggcattcagtcagagttgtagaaatatctgaaaaaccaaagagctgcacgtttcatgaaaaaagtaggagagtaagctgggcgcagtggctcacacccaaaatcccagcactttgggaggccgaagcaggattgcttaagcccaagagttcaagaccagcctgagcaacatggtaaaaccccatctctacaaaaaatacaaaacttagccaagtgtgatgctgggcaactgtaaacccagctacttgggaggctgaggtcggaggatcacttgaatccgggaggcggaggtacagtgagccgagattgcaccactgcactccagcctgggtaacacagtgaggctctatctcaaaaaacaaagggtgctgggggagcatacgtacttctttgtggaagggccagatgttgctgtgtgtttcccatgtctaagaatcccacctaggatgcacgccgaagcaaaacatagcatctgtgagggatctgagcttgtgattcctgcattagaagctcagaaagaaacagaaaactccaacgtgtgtagagcctggagtgagtcatgggagcaagggcctcctaccttctttccccgcccggagcagcaggggccctgcccntgcagaaccacagaggcaggggcgccgctcacccctcctccaccagcgactcctgcagcctgggctcctgtcttctggcaggtgccaccggagcagctcaggatcgcagatgtctcagaatcttccctctagcaaagttactcctaaaaacctatcccagccagggcagggaggagacaggagatgcccggctctgcccgcctgaagtcaaggtcctgctgccactgtgggctcctggctccagctgtgtgggacagcccagcagtcagcacatccaggcctgggcacgtctctgcgggcccagagcccagtgggtccatgcactcgaggtcttggggtgattccacttagcagagactcagaacaatcagctgccatcacctcccgtggaatggctgtgatgccatgatgggaagaaccaaccaacccacctgtctctcatccacaaacggaagcaaactgcgagaacctcctcctccagcaagggtggtacaagcagctctgcagagccacggagcgtccaccgatccccaggacaggttgtggctcagggaggcggcacccacaacaggcttcccaggccgcacctccaggccccgatctctgctctcacctcctgggctcaccctcccgggggaaggaggggctggacatggagcctgtggctgctcggtgtgggtggtgacactcttggtgacgtccctcggtcgtcaggactcatttccccggtgttggatgcagctcgaggacagcagaggggcccagcccataaggatgggaaggtctaactgtagatgctgacaccgaatgccggagacgcggatgcttctaccccagtggcaccaaggctgctgtctgcggaatcccgaaggtgacagctttctctaccacgggccgccccagcccgccagctttgggcttgccgtgcatgggattacgtgctaaactttgtgggtgtcacaggatgcttctgacaatatgataatgagaaccggggagcgactggtattttcaaactcagtcatctttttctacttacagagaatcccgtttggagagatgtcatgggagtgtagttttttgttgttttggtctagggaaaagtagtcagatagccttctggctacaggcaaagataaagcccgaattctattcaagaataaaaatgttcagaaaaccaaagagtaaagccacacagtactaattcacacttacgatggccaggcacgaacccaaacacattgcattattccacacgtgatcgtccaacgggcctatgaggtggggggtgtcaccctgtgtcccctccagctgtgaggtgggggcaggtgtcagctccatgtcccctccagctgtgaggcggggggcaggtgtcagctccatcggaccacctctcaagctgatgaggtggagnggggatcctcgtannnangtncnanccatgcaaggcatagcaagcgtntggcactaggacaccgtttgttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccagcagccccacctatgatgctgaatgttcctttgggacctcagagctgaaatggataaggtaggttaggtgttgagagagatgggcggcagagtgctcgtgtcgtcttcagcaaaatgtgaacaatgtggcgtacctaccttcaggatttctctgattattatgacgggttaatgggttaatgtttgtcatatgcctggcacaagttagcactgtataaatatttcttttttctttttttgtattttttagtagagacgaggttttgccatactggccagactggttttgaactccagacctcagatgatccacccgcctcggcctctgaaagtattgggattacaggcacgagccaccgtgcctggccaaatatttcttaaagaaagaaagaaaaatctctggagacctttcttggccagaggctgcagggggtgtgataaggagctgtccctttattccttctcattgacattccatttagttaaaaggttcgctgaaagcttctacagggattatgtcacacctatttgcatactgaacatatatagtagctgctcaattaaatgtttaattaaattaatgtgctcctccaagcagtgtctttcccagcaataggatcaaattctcctgtcatttgagattcaagactattgtgagtgtgtctttgaagaagtagatcaataactctcttcctagttacatatgcacaaagaacctgggatgaattcagagtgactttggagataagcattctatgtgtgctggaagataattgcattacagagctcataaacctctccccaaacactgaggtctctagactgggctgaatgatgccttggagctcagcaccactgcaataacaaacttaattaaggcatcaagctggaagccaggctgggcagtaaattaatttttaatccatggatgtagctggcttttcaacatgatggatataccacaacccagaggctgtcaatccaacaagaagtaaaagataatcacattcaccagccggtttgctttttttttttttttttttttttttgcctgccctctttgaccccatccccagggtgggtgagcagcccgtggttttaggcagttgatatggttggtctgatttcactcaggtgagagctccggcgccctggactaactcagttttagcttgtgatcttgattactggtcgtccttctggttggttaaatcacacagagaatgagccttgtcagtaagagtgttaaccaaaccctgattcccaaacatgcttgctctcctgacaaggtgtataaatgctcaccgtgagttgagcgtggacttgcagagaatgtgcagtcagcaccctggcaggaaatgaagggtgtactcggctagggcttggagatggctacaagggacaacttatagaggtgtggggaggttaagagaaccaataagtagtgatgcatacagggtctagcaacagcaggaagctgttaccatccctagacttgaaggggaagaagcagcgttgtagcagcttggtcatcccttggagcattcagttaaatgagttttcagatgaactaccggatcacgggcttctggccaatttcagtcaggagcattctgtcttacagactaagagtacatattggttttagggtgagggggcttatcacaagcttggaatgtttttgtgtaggggagaagtttatggcagtgttggaatgtctctgggcagaggggaggttctattggggctgacatccttccagccagaggggaggttccactggggctgacatccttccagccagaggggaggttctgttggggctgacatccttctggccagagtaggggttctgttggggctgacatcctactggacagtggggaggttctgttggagctgacaatcttccggccagacgggggaggttctgttggggccgacatccttctggccagcggggaggttctgttggggctgacatccttccggcaggaggggaggttatcttggggctggcaggtctctggtcggggaggggtttggaatgtttctggtcggagacgtcatttgtgttgtatggtcatgctgaccttagccattaggctgatgccctttggattttggtgggttttgatcaaggtgaaacttaaaatggcagtacttgtccaagatggcagtgctcctgctctgtcagtcctgacaacatgtgcctaaggtggtcggggcacaggtagattttatgcattttaggaagacatgaaatatcaatcaatatgtgtaagatgtacactggttcagtcaggaaaggtggggcaactccagactagaaaggtggaggcagagtgggggctcccaggtcgcaggtaggtaagagacagacggttacattcttttcagtttctgataagcctctccaaaggaggtgatcggatatgcatttctctgtgggcagaggggggactttgaatagaatggggcaggtttaccctcagcagtgcccagcttgacttttacctttagcttagtgatttgggggccccaagaattattttcctttcacaataatttcacttgggtggaaaatgtagtgatgaaatggctggatatacgtaggtgtgcatttaacatttgcagaaactgtaaaactgtcaatatgtacaactataacacattgtagttaattgccaaattatttaaatggtagggccattatatactccgattagcagtatatgagagttccaatcatctgtatccttgctagcacttgcatgcccagtgtttttaattctggttagtttaatgggtaagtcatggtattatgatattttgagttttatttgcacttccccagtgactaatgctattgctcatcttttcatgtgcttatttgccatatgtcttcttgggtgaagtgtttttcaaatcattttgcccattagtttaattggatggcttgttttttattgaatattgaaaattctttgtataatctgcatacgctctcttgtcagatatattagttgcaaatgtcttctcccagtatgttgcttttattgtcattctcttaatgatgtcactcaaaatgcagaaccttgtacttttcatgacatctaatttaccagtttgttctgacagaatgtactttggtgtcagatctaaaaaaagttgtttaatctaaagtcacaaattgatgatctattttgcgttaatttttgcgtatcgtgaaggatgggtttacttattgcatatgatgtgaaggatgttgaagtttacttattgcgtatgactctccaatatttccatcaccatttttggaaaagataactctttctccatcaaattctctttgcatctttgttaaaatcagttgtaacttagtgtggtggctcacagctgtaatcccagtgctttgggagcccgaagtgggaggatcgcttgagctcagaagtttgaggccacgctgagtgacatagaccccatcaaaaattccaaaagacaatcagttgctaatacatttgtgggtctatttatgggatctctattctttttcagtggactatttgtctatccgatgcattaccttactatcttgattactgtggctttatagtaagccttaaaataatgttctccaattttttttttttttttaaatggagtcttgctcagtcgcccaggctggagtgcagtggcatgatcttggctcactgcaagctccgcctcccgggttcacgccattctcctgcctcagcctcccaagtagctgggactacaggcacctgccaccacgcccagctaattttttgtgtttttagtagagatggggtttcaccgtgttagccaggatggtctcgatctcctgaccttgtgatccacccaccttggcatcccaaagtgctggaatgacaggcatgagcactgcacttggctccaattttgtttttttggcagggtctattttacatcccttgcattttaatgtggatctttaggattagcttgtcaatttctacaaaaaaagcataattggattttgacagggtcatgttgaatctgtagatcaattcattaaaaaatgacctcttaacaacatagattcttccgatccacaaacgcaagatatctctctgcttatttaggtcgtctttaatttttctcagcaatattgtgttattttcagttggcaagtcattcatatcttttgtcaagtgtgcctgtagatattttgtatttttaaggctattttaatctgtatttttttaaactttaagtttttgtttgtggctagtatatagtgacacattattttttgtatgttgatctccttttctgctaccttgccaaattcatttaatagttctttgtagctcttttgttaattctgttggattttccacctagcctatcctgttgtccacaaataaagaccattttcctccttcttttccaatctataaatgctgtctatttctcattcttgtcatattgcattggcttaaatctccagtacaattttaaatagaagtggtaagggtgacatccttgtctcgtgtccaatcttagggagaaagcagtcaattttttaccttaaggttgttaattgcaagtatttcataggtgctctttatctcatggaggaagtttctttctcttatcatgttgctgagtggtgttatcagttatagacgttgtcatttctcagatactttcgtgtgcacgtctagttagatcatcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaattctggaactaaaaacaggtgatggatacaaggattgtgagtatacttaaagttactaaagtgttcacttaaaatggtttacatcttatgttatattttattacaaaaaatttgtaaaaagtacatgcatttatttttattttttatttttttttagagatagggtctcactgtattgcctgggctgttcttgaactcctgacctcaagtgatcctcccaccttgacctcccaaagtactagggttacaggcttgagcactgctaatcatagtccttgtgaataaaagttgataagtatgggaagctacttttacagaacttgcaattattgttcctcttttgaaatattcagctttggggcttgagatttctctctcacctctggtgtcctgataccaattattaattatcaggaaagcctgcacagagaatgccctgtagatgctacagagatgagtattcctctgcataagctgagatttctccagggttcagctatggagacagatttaaaaacatacttcaaaagttaatctatcacacaacaaaatccctacagcacgaaatgaagtgtggcgggaactgtcctcctcccaccccgatctcctctgagcccagggcctctcagcctcagtcgcgctgccacggggccgggctgctcttgtcatggggctgttccatgcactgtaggacgttcagcaatgtccctggcccctacccaccagatggtgggaacagccctggccactccccagttgcaataaccgaaatgcccccagacattgccaaatgcttcctgtgtgtatgagtgggtggggcaaaattgcctctccccgagagccgcggtcctagaagcaggcagtgatgtcggtgtcttgtgttatttgagcgagagcctttgcatgtccaagcttgcgtgtgtatgtgtgtatctgagtgtgtgttcccacatggccaaaacccacaagtgctccttgactgtgcccactgccctgcttttctcactgaacaacatgacaccatctgtgtgctcacagctctggccccctccattcaaaggcacccatggcaccgtgtactatggactggcacacaggagctttctcaaccttactcttacaagccaagtcatcctcaacgccatttcatgctcatgttagaatccctgtaggaaaagttcctggaagataatctgtagggtcgcagggtatgtgcatttttagttttgggagatttttactgagaactttccaaagaagttggactagttttctctcccaccaataatgcatgagagctcctgtttccatacaaagcatattgcctgcatggtctcacttgctggtccttcccacggtgggtgaacacactgcctgcgtgatcacactcagggatccttcccacggtgggtgaacacactgcctgcatgatcacactcagggatccttcccacggcgggcgaacacactccctgcgtgatcacactcacgggtccttcccgcggtgggtgaacacactgcctgcatgatcacactcacggatccttcccgtggcgggcgaacacactctctgcgtggtcacagtcacaggtccttcccgcggtgggtgaacacagggacattcatctttatattttttatttctttgtttgagagaagtttggcttgtctttctcatatttaaaagccacttatgttactttttcagaaaacatggatttgaggggagggtgaagtatttttgtacagagtgtttgttttttaagcccagtatccatagagaaaagggtacacatcacagccgtctcagctgctagattctcaccaggcgaatgcgcccgcacctgcacccgcaccatcagagacaggacacctcaggaccttgggagctctcatgccccgtccatcacctccccagtgagagaagtcaccgccttgacctctgacaccaaggattaactttcttgtgcaaacgtggatgtttaaaaaggcgattgtgagactaatggtttctccaagagaaaagaggttgtttcctagtaattaatgagtagtgggttatgtcctgccccgtggacaaatggttctctagacacaaatgcatggggccagtgacttttggttatgccaggctctgtactggataaaggggaattagtcaaatccagcgaactggaatcccagctttcctgatgataaatgcagggtttcctaattgtataggagaggcaggtgttcattcgtttgcattacctaaaaaagtccgcacgcacaatttatcattcttctagattctataacccttcttttttttggttgttgttgggaaatgatcaggttagtctttttttatttatattgaagtaaaattcatataacataaaattaagtattttaaagtatccagttcagtagcctttagtgcactcgcagtgttgtgcaaacatcaccagcgtctagttccaagatattttcatcacttccaaagcaaaccctgtcccctctggccgtcacgcctcatccccactccaagcccccgctgactatgggtctacgttctgcctctgtggattttcctgcacattctggacattttatagaaatgcaatcctaggccagggatggtgacttacgcctgtaatcccagcaccttgggaggctgaggagggctggatcacctgaggtcaggagttcgagaccagcctggccaagatggtgaaaccccgtctctactaaaaatacaaaaattagctgggcatggtggcgcgtgcctgtagtcccaactattctggaggctgaggcaggagagtcgcttgaacctgggaggtggaggctgcagtgagccgagatcgtgccactgcgctccagcctgggcaacagagtgagactctgtctcaaaaagaaaaaaaaaagtgcaatcctgcagcatgtggccttcgtgcctggctcctttgactgggtgtcgtgtttccaaggtgcacccacgctgtaccctgagcgggcacttcgcccctttggtggctgcggaatattccgtggcgcagcagcactacgatccgctcgtccacctatccgctgacggatgcttcagttctgtcagcctcgggctcctggggacgatgttgccgctgaacacgtgtgccagggcttgttctcctgtcgtgtttcctgttggcgttttcgctgctcccccagccttcttagagagtgtgggtggcaccaggccctctgctctcaggaggcctgtgtctggctctaatccaggcagagggaagagtcgtctagggtcatagaggctgcacccaggtttgtttgtgggagggacttcgataaggaaagaactgggctcttccccatccagtcaccctcaggcaatccagaacagtcctttgttctgccaagaagaagggtagagaaagaaggaaggtgcctgtttaggtgctgagcacggtgggtgcagagaggaggggagagggagccaggtggaggaggggtgccttctgcggcgcttcagcgcaaggcaaggattcatctgggtgcgatggagaaatggtaacgaggtgtaatgtgatctggtttatgctttaaaatgaacattgctctgaatgctggataaagaatgattttggggggacagtggtggaaattgccacagtggtccggtttggctcagggaaacacacaggcctagtggggccctgatggacagttgacaaaggcttgaccccaccccagactggttttgtattaacacgtagttaacacctgtgctaaaggtaatcttttttttgtttgttttttttgagacagtgttccgctctgtctcccagggtggagttcagtgttgcgatcttggctcactgcagcctctgcctcccaggttcaagtgattctcctgcctcagtctcctgagtagctgggactacaagtgcccgccaccaccctgagctaatttttgtatttttagtagagatggggtttcgccatgttggccaggctggtctcgaactcctgacctcaggtgatctgcctgccttggccttctaaagtgctgggattacagctgtgagccactgcacccggccctaaagataaccttaatggaagacgctcactcatcatcccagcatgctcacgtgacttgtcacttgtgtgtactcccagtgcctctccgtgtacctttgtggttgacataatcatcatatgcttggcccatttgtagggggctgccatgctcctcgtagaaggctgagcagtgtccctggcctctacccaccagatgccaacagcacccccaccctagtcgtaacaaccaaaaatgtctccaggcatcacctgctgtcccctgggcaccacaatcacctcctgattgaaaacccctaatctagactatgttctgaaactcacatttgtggaggtagggtttacacaggtgcctttctaggtgcacactgctgtgagtgctgacaaatgcatgcagctgtgtaacccacatgactaagccacaggctttttcccgtcacccctaagggttccctcctgtcccctggcaggctttccctcccctcaccctgaccccagcagcccctcacttgtccctgctggagttctgcctctccctgcaggccacatgcgtgggatcggcaggaagcctgtgggtctggaaccgtctcttctcatggtacatttgagactcatccatgatttgggctgtgtggtggtttgctcctttttgtggctgagtaatattccactgtatggatgtgccactgtgtgtgtgttttcttttcttttttcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggagactcccggacacaaaggaagctcccgggtcagcccctctggtccctgaggtttggcacttgcggntctagaccaacctatgaggcgtgcactcagcttcatgtatgacctcanccaaaggccaacagagagctggcaacatgccccagagatgcgtaaagcgcctcctggtcacgctgtattcaaggatcctcaaagtggggtccctggatgcctccacctcccctgggactgcgtgggaatgcggattcccggctcctccccagacctgctggatcagaggttctgagatttgtagccccttaacccacccgccaggatgccagcgctcaccaacgtgtgagaatcgctgctccaattaaaacttcaaccagactccaaaaatacaaacgtggcagggggtggatttgaaatggaaagcgaagcaagctcaggaaagagccagctcctgcctctcctcccgccccctgagcacatgctggtctcttccaggcgccaacagtgcatggggccaaagagatgaaactgaaagctacagtgtagggcccaccgcttgtcttttcatcttcatggccaggagctctcagcccggctgcacgctggcctcacctgggaggcttctccaccacccacgcccacccccggactctgcaggcttggggtcctctgccgggcttgcagcatgggggaggccggctgctatgccccggggaggctgcgtggcgcctgcctcctgcgtggggggcggcccatagcgccagcatcttcctgtctcccgggcacgtgggcagtgccaccctctccctgacccagtttgccatcctctaggaaggggcacgggggaatagccgctgccagcgccttccctgaaataacctggaagggctccactctgggccccagcggctccatatggccacnggcacagcctcgaccccaggcacgccccaccaccccccactgcagaaggggtgcccgccggccttcccctcacaccgtgcccccagggaacctccggagccggtcagaccctgcccatcccactgggagcttgggatcacgtctcacaggacaagccaagaccccacagcccagcgggggatgagtctgaagctgattcccggacagcccagcaaggctgggagggagccggggaggggccatgtgcgtgggggaggtggtggttttttagagccttcccccactgttccccttagaaaccgggtgagtgagcctgcacgccagctcccctcccctgcccactcctgctcagagcccagcagcctggcctgccgcaggcccagagccgggacacctcctcttcccaccgatcttccattttcagagggagccgctctccctcctctcaggcctgctccatctgtgacatttcccttccctggacgaagtggggttttcacccttgtgagcagagtctccttcagggctcctccgtgagagaaatatggggctggacagggtcccttccctccctcctcactcaccctaagaacctccagggacccagaggccacgcaggcacggagccagcacccccgcctcccccggggccagtgaccaggccgggaggtgaagcagtcctccctccctccggccagccgccaccccgacctcagccagcgtgcgctccccggggacaggagggaggctgcttccaccgaggcctctgctgacagatgtccgggcccccacctggacctacccagacctaagctcctgggcgggtggtcccgtacgcgctgcctttcccggtgaaatacggtttccactgggagagtctgcccccggccagcagcccgcgcacactgctcacacaggcacacgcatgcacgcacacactctgccggggaacatctgttttgacaaacacattattcaagtcagtccatgggacgtgaattgacagattcctgggcgcagctgcgggctttgtgcatttgcacctgagccgagctggggactctgatgtgtttgtcccacgtccccttcccccccctccaccccgcccccaagaagacaagtccaggccctgagccgctgctgtctgagaagcctgggcgcactccccaggcgagcggggccgtgtccatcgggtgccaaactttgcctggaggggcctttcttaaaagcctggggtgggggccatgacagagccacagcacccctgcagctgacacccggcacccaggaagaagcccgtcagcccttcccttccgagacgatcctgaattccaagcagcaccgacatgccagcagggcgagccgctgctccccgcacccagcgcccccggaccccacgctgaagggcattctccatccgctgcaagataaactttgtctgggcaaagagtttccggctaaccccctgtgatcaacgccgctgcagctcgggtgcagaaaggcgaggggagacgggaagctatttttaggagaaaaaaataaatctcagcctacctttagaagcgagctgtgccaaggctccggaggttcacctcggagacaactgcagtgtactgtgtcagattacaaactgggggcgagacggagggagggaggagggggagagggagagaaggagggagggaggaggggtagagggagagagggagggagggagcagcagagggagagacagggagcgagaggcaggcagagcggcgcccagtcaacattgcagggcattggtgtgtctgcactgcttgcattcagctagacatgattcattagttttctgcaggcaggcaagcaggtcgagagggagagagggagggagagagagggagagagagaggatcatccgccatgcagcagtaaccagagcctctgaaacgtcagtgtttgaacgcacacacacacacacacaaatacacatgcacacacacgtgcgcatacacacaccaagatggctatacccctcactgccagtttctctttcacagagctgtggtgaaaagctcggacagagatggaggcaaacagctctcagccacgcggggcttggggttggtgcttttctctccatccctgggaaaacagcacaggatcttccctgcaggaggccgggggtctcctgcaaccgacaggcaaccgatcagcacatcaaagtaaaagctgccctgggctctactccaggaagctcagaaactcaagcgccctcagaattaagtgatgaagaggagcgacccaagctgcctgggtctttgctctcctgtccggctcccctccccaccccaagcctccagtggccccgcggttcccccttcccacagaacttcaggtggtggcacagatatacccgctacctagcaaccgggtggtgcaggagggaaaaaaccctgggaaacatgcacggacttcacacacttgcttccttcccaggggtaaaaatcccatggcttgttactgaaaggtgctgaataagatagctcatgcggaggaaagcccctttggtattttgggctccacataccctaattgaggctctgagggctcctactaatgatggccctgtgcagggacaagactcgagtgtaggacacgagaattccaaggaagggctcaccacgggtcctttgtacaaaaaggaaggacttgtcccagggtgctttctgttgcttctccaattaaggctcactttacaagtttttaaaaaaatgggctccttagtaaaaccaacacatcctcccatcaccgtggttttgcttgtgatcttaaaggaatcgcaaaggtctcaaacctagacagccagaggaaacctcttcccaagacaactttttcaacactgtggcagacgggtccagcgagttttcccagtcaggactcattttggcctcccagataggcttctgaattatatgcctctgaatttggctgcaagactggaggcttctttcaagtcccatgtagagtggccccagcctctgtgcatggaacaaagagatacgtgctgtatccaggagtaggtggcaaaccacagacgattccttttcaccctgcagcagagttatcaggtcacagaaactacaagactgcagaaaatcgtggaagggactggttaccagatactcgtacacacatgttcacagctgcgctgctctcaacagccaaagggtagaaatgacacaagtgcccatcaatggatgaatggggaaacaaaatgtggcatatccatacaatggaatattattcagccaggaaaaaggaatggagtatgtgattcctgctaccacatggatggaccttgagagcaccatgctggggaaagaagccagacacaaagcccatctatcgtatgagcccatttttatgaaatatccaaaataggcgaattcatagagacagaaaggagactggtggttgctgagggctaggaggagaggagatgaggagtgactccttactggagtggggtttccttttggggtggtgagaacacattggaacaagagagaggtggcagttgcacaagactgtgaatgtattaaatgccgctgaattgtttactttaaaatggttaattttatgtgatgtgaactttacctccataaacacatatgaaaagaccgtagaaagtgcctgtgaattgggcccactgacccagtctgccccttcctgactccctctgctgtggcctggagcaggtcagtcttttccacatctgttaaacgatcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactgagttggtggaaaggggtcttcagacaattagagtaaatctgggcttggactgaggtcagtatttgtatttgaaagcacaattttcagaaggcttccacggcgcgatttcaaatgccaagacaggagcatgctctgggacccatccgctcacatgtgctgctggaggggacacggagcccccaggtggcaggcccctgtgactgggtcagccctatggcagggcttccctgctgaatccacagataaagaaaacaagtgttgtgagaagcttgcatttagcaaagtggtagcaacgagcagaaggctggctggagtaggaagagcacacatgcggtgttaagagcagttctatttagagccccaggctgggagctggcagcacgtttcggaagggtgcccagatgtcccctggaggtttttaagaatggacccggcagctggctgctggggaaggtgggcacgagtcagcacccagggaccacgctgcacatgaagggcagaaatgtaccctttggacagcttgcaagctgcccaccaagcccccttggtgctgggggcaaggcagcagccgcaattttctgtgtagactgcctccttggttgcctgcgagtccccactgcgtctccccgagggttcaccccacactggaggagcaggtcctcaggtttggtttttttttttcagcttcaacaatatactctgcacctccctcatctctgagagtctcgtaccgcttgttcctgttgaatctccgacctgcagacaaggcttgactttggagtctcctgagcctatgggttgaagggaggtggggcagcttctccagggcccgcagagtgtgaagtgctggggtcactgagtagagtactcccagcacccgcacgtcctcttcgggggctggggtagcagggcacccctccctgttcgggtgctgtcttggtgaaactgtgagcagggggcagggagaccacatctctgattttctcagggctgagaggatctccagggctgaaagtgggaaaatccaggcctaccagggtgagtgagttggtcctcctagcatggggtatccattgtttgggggtctcctatgtggcccgcgctgtctctccaaggaagagtctgctagccgttcaccccggatttttccccattgcacagaacggctgtgggaagccacttctcagcggaggggcacatttcccagcagcccttgggtctgggtggccacgtggcttgttctggccaatgggagagtggagccctgagtcgggggaaggcgccgcccttcccagtaccccactggctggatgcggaggccatgaggccccaggggttgggcggccacggagggaggggcctgggtctctaagtcactgcatggagcggacgtccggccgggagcactcatctctccgctgaggaggagagaaacgtacgtcgcagcaagccccacattccagcgccttacttggcctagaggctggctttgcagtcacacacgcgcttggcacggttctgtccctccggttgctctcttgtccatagcttcctcctgccacctccgtacccacctccatacccacctccgactgagcctatcggccgccacgaagggcaggaaaagccgggagatctgctcccgtgcctctgagtcaggaggtcattgaggatcatggaatccacatgaaaatggtgttcagggcccacagtatttaacccgtggtgctgcaaaaattaccatgtgcgatccgtttctcggcggctcacgcctggaatcccagcactttgggaggccgaggcgggcagatcacctgaggtcaggagttcgagaccagcctgaccaacatggagaaaccctgtccctactaaaaatacaaaattagctgggcgtggtggtgcaggcctgtaatcccagctactcgggaggctgaggagcgagaatcgcttgaacccgggaggcggaggttgcggtgagccgagatcgcgccactgcactccagcctgggcaacaagagcgaaactccgtctcaaaaaaaaaaaaaaagatactaattttagatagtttttaacttgattatgattaatggagtaacatatatttattgtagaaaaaattttaaagcacagaaaataatttagaaaaacacatacctcattaaaatcatcatggataacatcagatgtatatagcttgaatttgattttgctgggggatttagaagacgcatacagatggaatgtattttaaggggatattacgaagtttttattttctcctttatgcttttcaattttttttacaatgaataccttatgtgtgtaattctaaaagataagatgattcagtcctgtccattatgatcctttaaataaatttatgaaggtggaatttctgggtcaaaaaaccatgtttttagggcatttgagaagtgagagttcgtgtctgtttcctcttccattagtggcgcacgaaatgggatttccccttttcccttgacagctgtgagaaacattttttcatctttagtatttactgttgaaaatttagaaaagaaagatgtgtaaaagtttaggaactcataatctagggatgtatctgctcggtgatgatcagcgcgtgactcctgacatgccctttggctttctgtaccacgtgaggcgggtgtgtacacacgtgtgttcacatgtgtgtgcacacgtgtgtgcatgtgttatccaacggagctggggtccaactcacccactgcagtcgggccaaacagccacaccgaggtttgcagcatgagaaagagaggcatttagtgcagggcgtctagcggggagaaccttatgtggaagacccggactgccagatggcttaaaggggagggtctttaaaggcagagaggtagaggttaccagcaaagtcacacaccaatacatggaggttatgcattggtttgatttaaagggtgggatctctggatgcaggggcttacaaattgtaggtatatgcaaagattttctgatttgtagttggttaggaggagaaactttgtgtaaaaatttagggtcagcagaaaagaatgttagctctggctcatgggtgtgacctcctccaggcccctcaggaagaaatttagaacaaagactggtgctcagagctcagtcctccgctctccgtagctgaggtctaggtgcaggtgaatccattttggtgggggtctgggtttctgaaaaacaacccagagacagatgtgatgatgctttagcttctatagggaagcaaacatctcctgactctaactcccttggctgttgttttaagctgctattaccttcttttttgttgttggtttttttgagacagtcttgctttgtcacctaggctggagtgcagtggtgcgatctcagctcactgcaacctccaccccccgggttcaagagagtctcctgcctcagcgtcccgagtagctaggattacaggtgtgcaccatcacgcctcgctaatttttgtatttttattaggggcagggtttcaccatgttggctaagctggtcttgaatactattagctttttccttctcaagttgcttatttacttcccagggccaattaggtgcctggaattccccgtgaaggaacccaagattttcctttatttccatgctgaggggaggggacccacaggccccttaagatgggtccccactctgcctcacatgcatatgtctgtcccgtgagaattgcgtaggctaaggctgggctctaggccaggagatggggagcaggtgcagctggcaaacaccaatgtggctcctgggctgctgggcgtcctcacccactgtcatgcccatggcgcctgtgtgtcgtggctgcagagtctgaactgctgggttctcagccctggttcagggactctgtgtgtgagttgtgcgacctgcaataaatcattcgcccctggaggcggctttctcttgccctgtaggagatgacatcaacgatttttttccaactctagctttgtacaattttaagttttagatagggcttctcttttcctgacaatggggtaaatttgaagctccctatacctctaagattggttgtcattcttcttgtggagatgcgtgtgcttgcgaccttggattggggcaagaaagcatctgaaaacaggacctcgaggaggaaatgggagcagagggccattaggagctggaggaaacaatcccttttgcagtagtgagggaggtagcgagggaggtggcgagggaggtggcaagggaggtggagagggaagtggtgagggaggtggagaggcaggtggtgagggaggtggtgagggaggtggtgagggaggtggtgagggaggtggagaggcaggtggtgagggaggtggagaggcaggtggtgagggaggtggagaggcaggtggtgagggaggtggagagggaggtggagagggaagtggtgagggaggtggagaggcaggtggtgagggaggtggagagggaactgctgccgcaccacagatttcaatgcttgggtgaaacgcaaagtgttgttccctgggttttttctttccttctttaaaagcataggagtgcaaacaaagctattcagtgacttagtaactgaaaagagctttaatgaatccatttagttaggcaaggaagactaaactgtaaagagttggtttcagatttctgttggtaagaaatctttctattcaaagaaagtgcatctccaagtggcttaaatataaaaagcatgtgtaagtttaaataacctgaaagtccagcgataaggaagagatcaggcacggtttgatccagagacttaatgtcatcagcgaggactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgctgagtctgaggggagtgggtgatgagcagaaagactactcggggccataggcaggtgaaatggtttatttcagcagcagctctcattaacagctttctcacactggctctttacaccacctgcccagtctcggctgcttgacggtggctcccacaagcagctgcatggccggctctcccctgccctcagggttagcagcttaactctttctctctctnngcgcagcacaagctgtgccatgccatgccgtgccatgccaagctatgccctggctccccagatggacagctctggttctctctctctttctctcgggtgccagtgcaccctccatgttaagccaagttgagccaagccaagccccgagagcccctgtacagcgttagcagggcaattataccttttgcagacaacagtggctcagagccatgtatgaacttaaacaaacaggttatataacacgtggaggtgtgcgcctgcgtgccgaactcactgagtcactctggccagacatgtgcctcgacctatccttaaccaaacacatccatgtatcttacagagaccagcgggaagagaattctgcacagggaacagcccaaaccagggcacaggggtgagaggggacacgggactgtggtgagacagacatggctggagcagcaggactcacgcctgggctggtggggcagtgttcacggcacagcatgcaaatagcacgtgcttgataactatgtaataaataggctaaaaactggaatagtagcttgcactaacaagataagacccaagggaagacacatcagatgatatggctgggctctgtgtctccacccaaatctcatcttgtattgtaatccccataatccccacgtgtccagggagggaccaggtgggaggtgattgcaccacggggcggtttccccgtgctgttctcgcgagagtgaggaagttctcacgagatctggtggttttataaggggctcttcccctttcacagctcactcttctctctcctgccaccctgtgagaaggtcaagcttgcttccccttcaccttccgccatggttgtaagtttcctgaggcctccccagccatgtggaactgtgagccaattcaacctctttcctttataaattacctggtcttgggtatgtcttcattgcagtgtgagaacggacgaacacactaggaatgcaggagctctttcctagtgcctgtggtcagaataccctttccgagtgtgccaggattcttctctctaagcagtgtagccactgacggtgaaaaccacccaagaagtaacaagcaccgtcttcaagtgtccgtacttgggatctgtggtgggttgaaggccggggctcagtaacacacatttaggcctttttccacagaacctaagaatgtcgccttatttggaaaagaagctttgcagatataattaaattagggatcttgagatgaggagagcatcctggattatgcaggtgggccccgaatccaatgactgctgtttttataaaagactcacagaggagcacacagatacacagaagaggagagggtaatgtgaccccgggggcagacactggagtgatgctgccaggagcccaggaatgcctacggttgggagagacaaggaagaggccctcccttgagctctgggagggagcacagccccgccgacaccatgatcccggccccaggacctcagacttccgatctccagaactgaagttttaggactctatatttatggtgatttcttactgatggacgttctaggaaggcatggagaagcggatcttcccggcagccaccagcgtgtgagcattttgcctcgggaaactagagggcagtagtcatgtgggttctcatgaacacgccagccctgctctctctcctagctctgggcccaaggccttggtatgtgcagctccctccaactgaggcacccttcccccaggggttccatggtcagctccttagccgactttatatatatggaggtctcaacataaagtttacacttgttcagcaccatgaagccgccagtccgacacccattcccagtacccttctctcacacccgcctccactagagaggctggaaaggagaaacgctcactgtcccaccctcccttgcagctacagttgtccatggggcatagatccacccaccagctcatgagaagtctgttaaagaagatttaggaagacttttctttccatttatttatttatttatgagatacagtccctctctgttgcccaggctggagtgcagtggcgcaatctcagctcactgcaacctctgcctcccaggttcaagcaattctcctacctcagcctcctgagtggctgggattacaggtgcccaccagtacgtctcttttagtagacacggggtttcaccatgttggccaggctggtctcaaactcctgacttcaggtgatctgcctgccttggcctcccaaagtgctgggatgacagacgtgagccaccacacaggccgggaaggcttctgcttttctgataggacagaaaagtagaaggggctagatggggctggtgccacgtttcctaccatgagcacagatgtggtgcctggagctacagcaaccattttgtgaccttgagggggcaaaaaaaataagagaccccggccctgatccaatgtcacagcttcccactttcagacttctgatcaagtgagaaatgaagtcccccttgtttacgccacctcactgtcagatgccgtcattcctcactgctctgtttcctcacccaagaggatgtccctaacatctctgacttgcgtctttccctccatcatctctaccacgtttctctgatcgatttcccttattgcacaaactaaaattatctcattattgactgtctgcctcctctacgccaccactgggatttaagccgcatgagaacaggaccttctcctagtcaccagcctatccccagtgcctagatgggtacctatgaacacgaacctccccaccccaaagatttgttcaagccagggttgctcagtctcaacactgtcgaaactgtgggctgcctcatctgttgcacagggctttcctgggcatggaaggatgttttgcagcaccgctggcttctaccaaccagaggccagcagcacgtccccacccccaccccagctgtgataaccaataacttctccagacattaccaatagtccctgggggcaaaatcatccggttgagaaccgctggtttaatgaatgggtttaatgattgcctgaaatggcctcctccaagtgcatgtggaaatgatacaatattgaaatatactggtagatgagaaagtcaggcaccaaaaacaaaattattttcatgccacttagaagaaaattatttattgtcacatgaatcacatgatgctatggtcagtgggccagcatatttgcgtacgtgttcctgggcataatttgagatgatatgatatggtttcagcatggaaaagggccacattcttacatttcccacctccagtggaagctgaaaactccacagactcgtgtcggttggacgactcggaatgtgcctccaagtctcatcaatgctcggagaattctaagataattcccttttaaaccctcaaatctctcactcaaaatgctctgctctaattctaaggaaatttccacagatggagacaaagataaatatgtgctcttggccaggtctgcatctcacaatacgactcattaaatcaattaaatcactcgcttggcagcattatttatggaaataagaaatcgttttccatcagcaagtttgagggtggctaaacaccgcttcacagcggtagggtggattgagctcaggctcacataattatgaaccaaaacttccatcttgtgaggcctcttttcactctcccaagtgcttccaaatccacttaggaccttgtgtctcccagaacagtatctccttttgcagaggggaacagcctcacagcatctctatgtgcagatgagaactggaagcagcacgtgggcaagttgccagctaagccagaaccagaactccagattttaacagcaaaacctccacggggggttgcagaggccagtctggcaggcagggaggtagcagctttggggaactgaagaaccactgctcccctctgcaagctgattgcagccgctcagaaacagaatgggtgtcgccggagcctctcatttcttttctcaagacaactgtcagaaattcagcttatgataggaaagttttgcactttgggttgttaacattagccaccaattcaaaattgaaaacacagcgtttacaggccttatcctagtatttagatccacacttcgtcaccttcacactttcctctgcccaaattccttcattcctcaggaagccacctcaagtcgtttccctctcagggattcgtgctgctcccaggaaacaaaggaagacccagagaaagaacagtctgtctcagaaaaagggcagagatttctcaaaggaagaactcccactcgaggatggaagaatcaccagtgcctgtcccgcccttcctgaaggaccaggacttgggctaagttgttagaacatccacacatcgctccccgtttaggttcctggtaaacagcaggagctgctcaggcagaggaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggcacgtgttagaatcagttaaaatgatggcaagactgcggtttctcctgcccaaccacagaaacagcgctgagtgccaggacggctgtgacgccgacattagttagctttaatagggccatgtctgccctttctttggttgatggcgttcccagtagtttcctagtattaaagttatcaatttaatgtttccaaaggcccacttaggcttttctttcacatctgaaaagagaataatttttcctttgaaaaccttggtggcccagagcagctgcctctctccccttggtctgtgttgatcctctaacttagggggtggcacaggagggggcagaggtgaagcccagtggctgtgcggtccctggggccagatgccgacgtccaaatccccacgccttgtctttcaagctgtaggaccaggaggtgcctgaagccctctgcgcggccgtggtgtctccctcgtaacaagcgcaggtcatcacagtgcctacctcacgggctctttcgaagcttcagtgaacactttgagtaagatgctttgaacctttcttagtacagaggaagctctcaaaatgttggctgtggttacagacacgaatagtgttaataactagcattaaaacggaaaatgaaattctgaacataactttattttagaaaatagcacgatacactgaacttcggtttgaaaataaagaaataattgggctgaagataagcttaatctgtgatggaaggttccatacataattgttccagggcctttagtgggagcaaaattaattttcgtgtaagatgattaagctgatgaaattgctcttgagcggtaagtgtgtttaattaaatgcaaagcatcgctgagctcaggtacacattgtccccggggagtgtcctgttctctgagctgtttccttgagcagcaaggttggttctaggcggtgtgtttgttccccatcttccttggtggctgaaatgtctgtgatcgagaataacatcgtgagatgcccattgttctggggcggagtgtacaggcatgacctgtgcagcctgcaataattcaaaccaactagaactgactagaaagctagccaggtccccacagggttagacttcctggaacagaaacgccaggaagttgagggctccctcatatgtcaggaatttatggagtgatccaagcgtcttaagctctctggaattattttattgatttacatctctggagaatggagcagcctgactacgtttcctgggggaggttttcatctcggctttcaattttcacttgttaatgatctgtcatttgtagctaagtggagatacaagaaataaaatacttcattcaacaaaatagttagggtgcgggtcccatgagccaggtgccattcggggactgggagtatagcagaggacacggtagtcccagcccccgagctgcccagactcatctgaatgagcccagcctgctgaccaggaggaaatccactgacccggaatggtgtagacacttgctgtgtacaaaagaacagcaattaaaggggtgaggtacttttttggtcagttttgaaaaaaatgtgatacttagttgggtttttttttttttttttttttttttgaggcaggatcttgttctattagtctggagtgccttggcctcccagagtgctgggattacaggtgtgagccactgcacctggccaatagatttttttttttttaagatggagttttattgcccaggctgggatgcaatggcgtgatcttggctcaatgcaacttctacctcccgggttcaaacgattctcctgcctcagcctcctgagtagctgagattacaggtgcctgccaccatgcccggctaatttttgtatttttagtagagatgggggtttcactatgttgcctaggctggtctcgaactcctgacctcaggtgatctacccgcctcggcctcccaaagtgctgggattacaggcgtgagccaccgtgcccggccaggcttttattaaaagagcagttttaggtttacagaaaaactgatcaaagagtacagggagttcccaagcaccccctcttcctgaccccacagtttcccctattattactatggtacatttgtttcagttgatgatccaatattgatattgtattattaactagagtccatagtttacattagggtttactccttgtcttgtgcattctatggcttttgacaaatgtgtctctgtcatagcatcagaccctgtagttccactgccctaaaaatccctcctgttctacctgttattccctccctgctgctcacccctggcaaccactaatttttttttttttaacgatctccatagttttgccttttccgcaatgtactatagttcagtggtctccaacctttttggcaccagggatcagtttcatagaagacaacagatggggagggggaaaggtttcaggatgaaacctcagatcatcaggcattagatactcataaggagcatgcagcccagatccctcgcatgcatagttcacagtagggttcacattcctatgagaacctaatgcctgatgatctgacaggaggcggagctcaggcagtcacttgttcacccaccattcacctcctgctgtgcggcctcgttcctaacaggctacctttactagcccgcagctcggggcttcgggaccccgatagagttggaatcatatagtttatatccttttcagactggcttctttcacttagtgatgtgcaatgaaggctcctctatatctctttgtggcttgataatttattttttaaaagtgttgagttattccagtatctggatatatcattcattcgcctatgaaagacatcttggttgcttatgggagtaattctaagctgaacttaatcggtgtctattcccaaacagggtggctttaatgtgtgtccatccggggagaccctggagaaatcaagaaggcaagacattggcgatttctgtgctctggacaccaatttcgtgactcacaagttattcatccaatactatctcattctagcaactagatgttggtgaagtcactataccaaagcagctggggctgggttcagaggacattagaacccatggtcattaagtttgcattccaagaaggctgattttcccaactgtctacacagtcaatgccaaagtccccaaataacttatttaccaaccagaatattatcttcttaataaccaaagtcagtaaagccggcaggacccagggaatctgctcatccctcctctcctttcccatgagctgtacaggaaggtaccccaagccaggcctgaaggtttctggataaacaacaaataggaaagaggacattgttagcagaaggacatttacaccaggacatcgcagctctacctcattctgttaggcatcagggttggttctaaccaagtcccacaaatccctttgctcccggcagacagtgcagggatacattgatcaattctttatcttcattaattttaggattccttaactgtggcctgaagctttggttctaatcacattactcttattatatgttcccagggttggtttacattgctttcattttaatgggggctgcttcttgaactcactaattgcatgactaattacactaaagcattgtggatcctccagtccgatgtgctgtctcaggcacgcatccattcattcattcactcgaaatgtgtcaatccagtgtttcctgcgttccaggcactgctctaggctgggagggcccatgggctgtgagaccaacaaggactctactcccagaggcctcccattccactggggcaactggtgataagcattttaaatggtgatgggatggggagatgcggtggggctttagcctctgctgagaggtgatctgaggacaggatgaggcagcagaggcaggaaaacagggatgcagctccgcagaacatctcagtgcaaagattcgatggctgtggagtgtggaattttctatatatactgctatgaacactttaccattttaacattcaaatgcaacctggagccaaagagatggtactgaataggcatagcgtacacaccttcatgattctctgctcttctgtacccagaacaaggcgacaagacaccatccccaaggcattactaggtgtgtattggtttgggtttggtttttactaaaagtggcagaaaacctaattatattgacttagtcctaaaagggaatgtgttgaaacacaactgaaaaacccagctgtaggtatccagcttcagttacagcttgatccaggggctgcagtaatgctgtcaggacttggtttctcctcatagctcagcgctgttctctgcagtgctgactccacacccaaactctctgtaacgccaggctgacattcctaccttgctgggctcatgtcatggggctggctgatggtttagtgttcactcatttccccatccattcatttcttcaatagtgtgcgagtatctggcacatactcaacactgggctaagagctatgtggttattacctcatctagtccatttaagaagcccttggattaggggatactattatacctacttcacagctgagtcaattgaggtttagtgaggtccaatgagtgttcaaggtgattcagctggtaaaaaaacaaagctgggtcctcgcacctgcacagaaccagctggtaaataagatacatacaaccgccaatctccacgtggttctagttctgtgaggaccaccaataggtagttaggaaattaggaatctgtgtggtgctcaagagtgccagtagggaggaaagatgacatgagaacacagatgaaaggtcttagagggagggcttcctgggcgaagtgacatctgcctgaaagacaatagagccagccatgtcgggacaaggagtatagaccagcctcattgggggatagcgagtgtgaggtctggccgagagaggccaaagactccgtttgagatcttggaaggagtagttcatcataaagcgtggaaatggagggtggtggcaagagatgaaccttgagggcttagcggaaccaggtcacgagtggcatggtaaccttcactcggaggctggaaggcagaggggctttggcaggggagggacatagatttccgttttgcaagttggctgtgtggagaagacagtagggggtggtagagtggatgtagggggccccagtaggagaatgcaggggagtgaagtcagaagctggaatgtagagtggggaagggttgggaggacgataagatgtgtgggcattcatcaggtccctttcagatgttaggtgggactgcacccctgggccccatctttccatctgggcctgtgcatgatgcatggaaacagtagcaggtgccacaatgagatagcattgtgagtcacgaattggtgtccagagcacagaaattgccagtgtcttggggtgcagctctcaatgccagcagtatcccctcgagcttctccttcctgctgatgtgcagtgacctgggtggtggccattctgtcagcttgggtcccaggtggggatgatttggagcagagctgcagacacagggcaggtgccaccaatgcacccaggtgatcttaagccactgtaatcagaattatttgtaaccacagcagagtccagcctatcctcactgctacatatgggaaggcaacagagaggttgaagacttcattcatttggcatctcaacaagtgtttcagtagctcctttggccggatgctctcctgggtgcttagaatacgataagcagggtccctcccctcctggagtgacagtctaatggggacagaggtaggtccaggcgctggcccgcctggcttgtggtttttctacagcagtaaccagcagcccatgcagtggatgtggagaaaatgaactgctgagcttcctgagactggaacaaagcaatctgatgaaaggcatgtccttaactctcaagaaaccctggaaggagaacggcaggggatgggctccatcctgcctggtcccctggggcagggggagctgggctgtgtcacctggctagggtcttctcatctctgaatctcagctcccttttttttgtgtgctctggattctgtgactttaattaatgtgctggagactctgttgttactggaaacagaaaatgatttgtttacaggtggagtcagccgggtgtggtggctcaggcctgtaatcccagcactttgggaagctgcagcaggtggattacttgagctcaggtgtttgagatgagcctgggtgacatagtgagatcccatctctacaaaaatatatatattttttcattagccaggcatggtggtaagcactggtagcctcagctacttgggaggctgaggtggaaggatagcttgaagctgggaggtcgaggctgcagtgagctgagatcacgccactgcacttcagcctaggtggcagaatgagaccttgtctggaaaaaaaaaaaaagtcatctttaaagagaggcaggtttctttgcattggatgatgtgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatcacacacacttcccgacagcccaggacagcactaatgactcgtttgactgtaactggcactgagacttcagtatcaacagagcccattccacgtcgacttgtctactttaaaaaataataacagaacaaaatgaaaccaacaaaatggaatttaaaatacataattgctttagtcatgaagagtaacgacattaagagccattttaactagacatttccgcacaaataaaattaggccgagacagttagtcttggggtcctgaccaaaaatgagccctgagaacttgcaggcctgtttgtttcaggttggatcctgggtaacaggcagggctgtggctgactggagcagacgtgaagcccccacaaggctgcataggaggttccggggaacagagtccccaaacatcacaagttttgccatctctgtgcccactgttaactgaccctctttctttaaatgggcttgtgttttacatacataattatattgaaaaaggaaactacatataacacaaaactgttggttaattcactagttattttgtacataaattcactattcactaattgtacgtataattctctactatttttcatatatttatatataatatatattttataatagagatggagtctcactttgttgcccagggtggtcccaaactcctggactcaagcgatcctcccacctttgcctcccacagtgctgggaatacagaaatgagccactgcacctggcctactagttatatttttcctaataattgtattttttccaataactacatgaccatagctagctagggtttgttgattgtttttgtctattttattgcctgtacaacactcttggaaatattgggctagttggcagatttaggcaatgcctccactaggctgatagtcgcaaaattctccacaaaaggcatagaagacaaaatttctctctctctgaccctgctcaatgcttagatgtaacctctgttcccagagctcatggcatcgagtaaacagttcttgcctactaagccctgcaggtaggaacaagaagactcatctaacagagaaaatgaaagaacagatggcgtggactgaggtctggggatactgttggggccatttccttctagtatcaatggtttcttatctcaacaaatatttgccaagcatctgtagtgtacaaaatcaggttgctgggctacttacacaaatacatataaaacgaaggtcaactgaatactattaaagactgaggtaattccatcctgcattattgaatttaaaaagcatattatgatgaacacacacatgtattcccctttagctttttctatatatttcaacacttatacaaatagaagcacttttattttactttaagttcttggctacatgtgcagaacatgcaggtttgttacacaggtatacatgtgccacagtggtttgctgcacccatcagcctgtcatctaggttttaagccccacaagtattaggtatttgccctaatgctccccctccgtcggganggacgggcngaannannnntccaagnggacagaggcgcggggaagggacggagggagcatggacaagtatagtgcccagcgttaggagggggcacagttatgcatgggtgaggcgcagttagacaactgttgtcatctgtgtgtgcatctacatatagcacaattgttcatcaaacagcagcaagtgccttcagtgggcataagctgcctcccataacctcttagcgctcaactccatgcacaccaagctgtaccaccaacacctgcatttctgtgcctgggggctccatctagctgagacccaagcctgacctacatgcagggcaagcaagacatgctgagcctccatgcacctgcaagaccgcctcagccaagtgaagagtgctggtggataaataccccagctccctcatccctcaagcagataatcccacggtgtacaccacagtctcccagaggttccacagcaggattgagtccccatcacccacagtggcaactggctggataacacacacccattactgacttcctgccctgccctgtctcacttccacactcccctcccaaaatttcctggggtcaccttcccatgaaaccacttttgctggaatacttatcttgggcttgctctaggagagcccaggctgagacactcagtatagctacactgctgggtgaaacacagcgatttacaaggctgaggttgggtgccaatgtactcataggaaataacaggcaaaggtctctaggaaatgttctggaaatggaaaatactaatctgcagaaaaatatagttttctttaaagcacatacaaaattataggacagagtttcacatatgtttggaaggtccaaactgatgacagtggttagcttggtagaagagtcaagatacatgagattttacaaattaaatatataaatttagtatgtaagtaatgaaaattaaaagttgcagaacagattatgtgtgtacttggacatgcacacatggagttgtgtgtccacatccacttttgtctatacacctgcctctattttacaccaagacgtgtgtgtgtgtgtagatttgtgtatgcgtggggaaaggtctgagaattctgaaaagaaacaccaaactcttcataatgattgccaatgggaattaggaacaggaaatatttatcaggtgattttaatgttttactttatacatctctgtgagatgtgactttttcagtgagcatctgctgcccttcaaatctgacaaggtaaaataattttgttttttcttttactgtactgatttaattcactttaactaggattatatttgggtttctttgagacggagtcttgcgctgttgcccagaatggagtgtcatggcactatctcagcttactgcaacctctgcttcccgggttcaagcaattctcctgcctcagcctcccaagtagttgggattacaggcacacgaccccacgcccagctaatttttgtatttttagtagagccagggtttcaccatgttggccaggctagtctcaaactcctgaccttgtgatccgcccacgtcggcctcccaaagtgctgagattacaggcatgagccaccacgccagccgacctatctgggtgtcttaaattgatacataataaatggacatattattggggtacacgtgatattttgatacacccatataacgtgtgaaagtcaaatcagggtaattaggatatttattacattaatctttttatgctaggcactttcaaattattctcttgcagcaattttgaaatgagcataactttaaagctgctcacacatactcacaacccctgtgaaagtcgttgataacttttccaactcagatctgtgaataagcatcttaatatgttttattgacatagaggggcgccgagaactgtctggatggaggggaacgacagagccgttgagaatggtcattgtgggattagacaggaaatgctgcctgtggagagattaaaatttagcagccagtgaggtgtgcttcaggcagctctaacttcctccagactggagctactctcagagagcctcctcttccaagtcaaatgtgcagcccatctcagactcacgaactaggcccactctttcaaacagtcatgaggacctattttctaattgctctcccttcatggtgaaataattcaaacattccattcccttctagagtgagaacaagagctaaatttaaatgcaatagcttaatgatgcatctgcaattccaagcagccaacaatctatcaaaaaaagaccagctcattccaaatataggaaagactcatacacacatacatcactccactctagcttccaaccccagaatgaccaaaatttaaaaatatcaaaaaagtaataagccctcaaaataatctgcttgtgatccctaggaggactgattggcttctgtatcccataggccaagtataataaatgcactggaaaaaaattacaactaataacccacaccactcagttgaaacacactctttgaaagtgttcttaatgacacaatttgtctttttagggcatacagataaacatattgtcataaattatattcattgaagaaactgataccattatattaataatgaaaatgaaagggttttgaaatatttttcaggaatcttacccacctccaaggatgctgcctttactcattaagtgatgattagtggctctattgtaatgagaaacaaatgattaccaagtgtatatcctacattggaaagagttaagtttcacatcagaccttttctgccttcttctatggaaaatgaatgcataaaataggaatcagaggactgggtgtggatttaggtctactgaacacatactggctggatccattaccatcattatcaccacgactaccgccagcatcaccatcagctcctccatcaccacgactaccactggcatcaccaccatcttctccatcacgactaccgccagcatcaccatcagctcctccatcaccatgactaccactggcatcaccaccatcttctccatcacgactaccgccagcatcaccatcagctcctccatcaccatgactaccactggcatcaccaccatcttctccattaccatgactaccgccggcatcaccaccatcttctccatcacgactaccgccggcatcaccaccatctcctccatcaccacgactaccactggcatcaccacaatctcctccatcaccatgactaccagtcatcaccatctcttccatcacaactactgcttcatcacacctcctccatcaccacaactatcgccggtatcatcacgatctcctctgttgcgatgactacctaccaccaaaatcatcaccatctcctccatcaacacgactaccaccagcatcaccaccatctcctccatcaccatgactatcagtcatcaccatcatcttctccatcaccacgactactgccggcatcaccaccatcttctccatcacgactaccgccagcatcaccattaccaccattatcaccacgactaccgccagcatcaccatcatcttctccatcaccatgactaccaccaaaatcatcaccatctcctccatcacaactaccaccagcatccccatctcctcgatcaagtctactgccagcatcaccaccgtctcctccatcactacaactaccgccagcatcatcaacatctcctccatcaccaggactacggctagcatcatcaccatctcctccaccaccaccacgcttactggaatctgagactcagactcatttgccaagcccaagcaggggcaccaaaggtccagctgattcatcttctgctgcgcgatcaaatgcaggtggaacagtcagtgccaccagtgcctagccagccatttccgggttgaaaacctttagtaacagaaagcagctgttattcttactacccaagattgtctcatgatcacacagggtgaaatgaactattgccctgagttcagatcacacctctgcacaggaaacctcaaaccaaacatttcacaaggaatgaagaaaccagcctagagttctctcctgaaccctgaacctgaccatcgaactgtggattttcccgtgtatttaggtgtcagtcgggtaactcaaactcaaaactgggcttcggcgcaaacctgaatgtgaatctccccacacttctactgctctctcagtctttctcatcctaggaaatggtcctccccttccaccatgcagcccacgccaaaaatatgaaggccattcttgtcacccccttgcactccctctcagcccagtctatcacaatggctagcaggtcctgctgccccaatatatccgggacctctccaatgaccctcacgtccactaccatcctggtgcaggccacccttgccagtcatgtggactacatggtcgccgcctaatcctctttgctcccacgcttacctccacctccattcagaactggaagtgatcttattaaaataaaaattggatcatgtcactctccacctaaaatcaatcactactctctggacattgttcttgagatttagaatcaataccctagcacagccagccctgaggtcctgaatgaactgccctgtccatctgtccccatctgtgctccagacacccagattttcaggcatcaagttctttcttgcctcagggcctttgcacggctgttccccatgatgttcctctctctgtgagggtaaggaacacatctgctctgtttactacttagtcctcttaattaggggacatacagttggcactcgataaatatgcctcaaataaatcaacaaaccatgaaagaacagacacagcccctaactgatacagaggaatactgcttctgagaaaagaaaggacgacttaccacaaagtttctctgctgagttcctggtctcaggagaggaagtgggaaatttccccagcggtctcccaaagcttgggtctgatcgaatgtggcctcagcacctgcaggcttcaggtgtggcgggtcatttccaagctgcgggaagaagtagacacaatcttctgtcaccaaagaatgacttgcaattttgcttgtctgcctccttcaccttccttgatgcttaagagccagggagaagcaggaattctgctaccattttccagttcagaacactgagggctgagtgagggacagatttgaaactgaactcatggtcctcccagcctgagatttttctttcccttcaaccaaatttcctggtatggaacagtgcaacaatacaacacagccattgacatgaagcttttgtgactccttgagtagaccatcaagttcctgaatttgccaaaagaaatgcacttagggctaattatccaggatagacagatgatagcaagggacagaattgagggcacaagtcaataactgggcatgcactgcacatatccttaattatcaagatgtgactgatgcccagccgatgacagaaagagttattataggtcaaattaattaataaaaataaatataaaaaccaacaagcatgctacacatagtaaactcttaaagaattcccaccttggccatcaaatattcaaaaacaaaaattcctgtatatcagtagaccttcatgttgacatgcacaatcaaaatatcagaaatttctttacttctgttttgctaaaaagagttattaacctgctcagaaccacagaataagatgataaattgaattaacttcggtttcatcaaaaagcttgctgatatcctgcatccatatgaaccagcaggagtgagaggaaggataaaaagcaagtgaggctttatcctagaacttggagctgaagaaccatctgtatggtcaaaattcaatttatttcaatttagcaaacatgttctgagcacctgcaaagttcctgacagctgttaggcccaagcatgagtaagatcaaggccttccaggactcttcgtctgacagggaataccagaacaggcatgcataatgttagttcaagctagaatctaataaaatttagaattttgtgcaagcaatctgtgagggaaacacatctaggcaggagactgaagtttattttctagagatatttaatgagggagctcaggactcacatgcagcaggtagaggtcataacagccaagtgctattatattgaaaacagaaattagacagtccacctgtggatacccctccccagatccaatgcattaagcaggtaggtggatgctacccctcgacgcactctcaaactaggcaagagactggaaatattttggtagaaaactacaatccaagagcaaagaccatgtttgacatgaggaattctacaacaaaatgtgttcagctccctcacagctaccctggagtgagctcaccactgacctcccccaacctgtcaagactatgctccaaaagcagtcttggagtaccaaggagtacagcttcatttaaaaacctctaatatggaagagtaaaagaacataatgataaaacccagaagagagagagantcatccagccaaccaatcaagctttaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaccatgaccccatttaatcctcactctgcgagggagaactattaatactgttagctctaactcttggatgaggaaactgaggcacagaaagtggaagtgattcaggcagggacacagtgggcagcaagggttcaagcccaggtagtatttcttaaagaggtcaccaatttgcataagcttcaggccttacaaagccagtttcacattaacatcaccaccaccatcatcaccatcgtcatcaccacctccaccatcaccaccattatcaccatcaccaccaccaccatcaccattatcatataatcatcaccatcattaccaacaccatcatcaccatcgtcatcaccatcaccatcatcaccatcactatcattaccatcaccatcattatcaccatcatcattactatcatcatcaccatcaccaaaatcatcaccaccatccctatcatcaccaccattatcaacgtcacatgccagtagtgagatgtaaaacaaatgaaattatcatgcattgctgatggaagcttggaaagagagagaggaaagagagtggaaagaacaaagggaggaagagagggaaggaggaagggagtgaaagaataggggggagaagaggaaattggagaggatgggagggagggaaggcaagggaaaaaaatcccaggaggtggcttgggccctctggcccttcaatccctaggggcaaagggctctcggatgtggggcagggtcgggaggaggagtgctacagggatgtctccctcacatggcagacagaaagggtgagtgctcaggacagcccaagaatgatgtgcagggtgggcccaacctcccatgacccctgcacctccctcccagcaggacactgcaactctccatccactcctccccactaccaaaagaacacaaaaataggaggatggactgctggtgctcggtggtccacaaacagatggctccctttcaactccagcctcagcctggatcccgcctgggtatgaatccacctggcccaggtagcaaggccagatacaggaggggcacccaggcctgtctgcgggcaacaccagcagcatcaccactccatggtcagcttggggcatcctgctcttaggatcaaacactagtgtcagaggcgtcctaatcagagtgagtctgtctttaataaatgtgggatatagccatgcctgcagggttacacccccagggggtaggcactcttgggcacaagatgtttatggttgagggaacaagttaatgatgctaactaaataaagacgcagaattttatggcaatctcttaatattttaagaacaaaaagcattcttagtttaagagtaggttttgatttaaggttaatagtacattcgtaaatccttgctgaaatcagtagtaacataggaaaataatactaatagcctgtcagaagctgatcaccagcctctgtaataaagcacaaaagacctctcttcttagctctgttaacctatataaataagaatcgtatttaaggtgtgcgcgttccttctcttgcttttggaggacatcctactctgtaaccgagtggtctctgataaacgattttaactttactatactctgccactcacctggaattgttcctcatccaacatccaagaacccgctcttggggtctgggacaggcctcttattccagtgacattaggaaggggttaaaaaatgaaaaaaaaaaaaaaaaagcacttgcctttcaagatgcctgcttggtccttctccaagtatcctttccttcctttcattcatgttctaaagccttttaataaactttcactcctgttctgaaactggctccgatctctctttctgcctcatgcccctcagtcgaattctttcttctgaggaggcaagaattgagattgctgcagacccgcacggacatgaattcaccaccaggaacgttttgatgccatgactcaaatacgtattttggtgctgcatgactcagatctgttcctggtggtaagacacctctatgcctcaccttcttcggctagagatgctcaacgcctgtacacaattttcttctccccttttgctctcctgtttactaaccaatgcccagaacaattccccttcgttgtaagtgactctgctgatctctcagttcaccctgatgggtggcttgcaggggtgggaagaaccctggggtctgcaccgagtggaactgaggcactgatggccccctggagacagaagacttgtgagggtggtggggctaaagcctaaagcctaaagccatgcaatgtctggggtttcctctgcttttgcaactaaaatcagctctttcccaagaacccacagtgcctagtctcctgctttctctgcgtgtgttctgcctgtggggcttttaaacactccctggtattccctggtgtccacagctcttactgcatttgtgtggcaccaaagacatgggctcccttgtggatcccccctgagatttatatttgttctcaccctaccagctcagatgacctcccacccttcccgtctgctgccgcactgccggggcagatactcactggaactccagccctgtcagctccttatgacctaccatgtgatttccatttctgtaaaaaggaaaagaaaaatgaggccgggcacagtggctcatgcctataatcccagcacttcgggaggctgaggcaggtggatcacctgaggtcaggagtttgagaccagtctggccaacatgatgaaagcccatctctactaaaaacacaaaaattagcccaggcatggtggtgcatacctgtagtcccagctactctggagactgaggaggaaggatcacttgaacctgggagattgaggctgcagtgagccaagatcacaccactgcactccaagcctgggtgacagagcaagaccatcgcaaaaaaaaaaaaaaaaaagaaagaaaaaatgaaaaaaggaggctctatccccaggttctttcttcaccctggaattctccacaactcccatgggagcagggctgggagacagtgcaaaagagtcttgaagccggacaacagcgggggattccagcactgccattctctactggaatgctcagctggatgcttgaccctggagaaattctttctctctctgaagttttccttagtggagagggagaaaatgaaaaaatatgcatatgcctattttgttaaatgtaaggtaataatagctattaagattcaactatttgtaagaaggtgagagttaaaagacagtctgggagacaagcacaacaggcaggacctgacatggagcagagtgctcatcagattgggtttttctcaaccttcagtgatcaccataaattttctatgactttctattcatcccatctatatcattcatcatttgaatacttttggctgtttaattaaacacattgactcacttttcttttttacttaaatatgttttaaaggaagcctcatatctcaaccaaaaatggaaaactaatatatccattgccattaataaaaggtaacaatataataaagaaaattcaacagtatcatcaaactgcagctagcttgtacagtcagttgaaggcgtcatgcttgaggcccacttctgcctttctctttttcaaacaagaagtttagaaaggttagagattgattggtacccaaaggagactcccttgttgatttaattattagaaaaatgggtaattaaaaagtgattaacttcactatggattcaatgttatatctgttataaaaaatattaaaaacttaaaaataggcaaaaacaaaccactaggtgtgtctctgtggttggctttctattgactgaactattttacaactgtagaatagaagttcatgtagagaatacagcagtgtgcatgcttcttatctgagagcaacacaaagcttcctctatggcaatgtaatcagtgttgttcactgtagatgcaactgatgctcatgtctaaggaaagatgatcccaagtattacttacaccttattgtcctgtaggatgttacccaagtttgcatctattatcaaattcatttcagcatgcctttgttcttcacattgtcctttgaaccagccttgacatctgctgtggtctgaatctgtctccccagattcatgtgttggaaatgtaatccccagtgcaacattgtcaggaggtggggcctttggaggtgtttgggtcatgggagctccacccacataaatggattagtgcctctgtaatctggggttttcaggatgggttcgctctctcttgcccttccactttccgccacgtgaggatgcagcaagaaagcccttgtcagacgccagcatcctgatcttgattttcagcctccagaactgtgagaaagaagtttctattcttgataaattgctcagcctcaggtgttctggtctaacagcacaaagtggactaagacaacatcttacaggtaccctcgtttactgatgagttaaatacaacatcttacaagttccctcgttcactgatgagttaaatacaatcctttacatgtgcttattttatatttatagaacagttgttttccaccttttgaaaattacattttagcatccaattgtaccgaaaatcacctcctatgctggttagggtctcctaccaacctcattcaactatctcatttatagttggtactaaggcccagaaggggtcagtgccttctctgagtctgcacagcagtggatgctaaacctgagactacaagccaagttcctgattcgtttgtgtttctcttggccatccgcctccccttaatggctacccaaacctacctctctagaggttccagtcccctctcacctttctggatgtaaaatgtattcctaatctctcgcctctaccctggcaacccacactcctccttactgcttccctaattcccagataatacccaaatacagccttccttctctgccctctccttgcctccctgaaccagaacacctgtctcttaaacttaaccagggtcccacactcctctccaaatactccccgccatgacctacacacccgacacattctggccgctgcctcctctctacctcggtcccagcaatctccccagctcgacacactctgcactcgacccctcactctgtcccttaaactgccaagttgctcctgctccacggcctctgccctcacagctcccacagccaggggtcttctctccactcctccaccttcttcacatgccgtcctcccttcagttggcctctccctggccactgtggtgaacacccctacctccaccacctcctggccactctatcccaataccgtgcgcccaattcttcacagtctttctcttgctctcatttcagagctgtatggggtttcggctggctggtttactgtcgatcttctgcactagaacctaagttccggtgagcaagttccctgtttggcttgctcagggcacctagagccaggcctcgcgcagagcaggtgctgatgaatatttgctgaatggctgcacactgccttagctggtagcagcccctgggtctctgaaaaggctcgcgatgtcagacagggcgacacatgctgcctctgctgctgactgtgctacctgggctctttccttcaagtaacatctatttcatgcccagtacagctctaggtgctgagaaaatgggacttgattacatacagtggctgcagtgaggaaagaaaggggttcgtgccatggaaaccagcaggcaagagaaggtatgctctcagcccagcatcctcagctgacttgggccaccagcctcacatcccctttgtttcattgactatctaagtccactttgcattgctctaaaggaatacctgaggctgggcaatatatagagaaaagaggtttatttggctcatgattctgcaggctgaacaagaagcatgtgccaacaactggtgaggccttgggctccttccactcatggagaaaggggaaggggagcaggcgtcagcatggagtgggacgggggagtggggaagggtaggacattgccgggcttttttttttttttttttttgagacggagtctcgctctgttgcccaggctggagtgcagtggtgcgatctcagctcactgcaagctccgccccctgggttcacgctattctcctgcctcagcctcccgagtaggtgggaatataggcacccatcaccacgcccattgccgggctttttaacaatcagaccttgcagggacccatagagcgagaactcactcattaccacaagacagtgagggggagatatccaaaccacatcactgatcacttccagaacatgggcctccaagacacaggaggttcaggacccagcgtgagagcaaggacacacagccttccagaggagactcccagtgaggccaccccgcactgggggatttcaagccatctgggaaagatctggggaaagataaggtgactattccagccacctccagtcatggagaggcaggcaggtgtatgcagaaagacagaggacaaggtaaaagtgttggggggactcatgtggaaattcaacaattgtgatatttttaacaagttcctattgtcttaatttttttttttttttttgagacagggtctggctatgttacccaggctggagtacagtagcatgatctcagctcactgcagcctccatctcctggactcaaatgatcctcccacttcagcctctgaattagctaccatgctcagctaatttttttattttttgtagagatgaggtctcactatgttgcctaggctggtcttgaactcctagcctcaagtgattctcctgccttggcctcccaaagtactgggactgcaggcacaagccctgcacctggccaccagtccctactgtaaaaaggaaaaaatacacacacacaagcacatatatattacagcaaagaaagggggctggattttcggataacttatctgtagctccgaggacaacccggttccccagggattcattaagtccttcttacatggctgctgagtcttcaccatcaacaagcccagcaacctccccaaagaaaggattctgcagcctggagagggccctcatccactgatgattatgtttcttgctcagaggaaactaagtctagctccctgctaacgcagccttgggaagccaacacttcaccgagaaccctgaatcggcccctctcagaggccgggaaggcagtggggctggcagggctaccgttctgaattcatgtgcaccgactgcgtcccctgagctacgcctgcattcaccgcactgattcaagacagccgcatccattcaccaggctctgtgtcatcaacatcaccctgtgacgtgccaacatcagggatcccccactctgagctcaggaagaccgtcctaggatatttttttaaagcacagtgagagagaaataagaaggccagtggtagtgacagacctaagagtgttctgtccctcttaggccccacgacgcgcaccgctgcgtgctgcctgggagctcattcttaggtttttaggtctttaaagaggctgtgaagaggagggtattccggatgctttgtaaactgacagactttttaattaacataacaccgtgatattatcacatccaacaaaactaacaccaatcccttactatcttctaatacccagtccataataaatgtatctgcttatctcaaaaaaaaaaaaaaattcagttggttttgttcaaatcggaatctcaacacggtttagacaacctttggtatttctcttaagtctctcttctcttttattttttttaacagatgcattaaccttaatgaatcaggaatatatcaaaagagcaagcaggccgggttcagtggctcacgcctgtgatcccagcgctttgggaagccaaggcaggtggatcactcaagcccaggggttcgagaccagcctgggcaacatagtaagatggccatctctacaaaaaattacaaatacaaaaattagccaggcatggtagtgcacgtctgtggtcccagctactcaggggtctgaggcaagaggatcatttgagtctgggaggttgaggctgcagtgagccgtgatcgcactagtgcactgcagcctgggtgagagagagatcctgtctcaaaaaaaaaaaaaaaaaaagcaagcaggatattaaatgaaggagccattttagccagggaaggggccggaggacgcagcacatcccttccgcattgcagacttgcagtctgtctcttggaagctcacagagatctccatgcatcctgcttaagatcaatggtcaaagactatcaatcccatctgcagccaggagatgggagattacatgactctgccaagggacccagacttcctttaagggattttcccaaatgtcctccctagcagtaaggccggatatcaccaaaggaggcgaagaaacgaatgagaaatacgcagtgtccaacagactgacctgtgtgcccctggggtgtcctcatggttcgggttttacagcttttacaggttttcttcaaaaacccaaatatcaaggtgaacatggcacatcctattaaaagggaacacgttaatcactgtgtgatttcagagaataaaaagatctcctgtaacccacacaaacgccaggccccatgtgaaccaggctgtacgcggcccacatagaaagaaatactaggattcacgaaccaaaggtgataaaaagcaattcctgtctttagttgtgcttcttggaaaagcttttagggcatctaattcatagtccatagcaatactttctttttaaaaatctacattaattaattaatttatttatttagttttgagatggagtctcactctgtcacccgggctagtgtgcagtggtacagtctcagctcactgcagcctccgcctccctggttgaagcgattctcctgcctcagcctcctgagtagctgggattacaggtacctgccaacacgcctggctaatttttatatttttagtacagatggggtttcaccatgttggccaggctggtctcaaactcctgacctcaagtgatccacccgcatcggcctcccaaagtgctgggattacaggtatgagccactgcgcctggtcttctactttttattttggaataattttagatttacagggaagttgcagcagtaacatctaacatctccttccctttcaccctcggttcttccgcactttgcaatctgttctgctgcttttctctcactaactccctacccggcccacctatcccccaaaacatactcttcctggcacccagtttctgtgagtttcagtccctcctgggtttcctcctcttgttcagcttttttatttcacagcccacctgagcttctctggcatgttttagttttttctccactcatttcactctaatttccccaccaaggaatgtgctggagccagctgggccggccagagccctctcccccttctcacggctctctgcttattttctccactcggcccattcccctgactccattctgcatgaaaaaagggagcccgggggaaggacctcattctccttagagggtggaggaagcgcgcagtgtgaaaacctccagtacaggaggcacgagcgatgatggagagcgctggaatcgctgacgtcttcacgggtcgcgcctgctgccctgaggagcccggccccaaaggctcaggctggagccaaccaagccagggaggtcatcccaactgcaccctgcggcctccccggccgcgaggagggagttctgcagggcaggcagcgcctgcagaggcggagaacacccgcacagctggggcccctctgctgagatgctgcccaaaataccccgctcacgactgccttccaagctaactgctgaagccgagagttctgacgggcagcagtgggcgtgcatgaagcctgagtcaccatttcaaagcgctgtggcggagcagaggcatctgctctgggcactggcttcccagctggaaggaggcacctcccagcaagtcgcccttgggccaagagccttggagctccctcccggtctcccgggtcccaggacaggcgttttcatttacccatgggtctttactacaacttgcgttaggcactacttccttacaaaaccatccatgggtccaaagacagttctgttagtctctctctgacaataccccaaaacacctctaacctccgtgtgtgcggatctgctgtaatcttggccctcactttgtaataacagcaaacattatggccggggtcagagccaaagtccattctcccgttatttcatttaacgctcgctgaatcaagctgcactgaggtcctattgttcaaacaggaagtagcagtgcaggggacgatgcgcgccgcagggctagaaaaggctggagctggggtcagaacaggctttgcctccatgagagcgctgtccagctgctggtttctggccccagccggctctcctgttactgttctgctgcactgtggctggttttgcttacgctcgcagtgctgctataaaaacttaagtagcacagggttcaccttctggactaatgtaaatagccagagccgaaatattcacgcaaaatgcatttcgtcacatttactgagtgtctatgtgtcaagtaacaccctaagctctgtacgtgtagaatattttttttccttttagatatggggtctcactatcctgcccaggctggagggcaatggctattcacacgtatgatcatagcgcactgcagcctcgaactccaaggctcaagtgatccacctcagcctccccagcagccaggactccaggcacatngctccactcccggcttttatgtacagtcttattaaatactcgctgtggcccaaaaatgtgagcactgttatgaaccatttttacggagaaggaaaatcagcctaggatcataaataagttgccaaagtaaacagtcagcgtgggagccaggtctcagcagcagagcttcttcatgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctcattgtagtctgtggccggatacccacaattttctttgaccaccatgaaaagatgtcctctgcagacctgcaagatttccccttttttctttgccccgtcactgctatgctaaagatcttcatgtgcgcattcttatgttttttattttgtggaatcaatttctgggaatctctgggtcagaatttgtctatgctttttaattacgcctccaagagatggtttctcagaaagactccaggaatcaacattcccactggttctgtgtggagcggcctattgctttttccttataccccagcgctgtctgttactgctcttcagtttttccacatctaacatgtgagaagtgttgtgttgttagggcagagggaatgtcgtcggtttgtttacgttgctcactgaacgtcttctgaggataagggaggttgggcacaaggttggtaattaatcacatggttttcgctgattcctgtgggtgctgccccaactcatgttagtccttggccgtaagtaacttctgtttctttattgtactctttaaggaatgggaacaatggcattgatttcttctgcttccagtcacatagtatacgtgcaactgtgttaccaagtctgaagtgctaccgaaacataaagtgtaggccagcctgttgcatcaggtgagacagcgttcagctgcaagtaacaatagaacctgctaacactgccctgcagagacggggctggcttttctcatgcagaaagtcagaggccaccattgcagggtggcatgagggctgaaaggacctgcctccctccctctctgctgtcattggggtctatggtggctgttgcaccttctggcattgtgctgcatcccaggcaggaagaacggaaaaggccgatgagagctgtctcttaatgagactgagttttttttttttttttttttgagacagagtcttgctctgtcacccaggctggagtgcagtggtgcgatcttggctcactacagcctctgcctcctgggttcaagcgattctcctgcctcagcctcctgagtagctgggatcacaggcacccgccaccacacccagctaatttttgtctttgtagtagagatggggtttcaccacgttggccaggatgatcttcatctcccgaccatgtaatccacctgcctcggcctcccaaaccgctggataacaggcgtgagccactgtgcccggccgagactgaatctttaccgaagaaaggaagaagtctgtgctgggcgttccctgcttgcctcccagatccaccctctacctccttctgtgctgtcctctgcctgcggggtggggggctgggctcactggacttcctcactcaggttctcttgccctgtggcttccaggtggcttggccgatgaggtcgcagtaggagcctggagattgcggcaggggtatctgtgggttgcccactggccctctggcggggcggtcgcagctcccacaattggagtacctgggggcggcgtcccctgccttgttggccccggcaacccgccagcactgctgtcaactctccctccgtcccatcccctcattactcaccaggcatggccttctggctggtgtcctggattctgacagatgcgactttccaaaggacactcgtgaggacaaaaatgtcacctagtcatccttgccggccagggagctgggaaatgtatatcaaggaaggccagggagaaacagctggtgaatggtaacccagggtctaagtagcctgtgcaggtggcgatgacggggggctggagactaggtggaggctgtgtaatcatcggggttacccgggaggtcctggacttgggggaggggggagggaaaggagaagctgttttacccatccggactctctctattgcaagtgacagatcccagctcagccctgcaggctgtgtaccttgcttcacccggatggggtctaagcccagaataaggtaccagtgtctgcatccaggggggcctgcggtgatgtccacacggtttggttactggggaagccagttgtttaagacatagagctgtgtttgacaagctcctccaggtttctcccgttttgcatttacactgtttcctctgaagtcttgccaccacggtcttcaccatcctgtcaaatggtgttttaattattttaaaaaacaccattttcccataatgtgctctcttagcttgggttgctgtacagaataccccagactgggtgctgggctggggacccccaacctggggtggcttttcattaacccagcagccaggccaaactttgtctggattgggctttgcgcacagcagagcagctcacgcatggtgacctttcaacccctggcctgagggcttgtccaagctgagtaaatattcatacatgagagagaaggtgatgctttatgaaaaagccaaaagctggatcccctggccaactgaaacacccggggccgcactcagccctcagaaggcctgttttcaccgtggaaggtgaggctgaggagcgaacaggtggcggcctgttctccagtctgggccggacacaggtcaatccaagcagctgctctccttggaggtcacctctctggcccagagagggtgacttgcgtgactctgagctgtgctgtgtgatgtctgagcacctgccctggcacactgtctctggaagacttggatctgctgcccagatccctgcaggccctgcgcgtcttcagggcaaagactcatgacgccttaactatccaggacatgcttctcagaggatgcattgtatctgcttcgggtatcaatcctgcagccaattggttttccccaactttctacttgcaaagcaacttcttagacctggggtcctctcttgcaggcgccctgcatggcagagaactttttccaccacagccttcgtgtaacaggcagttacatgggtttcatgggtcgacatgggttccgtgtcctgcttgccgggcctgagctgtttgtcaggtgtacaaccgagaaccttgcagaccagaatccaagactccgcagcatgtgtgtgccggggcgggacacgagctgttggaggagaaagccatcagtgtatttagaggcaaagggcttcctaaatcgaggctgtgcaggcctcctgaaggtcctagcccaggctacggaggtaaatcctctccgcaggagacgcgtcgccgccagcatggtgcatctgccacttacacctgcagcgaagcccggtagccggcagccggtgtcttccagcggaggatcgggggcagagatgcgggtaaatgaagcggccccaggtgccctggcttctgcgggagtggaagacaaaagggcccccaatatcctgcaacgtattgtctgatggaggctgtagctcaaagagatcctttacgggagggacgtcaatcatcagggaggagaaggcggctcctggagaggcaggcactgagtgcttcccctgtggggtctgggggacgtggggacagagctcgtgggatgggaggggaatgtgcagttccaggagctgcggcggttcccggtccctgtggtgttggcagcgatgcctggaggccggagcccatgtcagtggcctgaggctgagttcaggctcatgccgctttgggcggcctggctagaggcacaatgctctcttctcctggcctttttgaggcctcctctgtgaaatgaggtgttggatgagactccccagggtgaagtcacctgggagctgatgctgctagagctttagaaatgagggaactcggaggcagagtggccagggactcgctgggcagcaacagcctccaatggatgtgagtttctgagacattgcaggtgttactggggggaggtgacagtgaatttaaagcaggaaaatggccgggcgcggctgcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctacttgggaggctgaggcaggagaatggcgtgaacccgggaggcggagcttgcagtgagccgagatcgcgccactgcactccagcctgggcgacagagcggactccgtctcaaaaaaaaaaaaaaaaaaaaaaaaaaagcaggaaaattactttgatgagtcacaaaatgtttgttagtctcttgtacattgctaggacacattacttagtttttatccttttgtttttatttatcaaagagataagtgtttattaaatctgttaagtattatacaagcatggagaggtttttaaaaaattacctgacttttggggccacacnagatggcgtagaccctcccttcaaagtgtagctttaagccctggaaatggagcaagacttgatgaagagaggaccctggaagctgaactcgcagaggccccagaacgggagggaccgggaggagcaggcttcccattttcccccagaacgggagggaccgggaggagcagacttcccattttcccccagaacgggagggaccgggaggagcaggcttcccattttcccccagaacgggagggactgggaggagcaggcttcccattttccccccgtgatggttgactttgtgccaacttaactaggttgagggatgcccagagaactggccacacactattttttggggtgcctgtgagggcgtttctggagaaggtgagcattcggatcagtggactaaggaatcgtcacaaatgtatgagggcatcctctgattcatcgagggcccaagcagaacaaaaaggcaggggagaggtgaatttgctcccttctggagctgggacttccgtctgtcctgcccgcagatgctgaagctcctgggtctcagacctctggactctgggcctcaaccagtccccctccagtgccctacccccacttcccagacctgcagccctgggctgggagcgataccgttggcttctgcagttctcaagcttgcagtctcaggctgaattcccaccatcagtattcctggctctccagacggcagatcatgggacttattggcctctgtaatcacacgaggaaactccccaaataagtatcttcatgtgtatctatcctgtcctgtttctccagggaaccctgactaaccaccccgcttccatccaacagaagaaagtgacccaggcccaacatttcctgacccccgacctcaccagagaaggtcccccaggtggctcagttctcctctgggggtcggggtccctctgaccatatcaccaaggagggttaatcaaggccctgccaacatcagtgtcaggatttcatttttttttaaaatggctgaacagcattccgttgtgtagagaacacattttcttgatccattcatccgtcgatggacacttaggttgattccacaccttggctagtgggaatggtgctgtataaacgtgggggggcagacagctttgtgacagactcagttcatacgtgggggtgcagacagctttgcgacagactcagttcattttctttgggtcggtaccagtgacatagtgggctcgtggccattccatttttgctttttgaggaacctccatacagttttctgacaacatggatgaacctggaggatgctgcattaagtcatcagtcaggcacagaaagacaaatactgaatgacctcactcatacatggcagctaagaagttgatctcgtagaagtagagaatggaatgtggttaccagaggctggggtgctgggggccatggggagatgctggttaaaggacgtgtaattacagttagacaggagggtgcatttcagatccactgcactgcaagctgaccatagttaatgacgatgtattggttaaaaatgttaagagagtgggtattaagttctctcaccacaaaataactatgaggtaatgtacttgctaattaactagatttaaccattccacaaggtatgtatatgtcaaaatgccacgtgatacatgataaactcatacaaaatcagagtcctaaagaggagtggcctgggcagcgctctgtccccacagggcctgagcctcccctccccggtggagatgcttctccccactgcccacctccccccaggaggagggtcctagcccaacagctcctgacctggggaagcctcttcatctctggggagctgagacttccctcctccccagtagagagacaccagggtgggtgatcagacctgcaagaggcacacgtagcctggactgaaggtctctttggccctgagaacttgaaacttccctgaaggcccagagaaatcagtgtaggcaggaggctacatgcaatgccagtgggctgtgcataggaaatgctgtctgcgaccccctgtggtggtgtcgttggccttcctgcccagcatcctctagtcctaagagtctcttggtttcccattgtcctgttgtgtgttgttttattcagccgtaagcttggagaacttgcccattcacaacagaaaccaaagcgttttctagcagctctttccactggatatttttccttttcctgccctggttcccaggcaggggctggacggtcagacatggaaggttgactggaagcgctgtcctaggacgctgaatctttgagtgaatcaaggaaaaaaatcaatgttttgagcatatttacttcagtggcaagtttccaggttgggggacaggaacttctggcaggtccttttgcaggggaacccctaccttctgcgcctggccctccaaacctctgacccccacacattcccacatcctgctgggagctccccttttggtggagtcatggcctttatttctgatgcttgcacccaacacagaacctaagcggctgtaaaaatggatgcttctgcttggtcagcgtggagagaaaagtggaaaaaaaggagatggaacttgaacctggtggaatgaatagttttctggggctccccttactgagcattccgagcagtttctgaccaatgcaggcttctccttgctggggagtcggatttgtgtctgactcgctctcgggctgagtgtggagaaacagtcgccggtgaggatgacttaaggaggcagtggtttcatgcctgtccctgagaaactcacaggagatgatcaaagcaccatgaataagcagcatgttcccaccgagcatgtggaagcatggttctgggtgtggagacgtggcagaaacccacggatgcacaagtagccacgattagccggggcactgtgtggcaaattcaaggaaagctatcaactggaggcacccgtctattaaacatcatcttaatcagcctgttaaattgtgatctgagcagatgcggtcatgggtagggccctttctccccgcctggaaacatcagcaaacacttagtgggaatgtttcagatgaccgggtctgtgggagagtgagtgctctgcccaggtgcattacaggatttaagctgggactatatacagaaattaaacgtgaagaaggaatactttctacacctcaggctcactggtagagtgagctgtgtttaaagaatttgaactgggccggccgtggtggctcatacctgtaatcccagcactttgggaggccgaggcgggtagatcacgaggtcaggagttcgagaccagcctggccaagatggtgatactccatctctactaaaaatacaaaaattagccaggtgtggtggcaagcgcctataatcccagctactcaggaggctgaggcaggagaattgcttgaacccgggaggcggaggttgcagtgagctgagatcgcgctactgaccctagcctgggcgacagagcaagacttcatcttaaaaaagaattggaactgcttgttgtggtgactcggactgttgcggcctggagacattttgcattatttttgacttcaagcaaaagccaggctgtaggaccagggcagaattcttcacacaggtcatatttagaaggtgaggaggaggctggagagtatctccagttcatgatctctaccgcttgctccaacagtttacagctcatgaagtgcagactttcagataaggtttggatggaagccactaagagttttgctataaatggtgaatcccaagagacactccacagaataccttttgggacttgttggctacagcttccgcctcttcaacctgcactcctccccgcctccacagcgctgatgcggtgacagccacctaaagacctgcctccttgcgtggaactgaggagctgtgtagacgcgcgactccctgcccacgcgtcacgcttgtgcctctctgcaaaccccatgcttccttttttatggcctagcccaggcagttagtggtagaataatagtgagagggggtaatcccaggaatgcaatgttctgactgtgatttttaatttgggagaacgttttttctcagaaacatacagacaagaaaacacctgtgtgtaattcccaccatatagactctcaggcagggccaatctttttttattttttattttttaccatatttacttccagttgttattgttcatactttcaaaaagttacacattaacctttcatttttagcttttttttcctctcttttctttttctttttgttttttgagacagtctcgctctatctcccagactggagtgcaattgcatggtctcggcttactgcaacctctgcctcctgggttcaagcaattctcctgccttagcctcccaagtagctgggactacaggctcccaccaccatgcctggctaatttttttctgaattttcagtagagatggggttttaccacgtagatcaggctggtgtcgaactcctgacctcaaatgatctgcccacctcggcctcccaaagtgctgggattacaggtgtgggccactgtgcctggcccatttttagcttttacttatgaaaaattgaaagcataccttgaaatggcaagaatagcacaatgaacccccacacagcacacagacgcaatcatgtaacagcattgtcatatttgctgtctgcctgtctatcatcatctatttttttactgagttatttcaaagttgtagatattgtcactttattactactttatcatgcatcattaaaaataaaattattttctacacaaccacaatgccattgtcatacctaaaaatgaacagtaattccccaatagcatacggtggtcatcccatattcaaaatttttagttatccccaggacattttttataccttgttattttgattgcacccagatccagccacgcctcatgtatgatgttggcagccacgtctttttagtctcttttagttggaaacacggtttccccgcgtgattgacttattgaagagaccagaccacctttaaaaataaatcaggcattacaagtaaagttcaattctttgatttatagagtctactgcaacacctacccaccctccactcccagaagcatccattatattattaggatagtatgtatctttccagcttttaaagtatactttcacagtcctgtgtcctgagcaatggaatgagttctgagaaaggcgtgctggcaatctcgtcatgtgaaccctgcagtgcacttgcacacacctagccggggagtctaccgcaccccgaggctgtgtggtggagccattgctcctgggctacacacctgtgcaggatgtgactgtactggactttgtaggcaactgtaacacaatagtaggtatgtgtctatctgaacatatctaaaccttgcagaaaaggcacagtaacatgcagtataaaagataagagaaagaggccgggcgcggtggctcacgcctgtaatcccagcactttgggaggccgaggtgggcgggtcacgaggtcaggagatcaagaccatcctggctaacacagtgaaaccccgtctctactaaaaaatacaaaaattagccgggcgtgagtggtggtgcctgtagtcccagctacttgggaggctgaggcaggagaatggcgtgaacccgggtagcaaagcttgcagtgagccgagatcgtgccactgactccagcctgggagacagagcgagactctgtctcaaaaaaaaaaaaaaagaaagaaaaggggcatctgtatagggcacttaccatgaatggagcttgcaggcccggaagttgctctggtgagtgagtgagtgagtgagtgagtgagtgagtgagtgagtgagtggagagtgaatgtgaaggcgtaggatgttccactgcacgactgtaggctttatggacactgaacactcgggccgcactgagtagcctaaaacatgattcaaaggcatttttcaaaaattgtttttatttcttcaataatcaattaaccttagcttactgtgaggtttttttttttttttttactttttaaaaacctttttgactcttgtaataacacgtatcttgaaacacaaagacattgcacagctgcacaaaaatccttttctttatatccttattccataagaatttttttctattttaaaacattttaacaccgtttaaaatgttttaaaaatgaagacacaaacgcacacattagcctgggcctacccggggtcaggatcatcacatcaccgtcttgcacctgcatgtcctgtcctgctggaaggtctccaggggcaaagcacgcgtggagcggccatctcctagggtgacaaggccttcttctggataatttctggaaggcctgcctgagactgttctacagttattttataagtaggagtacactctaatgagaaaagtagagcatagtgagatatctaagcgagtgacatagttgcttattatcacgtatcaagcatgatgtactttgcaggatcatatgtgctaggcttttctaggactggcggtgcagtgggtttgtttacagcagtgtcaccacacacatgagtcatgcactgtgctgcgatgttaccttggctgtgaagtcaccgggctatagggctacagcgagctttcacctctctcagaatcttatggcaccaccatggcaagtatgtgtccctccttgacggaaacattgttcctcagctcgtgactgcaagtgtatcttatgcctgtacttacccatctgtcagtctccataaaaacatggttttatgtaaattttcttcataaatatcatactgggcacatgattctgcatcttctatttttgatctgcattgtgttttgagatgcactggggctgacaaattttccttatccatttctctattgggttgtttccactcttccatgatgaggtgcttacacctgccttccgagcacatgtgttgagtccgttgaagttagtagggttataggatgtgctcacttctatttcaacagagacttcccagtgcttctagcagctgggccaactgactgatgatcctgccagttctgtacaggtgggcatgcttccctgccttgtcaacacttggtatagtcagattggtaaaatgtgcacatctgatgggaacccattgtttacatttgcatatcctggatggctagtgatggccatgttttcatgtgctcatttgccacttgagtttatcttttgcttgtctttttattagtactgtttcttgatatattttgaatatgaaatatggtgccaattttggttttaaaattacgagattgacaagtggaaattgtattgcttcactgaccagtgctgcaactgaaaacctcatctctataaatgagaaatatgttcttctcctcttccgggagggggtgtgttaattattcctgatagaccccttgcagggtgaattctcatagctaaaaagtatcattgtcataattcaatttttgagctgccaaaataacacttctctgtttatgctaaaagaacaccaaatcctattaaaaatggaaacacgttcttaacattgttgattacaatatggtgcaacagaaccaccgttggcgaattcttctgtcatgcgaccgtctacatctgtttgttcaattctttaatgactgttacttacgcatcagacaatgatcaaagtacacgtttgctaccaaaaaagtcaagcaaaagaagtcaatggtagccctgccaatggacacaaggcgggcagtcccacgcttacaggagtcctggggaagcagctccagcgctgccacacaggtcgcgaatttctgggacttgtgcacatcatccaaactgtccttgcaaatgcaagaaacctcccccaaatgggcggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcagtgtcctgaagctgtgcagggcagcgagccctggacctggcccctgaaactattctttcctcctaggcctctgggctgtgatgggaggggctgcctaaaagatctctgaaatgcatctgaggcctgtttcctgttgtcttggatattagcacttgggtcctttttagtcatgctagtttctctagcaagtagtcactccacagcctgcttggattcctcttttgaaaatgctttttccttctctgccacatggctaggttgtgaatttctgaaacttttatgctctgcttcctttttaactataagttccaactttaagtcatttctttgcttctgtatctgagcataggttattagaagcagccaggtcccatcttgaatgctttgcttcttagaaatttcttccaccagataccctaggttatcactcttttaagttcaaacttccataaagccctaggacacagatacaatgcagccaggttctttgcttaggcataatatgggtgatctttactccagttcccttaactttctcatttccagctgagaccacatcagcctggacttcactgtccaaatcactattggcattttggtcacaaccatttaaccactctccaaggagttccaaacaattcctcaccttcctgtcttcttctgagctctccaaactcttccaccctctgcctattacccagtcccaaagctgcttccacactttcaggtatctttatagcaatgccccactcctctgtaccaattttccatgttaggccatttttgtattgctataaagaaatactgaggctgggtaatttataaggaaaacagacttgattggctcatggttctgcaggctgtacagaaaacagggtgcaggcatctgctcagcttctagtgaggcctcaggaagcttccaatcatggtggaagacaaagaggagccagcatgtcacacagtgacagcaacagcaagaaagccagggaggaggtgccacacacttttcaacaaccagaattcacatgaactaactgagcaagaactcacttatcacccagggatagtgcccagccattcatgagggacctgctcccgtgacccaaacacctcccaccaggtcctacctccagcactgggatcacatttcacatgagatttgggggagacacacatccaaaccatatcaacataacccagcaatctggatgcagaaaacacacaaatgacacactagaggtctctacagggagagaatggggtgctggacagaggacaaagaggagtgtgccctaggcggggcagcaaaggcctctccagcgtgtaacatcgccccaccctgccagccagcattacttccctgttttattttcttcattgctcttgctgctgtctgaaattacctcgttatataccaactgtctgccactctgtgagaatgcaaactctgtaaggaccttatttatcttgcctgatgcattgtaactattcaaatatctgtgggagagaggaagacaggacctgaggaggacacatgagagggaggaaaagaccaaggaggggtgggcagggcggagagtcagagaaacaccagcagtggagggaggctctggggccatagaacaggccccaaaccattgatttccactttagggaatttattgagattttctttctgaactaaaaatatgatctatgtttgtaaatgttgcatagacacagaaaaaaatgtgtggttactacacagagcgaacagagttcaattattcaaacattcacacacaggcacacacatgtatatacaggcaaacacagatacatatgtgcacacacacacaccatcaacttcagctctccctcagctcctcgaatttgcccttgtttggacaccatcttgaagccagccagaatgaaaagggagggacgttggcttcagacagagcagctcaggtcaaggcacaggcgacgggaatgtgggcggaggcaccacgcagcccatggcagaggagacaagagggaagatgctgggagagccaggagtgaaaggaggatgctggtgggagcgctgtcctggaatccagcccttctggggaatggaggaagctctctcatgtccatcttagagcatgggttccagcaaggcgcgcctgcaggcttggggctggggacacggtggagggtggggagaagggacatggccagctgctctgccagcagaataaagagaggtttctgtgtgggcccgggagggccaggagcgagagagcgagcctcggtttgtctaatgttctatggaagatggttcttaaaggggttgggggacccggcaagaatcacaagggagccatctgagaggcaccttccctcccacagggaagggagggaagaggaggacgaagtaggatctccagggacccctggcaggcaggggctagaattctgcccgtcccagtggggctgggccagctcctgacagcgtcatacagagagaagctttccctttcatgtcccctctcctgggactaagccagtgcatttgtgtcctgaggcaaacaaaatgccacaaaccaagtgtcttaaacaacagaaatttcctctctcagctctggaggctggaagtctgagatcaagcagccccagcaggcctgtttctttctgaggctgtcaggagaatctgccccgggctccccctgactcctggcagcctcaggcactcctccgcttgtgagcgacctccccgcgtcttcacaccgtcttccctccacgtttgtctatctctgtgcccaaacttcccctttctaaaatttttatgttattaactttctaaaatttatgtactaaaaaaaaaagcaagatctcattagccgggtgtggtggtgcacacctgtggtcccagctacttgggaggctgaggtggcaggatggtttgagcctggggggaggaggttgcagtgagccaagattgcaccactgcactccagcctgggcaacagaatgataccctgtcaaaaaaaaattaaaacggtctcactctttcacccaggcaggagtgcattagtgtaatcatagctcactgcattgaactcccaggctcaagtgatcctcctgcctcagtctcctacagacctgggactataggtgtgtaccaccatgcctactatttttttacatttttatttctagagatagggtcttgctatgttgttcaggttgatctcaaactcctgggctgaagcaatcctcccagcttggcctttcaaagctgggattacaggtgtgtgtcaccacacgtggccaaatttccctcccttaaagaacactagtcatatgggatgagggcacatcctcatgtcctcatcttaactttgcccatctgcaaagaccctatttgcaaataaggtcacattcacaggtactgggagttaggacttcaacacctttgtgggatgggagggccacaattcagctcataacagccaggaaataaagcagagatcaccccctctacacacactgcaggctcccagcggaagcaggccccgggaggagaaagaaaaagttctaagttcagacgaggtcagatgtggtttggatattctcataactaaactgatagagcttgggggatggaagacagagaaagatccatcgtcgaagcaatgcagcggcatccaccggcacctccgtccagggcacaggggagaagtgacccgcagaagggctgtgcgggggcagtgagggcagaggatggagccccagctgcggggggcagtgagggcggaggatggagccccagctgcggggggcagtgagggcggaggatggagccccagctgcggggggcagtgagggcggaggatggagccccagcgcactgggccccaggtcccgccttccactcaaacattttatctcgtttcagtgtgcgatccccaacctctgatgttacacggaaccagctacccaacgagttgttttttacatttcccttttggtgttctatttatctggccttaaacaggcctggctgagaatatttaaaatcagagaacgcacggctggacacaaggcaaaccgtattccacacgcgcatttgcttaggagcagagttcagcaacgtgacgctgcctcccaagggcttgggttgttcccccatcctctctccacgactccgtcccaccttcccagtacttaaaagacgacggcagtaaccaacaatgaatgccccagctcaggagagcagctttgtgaccggaaggccacggcttccaggagcctgaggagggaaggtcagccctgaggagggaacagcacaagccaggctcgcgtgttgacatgaagggttctctgagcccagcctgagcaaatactaacacacaccgcctgtgctggctactgtctagcagccactggtcccgaaactccacacagtcaggccatctctgaagccgccaacacgcacctaccttctgggcaagaacacgaatctgtcatttgcactcgtgtatttgcaatcggtgcgaacactcacagtctctatgctgcatgtggggaacacgcagccatttcaactatgaaaaaaaagaagacggcagacaacagtttaaaaaaaggagaccaggagcatcatatttcactgagtaaattgacaaaaggtcaaaaagcttgatcttggccactgatgtgcttggtctgaaagctaaactgccacttaaatattcataggcaagcgcggtagctgcagcctccggttgccctgagtccacagaggagcaaggctggggccattttatgagaaaaaacaagctccctcccgagccgggttctgggcaggagaggactctgctcctgcaaccagcccgcacccgctgagccttcgttgctgtgtcctgtatcccagaagaatgtgagtgatggtcttgcacagggaggcgggtggcaatagaccaggcggagatgcaagtgcacaacgtgagaaaaaatgctgaaactctcggctctaaaccatgctcttggcatcctcacctcactcaatctcccttcctccaccatgccaacctcccttcctccaccatgccaacctcccttcctccaccatgccagcctccctccctccaccatgccagcacagggactccccgtaaatcatcttcatccccctttgtggaaagactgaagatctgtatatgacaaggtcaagagtgggctcacccagtgctatccaagagaaacaccgtgtcagccacctgcataactttacactgtctagtggtcaccttaaaaaaagtggaaagtaacagataaaactaattttcatattttatttcactcaatgtatccgaaatattaccatttcaacatggaatgaataattaaaattattaatgtcggccgggtgcggtggcttatgcctgtaatcccagcactctgggaggccaaggcaggtggatcacgaggtcaggagatcgagaccatcctggctaacacggtgaaaccccatctctactaaaaatacaaaaaattagccaggcgtggtggtggcgcctgtagtcccagctactcggaggctgaggcaggagaatggcgtgaacccgggaggcgtatgttgcagtgagcccagatcatgccactgcactccagcctgagcgacagagcgagactctgtctcaaacaaaaaaaaaaaagtggaagtaacagataaaactaattttcatattttatttcactcaatatatccaaaatattaccatttcaacatggaatgaattaataattaaaattattaatgccggccggcacggtggctcatgcccgtaatcccagcattttgggaggccaaggtgggcagatcatctgaggtcaggagttagataccagcctggccaacatagtgaaacctcatctctactaaaaaatacaaaaattagccaggcatggtggcatgcacctgtaattccagctacttgggaggccaagacaggagaattgcttgaacccatgaggaagaggttgcagtgagctgagatcttgtcactgcactccagcctgggtgacagagcaagactccatctcaaaaaaaaaaaaaaagagttattaatactattttacattctcttttcttttcccgcacagggtcactctgtcaccatggctggagtagtggcacaatctcggctcattgcaacctccacctcttaggctcaagcagtccacctgcctcagccttccaaagtgctgtgattacaggcgtgagccaccacgcccagcccattcttttactacgtcttcaaaaatcttaacatgacacatttctgttcagtcaagccacagttccagagctcgatggccacaggtggctcctgtgtctacgagacaggcagagggccaggctagtgctgcaccatgcattcaggaagggagcaggaacctcctctcttcattctctacccttctctctggaatctcatgggaatctcctctcggtgactgttcttattgccacgtgaacaacggaccaaggaggatggaggtctctgaggaggggcaggattctggtgggaaccgtatgaggggaaactgggagacaggcatggcctgaaatggggtcgtgaatatggagaaatctggacgaagctggagcctcagggttggaagagttgcggtctctgggctggtgagcacagactccagctgccttgaactctggggcccatgacagaaactactctcctgccccatgctggaggctgcaggagtggggcaccctgcctgcgcccccaccccaggttcggctctttggtgggtgaggtgggggccttccctggaccctgtttctctgattgagcatttgacgtaaagacgccagagccccttgaacccatgtgcaatttcacatggcggcacgcaccagggctctgaagtatcacagctggcgtgtcacgcaggccacctgcatcatggccaggcagacttgtattcagacacaccacccacctgccctctacaagccccatgatgttgaaaatgacataattggcccagcacgatggctcacgcctgtaatcccagcactttgggaggccaaggcaggaggatcacttgagcccaggagttcaagaccagcctggccaacatggcaagaccctgtctcaaaaaaagtacataatatctcagattctcaattttcttaccttaaaaccagaataactgccgcggtggacagctgccattcgcagtctgtattccagcagccatgcctcctcttggtggcaaggacacctagctttccttgtggactaatctattgttcctcaactgagtccaggtgatctgggtgcccctgctgcttagggtcagtcatgtgaccacaccttagccaatcggagggtatcattctcctgggcacagtgattggctcagggctagacaggtgagctgagctggtaattaactagtaattaactagcctcagcattgttgtgggagttatacacaaaggctcctttccatggccctctagcccagaagcatgtgagccattggctgagaagtgcagagagaccaagaatctacacacagtatttgagctcctaaaccattactggtcatatgacccctttgcacaaactaaaaagaggtgctgaccgctgacaactgtctagtgaggtgagcaaatctgcagtgctgtggtgtgtgtagcaggcgttagcatctgatgtggcataaagcttacgtaactacacgcaatgaccctatcagtgcccagcctctgacaggtcagtctcactaataaattcccctctctgcttaagcacagtttgggttagagttttggtaactgatgaatcagagctgatgcaataactacggtcagtgaagacaaaatgaagccacctagataaaaacccaagcctcgcacctgcagagtagccccttcatgagtatgcatctctgttcccggtcacgactgtggaaatgaaggttccagaactctgaaagtctggactgtgttccctcttctctgcactatttctgtatgtgtcacatgagcaagacccttaggagctctgagtctcagctgtgcaggactgaaatcacctgggcttacctacttggagggaatggggctgcactaggtgcttctgcaggctgcagctggccccacgccccagcaggggtcacacggactccattgccctgagcactccctcccaggtgcattcattcccgctcatcacacaagacctggggtctccaacaaattccctaaatttcaccctcaatccagccagtagctgacccgtcacgctctggggagaggtcagtctggggcaattctcgccaatgtgaagggtgcatgagggcttgcacagttcgagtctcgcgtctcctccttggccaggcttcctgcttatgtttcctaggccagccagtttcagcaccaagccacctgggaagcttttaggaatctggaggcgcagcggtggctcacgcctgtaatcctagcacttttggaggttgaggcgtgtggatgacgaggtcaagagatcgagaccatcctggccaacatggtgaaaccccatctctactaaaaattcaaaaactagctgggcatggtggtgtgtgcctgtaatcccagctacttgggaggctgagacaggagaatcactggaacccggaaggtggaggttgcagtgagccaagatcacacccttgtactccagcctggtgacagagcaagactccgtctcaaaaaaaaaaatctggataggctgggcacagtagctcacacctgtaatcccagcactttaagaggccaaggcaggaggattgcttgagcccaggagtttgagaccagcctgggcaacatagcaagaccccatctctaccccacaaagaaaaaatagctgggtgtggcggtgcactcctatggtcccagctacctgggaagctgagttgggaggactgcttgagcccagaaggttggagcttcagtgagctatgatcatgccactacactccagcctgggtgacagagtaagaccctgtctaaaaaaaagaatctggatgtcccagctgttccataggataattaaccagaatctctgtgggtgggaaagaaggcacctggatatttttaaaccatcccaggtggttcccacgtgcggccaagtttggctctaacaccttcaaccagcaggttctgcaggcaggaggggccggctgggttatttttgccaagtatcaagaggataacagggtggagggagggctgggatgactgatggtcagaggtcaagtatctgccaccttcctcccctcctgctccaccccctcagaagttgctgtcaaccatcctaaagacagagaggagacagccctgtccatgcgccctgagacagcctgggagggggccaggcacctgttgacagaatttctggcctttcatggattcaaatccacatgtctggccaaagaataaaatagtgatttcaactaggcaagttcagcagcagacagaaagcttttatttcttaaaattgcctttttttccactgaaaacaggaagaaacacaactaagagtaaaaattaggtttataaaagtacaaagtgccagaaacataaatagatgactcaccaaaaagacactaaaatgccactcaaaaaatgaaaagatgttcaacttcacctgtaagaagagaaatgcaaatgaaaactacactgagatactctcaaactggcaagttacccagcctagcagcaccgtgacatgggtgtccccagacgcctctgagtggggtaggagtcagaacggaacttcccgctgggtactttaacgaagttttgggttcactggcttcctgactggcaaccctgcttctaggaatttaccctcaagacaacataaaaatggcctttaaagatatgcaaatacatatgcacaggttattccataccggtttgttaataattgtgaaataccagaaacagcctaaatgctcacacatacgaggcaggttgaataagcgctgtcttcacacagcgaagaactgtgcaggacctgaggaggggagatctctgtgaagcattgtggagcaatttccaggctatattgtgggttttttttaaaaaatctattgttttaattgacaaaaagaattgtgtatatatgtattgtatatctatagtaacccctaggctcaaaaaaataaaaataaaaaagaagtgtcaacaaatactgaaccccacttggtaaagtcttttcccctaggattaagcagataaatatgtatgttgcctaaaatagaatccaggtttctcagtctcagaggagggagttgaaatacagaaagaggagaggctggaataaaacatgtgcggttaaactggatttgaaggcatcaaatagagataagttggaaatagacacagaaatacacacacacatgcacacacatatgcacgtgcatgcagcacgcgcatgcacacacacgcacgcacgcacgcacacacacgcacacacatgcatgcacgcacacacgcacacacatgcacgcacacacacgcacgcacacgcatcacacactccccatcctggctctgtcgactacaggacctggaggtcatgacacctcggctgtcatgagcactcctcacacccagatcttgatttctaaatatcactcgccacccagagaagcacgggctccttcaggaaggggctaactctacagctatgtcagagaaagtataggttgatcctacagcatctcatttcatagaaagtaaagagggactcagaaatgacagccacgtgtccaaaagacatgggaaccagctttgaaggagctcccgctgacctttcaatttcagctttaaaataatggcaataaatttaaccttggaataaaataagaatccatcagtccatactgatataaatgaacataaataaaggggggcggggcagggaaggctttcctgccaaggatgggcccattcacagaggccggagggacaacaggaaaactgccccttgtactaatcaatcaaccggaacagcgagctgtctggaccagagccgccctcagcaggtgtgagcagcatgctggagtccgacgaggaaccagagtctccactcactcaccaaaccctaccacaactcctggcttcaccaaaccctaccacaactcctggctacgtgaagagggggccctgggaatttcacaggagagcaattcaaccatgtgatcaagttaacatccccagtaacatgacatcctgaaatcacgtgtttcctgatgccatgctccgagatggaggcaaattcctgaaaaaacacaacaccccagctcatgcctgtaatcccagcactttgggaggccgaggtgggtggatcacttgagctcaagagttcaagaccagcccgggcaacatggtgaaatcccatccctactaaaaatacaaaatttagccaggcacagtggagtgcacctgtagtcacagctacttgggaggctgaggcaggagaatcactcgaacccgggaggcagaggttgaattgagctgagatcgtaccacagcgagccgagatcacgccactgcactccagcctgggtgacagggcgagacctgcctcaaaacaaacaaaaacacccaaatctaattgtgaggaaacatcagacaaaccctccgtgaggaaccttctgtaaaactactgtccttcactcttcaaaaatggtccaagggaagaaagacaaggaaacattacaggttaaaggggattaactggacgccaccagtaaaagtagtacctggtattggattggatcctggaccagaaacacacacacacacacacagctctaaaggaccttatggggcaactgagaccatctgactgcagacccatcacgatactgcagccatgttacacttccccctcttgattatttcctgtggttttgtaaggaatgttcctgctcttcggaaatgcatgctggggcacgtatggggtgaagggagtatcacatctggaactcactctcaaacaccatttgcctcatcctgtctccctctttttctgaatcatctgacagcaacttgtagataagagagaaagacaaagctaacaggacccaaggctggcagtgagtggatcctcaggggaggtgtatgggttctatctctgcacatttttttggtaagtgtgaaattatagcaaaattaaaagctaccaaaaaagatcccccttctttctaaaattaatactaaagggcctaaaacaaatgaacacagaagcacacctgggaagttgttattttatcggaactatgcaagggatatggaagcagcaagtgtgcaagaagagagagtctaaaacatggcacacccctcgcttctaaggggcttggcacaggtcaccaaaccctggaggactctctgtttacccaccaatgccactgatgagccactctgcaatacaacggcaccaagcagtattgtcttcctttatcctaatgctcaaaaaactgcatatattgctaaaggcaggactgcctttgcaagacaaagtttcagtccaagataccaaattgtgaatcacactcaatgcaccccagtttcactatcgcctgctgtgagctcaatcctgtgtcctacaaaggagaggtggtaactatcccccatacccaacacagatcctggcacatagagatcagtcaataatgtttaccaaaggaagggagggaggggagggatggaggaaagagggaaggacaagggaatgaggaggaagggagaaggggaggaagggagaagggaagaagaggggaaggagggaaggagtgagggagggaaggaaggagagagggaagaagggagggatggagggaggaagggagggaggaagagatggaagaagggagggagggagagaatggagggaggaaaggagggagggagagaaggaagaagggaaggaaggagagaacgcaagggagggagaaagagagggagggaaagaaggaaaaaagggagggaggaaaggagggagagagggaaggaagaagggagggacacagggaggaagggaaggcgggagggagggagggagagaaagaagaagaggcaggaagggagggagggagacaaggaaaaagggagggaggaacacctgaccgaggcaggctgggacacaaaaaggcctgccggacggaccgcaggacnaaacgagggcacgcaggcaggcaggccacaccggaggcacggaggaaggcccgacgcacagcgcgacggaaggaatgcaggagggacggacggccagaagaacaacggccggcaggaaggagngaagnaagagagagagacaacatcctctcctccagagaganaagagactcacccttcctgccccaacgaaaacagatggctccctaaccgaataaattaagagcctaaatgaggaaatgtctacaagntggagtacgagctcgattcgtatcctgatctaaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaggtacaggcagggggacactaaaaccccacattctaaagaccccaaaacagaggccacatggccccttgggtgcatacagagacacagaaccacctccaccaccactgtctcctccggcccccaattccaactgctcagctgaaacgtttcgaaccaagtctaaactctgcaaaacgctggctgaaacgtgggcctcacgttgcctgaggagcccaccccactcttgcccagcagaactggagcgaaggtcggtcgcaggcagcagagaactgcccagtgtgcgccgatatcctctgtcccttttcatttctgaaaagcgccggttacagcccacaaaattgatttcatggctccctaatgggctatgacctgcgcttacagaaacactgattgatacaccagataaatcctcgagaccaattttctcccacccacacccctccatgccaacacagctgcaccaaacatgaggggctcccgtgtcctgggccgggcacagtggctcacgcctgtaatcctgaggcgggtggatcatctgaggtcaggagttcgagcccagcctggccgatgtggcgaaaacccgtctctaccaaaaatacaaaaattagctgagtgtggtggtgcgtgcctgtaattccagctactggggaggctgaggcaggagaatcgcttgaacccgggaggcggaggttacagtgagccaagatcgctccatggcactccagcttgggcaacaagagtgaaattccatctcaaaaattaattaattaattaaataagtaacgacatccccttctctttcattagacctgacacataagcaaactgcaggcccgagaaaaaggatgatccaggatcagtagcagctcagctgggccccaggctgtctcccgtgcagtacgattctcccctggacgttagaataggtggaggagctgcctctgatcccaaggcttagctggggagggggacgggcccatcaacacttcgagactgcaccccaagtgctgatggacacagagatacacagaaccagtggagccaatcactgtaaaccctgcccgcgagtggaggacccagtagagaggctgtgttcattttctatgcatcgtaccaaatgatcacagatggcggcttaaacagccccatgtgttagctcatagctctgtgggtcaggcgtctgggcaggctcagccaggcgctctgctcacagtcttgtgaggccaaattcaagatgctggccaggcaggctcttgtctgcaggctcaggagtaaggggagaacctactctcagtgcactcaggctgtgggagttaagcgcctcgcaattgcagagctgaggccccgtgtcccgctggtgctgccagggcctctcagcaactgcagtgccttcgggtcctcacttctgtcttcaaagtcagcaagggcgggtcaagtcctcctcctgcctctgctccctctacctctcccttctgccacctgacagagaaagctctcggcttgtgcaggctccagggattaggctgggttctcccaggcggcctccctttctcagggcccaccatgccctgggggtggggatcatggacacagagagagacatcgtcccatccacaggctccagagattggggcagggaatcttgctgggcactgctaggggtctgcccgccacagaaactggtgctctttcctgctgcccgagaacctgagagaatgaggctctaacagcttgaacagcggttttgccaccatgaggcaaggacccatttcagaatgcagaaagaagaagaaacacagactctttggcaacatgatttgagccctgaattgagccacacctgatgtctgcggtatcctagatttttcacttactctggcccatgcatccccttttggctaattccagtgggagagggattttctgttgcttgcaaccaatggtcctgattgcaataactgtactattttagcataatctttagggctagcagtgagtccaccaactgtagcaggccacgcacttccactggaagctccaaacaccgaggaaaatgacaaaaggtctgagatttttctcggggtggaatatgatttcacacatcaggagcttgaagcctgggactcaaatatcacttctgaggtgcagagagaacccaatagccctcaggaaagcctggtgagggacatcttcctctcgctccccagtgagatgccctgtaattcacaccagcccacagggaagcctggtgagggacgtcttcctctccctccccagtgagatgccctgtaattcacaagggcccacagaaaagaatgttaaacagcgtgtttcttgttgggggaggagggagaggagcaaatgggtttctctttcctcagaggtcagttcctcaaaggagctgccagccccgactcaacagggcgggatgagatgtaaagggagaaatctcaaacgcctccaggaccaggggctcaagcctctccagtgcccttgttttcctacagtaactccacaccagacctaaaggaagcctgtgactcctaacacctgcaacgctgaccacagcaacggcttcctgggagtcagtgaaggcccagcggaaccaacccgaggaatgtgtgctcacaaagaggccaggaacaggcaggtggctgtagccccttctacccaggaatgcccctttcacttaagaagtaggtacacaggctgcgtgtggtggctcacacctgtcctcacagcactttgggaggctgaggtaggcagatcacttgagcccaaaagtttgagaccagcctgggcaacacagtgaggccccatctctccaaaaaaaatacaaaaattagccggatgtgatggcccacactggaatcccagctacttgggaggctcagatgggaagatcacctgatcccaggaggtgaaggctgcagtgagcacagatggccccactgcactccagcctggacaaaagagcaagatcctgtctcaaaacaaagaagaagcgggtaccacagggagccccacccagctcttgggggagaaaaacagcccagaagggaaggagctcatgcagacggtgcagcacatggtaggggtgccagcacccccagttcagatgatgtgcaaaattataatcttcaagtagaaattagcaggagaatagaggcttcctgagggtgtggactgtgctttccttgtggaggccctgggtggttagagcgggtctggaacatggcagggggacgggtttctagaacgaggagaagcggatacagtctaagatgtggtctgcgggtgctgcgaggggtctaaggaaaactgccctggatgctgccacgatgaaaaaggagatcttatttgttgtaatcacaggactagaaagggaattggagagggcgtctgcagagctggtgtgcagctgaacttgctgggaagggatgaactcactacactgggagatgagaggcctgggtttgactcctgcctctggaatgatacctcagcattctcgggacagaagtgggacagaaggagagtccccctgagatggcaccttcacctgcacgtggggggccccagggccttgtggtcagggcgggtctgctgcagaagcctcttcatgcctcattgattccatcctctcccctaccccttccctctcctcccactgcttgtttataacaaagcatcttaattgcctggtttgagcaaccaagaatgaagaatgatttgacgagtcttttgttctcctttttagttattaaattttaattaaaaaccattaaaggcacccttccccaattcacaataataaatctcaccgagaccctcacggtctccctccagccaagactgaggcagcctcctcccctctttcctgactcctagaccaccccaaaccctctttccccaggaatgccaaaggtgcattcttaaaaagagttatccaagctgcaggtcctgctgcattggattgtggaatcaatttagcaaggcatagcatgatctttaaaaactaaacatggaatgggatggggtgcagtggaataggtggaatggggtagaatagaatagaatagagacatggaatgggtggaatggaatcaaatagaatggaaaagtgggatgggatgggtggaatgggatgggatgggatgggatgggatagggtagggtagggtagggtagggtagggtagggtagggtaggataggatagggtagggtaggatagggtagagagatgggattgaacggctggaatgggatggaaacaaacaggtgagagttagggaatagaatggcaaacacatttataagtgaggaacttgcatcagctccattttacagacaagaaaactgagagtgaagattgctccatgaccaagtacctaagacacgatttgaacacagaagtttctcccatggccctccagctgcccccatactcctatgggagcatttcttaggaaacactcgtctgtctccccaccgtgtccatgaggtccctgtgatatgactccgtgctccatgccatggtcatgtaatgattcaattgattgaaagaaagaatgaatgaatgaatgaaatgtgaagaagaagcacagggccatctctcactccattcttagagataatttaggcaattggggaaagtctgggtatacacacacttgcagacaatcccatgctatcctaacgatgcctgtgatggggggtcgccttgaggattgttagggcaagcacaaaagggatggctacttctcagactgcttccattaagaactggtgacccccaaagccagtgatgcccagcaattgtgtgcagaatccacttctatgcccaccgtgagaaaggctctcaggccagaaagtaaatgtccactgggagaggagagcaggtgctttgaagatcaccgagggcctacccgcatatgcattttggccttctcctttctaacagaacccaagtctctggaggtggtcatggaaatagctaaatagctacatttcccagattctggtgcagactagggtggcacatgacagctccaaccagtgagtgtaagcagaagtcactgaaaggcgtcgttcccaagaaggccctttaattgcggatgattcagctgtcacttactttctcttgcccctcgtccattaccgctcccttgcttcctgcctggaatgcaggtgtgctggctggagctccaccagctgtcttgagagtattaagacaggattgttgtcatcaagatggcagagcagcaagccagagggagcccaggtccctaaggatgcagtggagcctgcacaccaggaagctctgggattcctgcatccgaacttccatgccataagaatataaacccttctcttgtttgaggcactgcgtaactgagcataattctgaatgagatgtccaggacatttatcccaagcatgtggaccagaagggggtggtgaatgccagctgtgtgcaggccccacccctgccaagaggctgcacaaaccagaactctcaagcaaaaccctccttggaggaggagtcactgcaaggccactgccctcaaccaggggaacgagccataaaccttgacttgaacatcaactcagcactttgcccttcattcagtcagtcaccagtagtcatggcctctagttctctccctacctaggaggcagaaaaatcatctgaaagtggatattcaaccatgtcattctacataaaggaccttagaggctacccatgaccttcaggacaaagtccagagtcctcactgctgctcgtgatctcaccctgtctcatcgccaacctcactgtgtgcttctctccttcccaccacgctccagcatgctggcctctctacgctcctgcccaaggccttctcgggactgctccccttcctggaaagctcctttccacggccctcccgtagagaattccgctcatccttcttctctgcatggatggtgcttccctggactggcttagtccccactgcggcaactttccttgcagttgtcattgcttgccacacaggaggtagcagacactgacaaaagtgattacaaagatgatagggtgggctggctgctcaggacagccctggagagggcacacaaagaaagggaagaagccacattggacacgcggacagccatgttcttagcccttgttcttaacacagggcctagcacgtagtacgtgatcagcaaacactaaccaaatgggtacacaaacagaacccagtgcctgagctgtaaagtttattccaggccagactgaggataagcgagatcccacaacagatcagtttcccgtcagtgtcgctcccattatgaacgcaaatgtccagtcgtgaacacaatatctgcccttccactaggctctggagcacctgttcactacagaaatagggagcatttcatctccacttagttgtctgaggttttcttttttataatccaagtgccaccaggtcaggcccacatgctacatcctgcctggagccttccctggtcatgacaagaccgcagggcccctcttcttctgagcctgagttcctgttcactctgttagcttccagctgcatcagctcccacgcgagccaggaggaccacgtggcctcagtctcccatctcaccaaacccacactcagacttcaacttgatctccaaataagtgacacactgtctcagagctacgttgacaggatggaaaggtgctgctctccacacaaccttgttaaacactcgacatttaaataaactattgaaggccaggcatgccggctcccacctgcaatcccaccactcttggaggccaaagtgggaggttcgctcgagtccaggagttgaagaccaacctgggagggagggtggtacatggtgagagtggggagtccaggcaggaacctcattccaagcgggcaggaaaaccactggaaggttttaagcaacagagtgaggtgacctagtttgtttcaaaaagatcaacccctgtttctgagtggcaaccgaccattgatcaataagactagaggccaggggacgaggcagaggctaggatggctgtctaggtgaagggcaggctggtctggactaaggagctagcaggggaggtgggaagaagaggttaggtatgttgaaagtttagagacgtccagatgtgctatggtttggatatgggcttgaagaggagtcatggttgatcccaaggctttatactgcagcaactagatgaaatacgttgccatttacaaaaatgaagacccctggaggaggagtacatttatgggagtaagaaattgcaagtatatgattttggacagatgcatttcagatgtgcattgggtcaccaaggggagatgctacatgggcaactgatcacctactaaattccaggagctgcagaaggtaccaacgatgcatggacacaaccctgccctccatgctcacgtcccagccagcaggctgacgtgtccacaaggacaggcacatgataagggctttaacatgggtacacgcaaaaccttactgggagtgcagaagacgcctgcacaatgcagctgcctggggagggcagagacagacccagctcctgaaaggaagaggccgctgatgggagtctgggggatgtgtgtggtgatctggtttttctatacatcagtcattcagaggctaccttcaaatgtgtcatctgcatccctcaagtttgatctaataattttctttaaattactgacattaaacctgagtaaggtttaaatttatagatcaccaccacaaaatgaaagccaacatcatcagccttaaatgtaaagtaacaattaatataggttgttttaaaaagcagaaggatatgaatttctagctagatagctgagctgactcagcattttgagccagaggttcacaaagcgatcactgtgaacattgatcatttaacaaatgaggtttaacaaaggtgattagcaagaattagaaatatcaagtccaactaacaccaaactgagactttctccttgatttaatcagaaggagtaaggggaattaaaaggaaataagtgtgctattctgtaatgccatgttgttcagcaatgtttgagaagccgcttaaacctctctttggagtctcagtttgggaagcactgtatctggtcagagaaaaggcagcattcagggcagtggcaacagcttctgcaaaagcacagaggcaggaagcagccgagcatgttttgaaagctacaaatcatctcacgtggctaaagggagaggtgaacgggggctgtaaggtgggcaggagtcagattgggaagtgccgtcctgccaggctgaaaacaggggattttattttgcagacaatgaataagtgcctccgaagggtgtcaaacaagatgatgggatcaggttcatatttataatgaacacacaggatggaatgaatgaagactgccagactggaggtacctcaggagacacaataccggacgaaagccatcctgaactaagaccacagaaataatagagaattccagacccaagaagtattaatgtggccaggtgcagaggctcatgcctgtaatcccagtgctctgggaggtgaaggcgggagaactggttgaggccaggagctcaggaccagcctgagtaacatagcaagacccctctctacaaaatatctctacaaaatagccgggtatggtggtggacgcctgtggtcccagctactcgggaggctgaggcgagaggattgcttgagcccaggagttcaaggctgcagtgggctatgattgcaccactgttctccagcctgggtgcagagggagacctggcctctttaaaaaaatcataataattgtggtagaattggcaggccttggcaactgattggagatagaagttcagggaggaatattctgcaattgtccttgtccttcctaaattggatgtggtgccatcaaccttcatcaagaacacagaagggaaattagccaggcacagtggtgcccacctgtggtcccagctactccagaggctgaggctggaggatcgcctgagtccaggaagtcaaggcagcaatgagctatgattgcactgctgcactccagcctgggccacaaagcaagaccccatctctttaaaaaaacaaaaataaaagtggaaagaagggcgagtgttggtgaagagacagtgagctccatttgggatgcactgaacttgcaggaaatgcaagaatcaagaaaagttgtctaggaagcagctggaaccatgtttaatatttagggggacatttggggcagggatttgagccgtcttcaacagctaacttgcggtcacgggcgtggagagggacagcctggagaagaggagaaagttgagagctgtgctgtgaggcccttcttcataggaggggccatgaaggagacagagaaggacagggaaggtgggaggggaaccaggaggcagcagagtaacagaccccagagataaagactttcaagggagaaggcgtgggccacagagccagagggggtgcaaccgtgacttagtgaagccccttcctttgggtctcgttacagccacagaacccgcctccatctgactcaaacactgtccttaacttgctcacttcagaaggccgtccgtccctcgtaccgctcctaatgtcctggtctctgcctctcctcctgctccttcacatgacctgtcaggaagggacaagcatgactcagccccacaaaattccagtgtgtgcagtttacaaaagatgctagaaatacaagttttagactggacgcagtggctcacacctgtaatcccagcactttgggaggctgaggtgggtggatctcttgaggtcagcagttcaagaccagcctggccaatatggtgaaacaccatctctactaaaaatacaaaaattcctaaaaccataaaaatcctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctatagaatgggagaaaatttttgcaacctactcatctgacaaagggctaatatccagaatctacaaagaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaataggtgctggagaggatgtggagaaataggaacacttttacactgttggtgggattgtaaactagttcaaccattgtggaagtcagtgtggcaattcctcagggatctagaactagaaataccatttgacccatccatcccattactggttatatacccaaaggattataaatcatgctgctataaagacacatgcacacgtatgtctattgcggcactattcacaatagcaaagacttggaaccaacccaaatgtccaacaacaatagactggattaagaaaatgtggcacgtatataccatggaatactatgcagccataaaaaatgatgagttcatgtcctttgtagggacatggatgaaactggaaaccatcattctcagcaaactattgcaaggacaaaaaaccaaacgccgcatgttctcactcataggtgggaactgaacaatgagaacacatggacacaggaaggggaacatcacacaccggggactgttgtggggtggggggaggggggagggatagcgttaggagatatacctaatgctaaatgacgagttaatgggtgcagcacaccaacacgacacatgtatacatatgtaacaaacctgcacattgtgcacatgtaccctaaaacttaaagtataataataataaaattttaaaaaatacaaaaattagtcagccatggtggcaggtgcctgtaatcccagctactcgggaggctgaggcaggagaatcacttgaactgggaggcagaagttgcagtgagccgagatcatgcctctgcactccagcctgggtgatggtgtgagactctgtcttaaaaaaaaaaaaaaaaaaaaaaaaagaaatacaggttttatattaaaatatcccaatttttaaaatgctagcaaccaattttaaccattttttccctaattctacgtaggccaaatagaaagcgtgtgtgggtggctctcagcccacagatgcccatctgctacccctaaggggcagccatgttccctccccagccacccaactgaggaaaatgcttcctgaactcttactagccagaaaacatttgatggtcttccagttggtgtggtttttagtttattttctctcaatctctaattggcaggccatttctacaaagacccacacagccccaggcccgcaacagccaaggtccttttctcccttcacccattccccggaaagatgcctggagttgaggaatctctaagacaccagccacaccccgcaagggtctgcaagacggtcaaccacggcagtggactgaggaatgtcccccgagaatcacgttcactcgagacctcagaatgggacctcacttggaagtagggtttttgaagatgcaattcttaaggtaggaattcagatgggatcatgctgggtcaggggccctcaatccaacgagaatgtccttctggagatggagaaggccacatagagccgcaggagaaggccatgtggagacagaggcagaggtgggggcagggggctgccacagccaaggaacacctggagccactggaaactggaagaggcaggaaagatcccaccctggagcacagccctgccagcgcctggatctcagactttcgcgttcagaactgggagggaagagatttctgttgttttaagccccctagttcattctaagttattatgacagctgcaggaaactgatccaaccacccaacaaattccaaacgttccatcacacaacaagcaccttgtgagcacctcctgtgcacaccttgtgagcgcccactgcatacactttgtgaatgcccacagtgcacactttgtgagcacccactgtgtactctttgtaagcaccactgtgtacaagcacttcctgtactgagcatggtgtgtgtgccacatgtaacatggccctgccttttagcaagtagttttctaggacagacaagaagagtgcacaggtctctagaacacaggtaaacactgagaagggctaaaacacaaatacaaggtttccgtgtgatttcgaaggatgggcaggatgtcattgcagttggaggccactgggttcagctgtagacagggagccactctgagccatgcccacggggtaagaagggaagcagcagagccccccagcaggtgggagctgagccggggccctcacgctgtaagcccccctaacacagcggggtggacagctttgccaagctgcctgggaaggccttggagtgttctataaatacagaaccagcaggtgttgtggttggaagacataaaagctacgtggcactttctgccttacactcagcttacatcacacgtggaactgcttgtattggagtttacaacccctgaagacacaagggttccaaagaatgccgacagccagtaggtcccatatcacactcaggggcggagagcagcccaggggagccgggcacaggaaaccttcacagtcaggcccgcgtctgaacatggggtgaaaagtaccttgctgggcacgttgtaggggaaggtgtctgagcaaggaaggcgtgagactgtgagaccgactgtagcacctgatgctgacttgagccccctcaaagccatgggacacaaatcgctcctgcttgacagtgtgggaagctgcaaaattcattgtttttcttcaagatctttgggccaaataatagcacgtctttaaataacgcatccttcaactcagtgggcaaaacaagttatacctgacaacctgccttaaaaccaaggagccgggatcagggttgccatggcccaccccttcccataatgcttccttcaccccgctggaggtacatgcagcccacacacgtatgttctagaaggaacagatgctctagggaagggactgcaggcacaaggcccaccaaaacataatgcggcacgaaagaggcccccatgtggatgttgctccctgtggccagccaatttcagtcaataatccagtacgaggatgagcccagcccacaagacacatactcttcctaactaaacaacaagggtcccagctgtttgcattacagtgggggaggaaaatctaagcttctctctagctgaacccttagcaatgattttgggtaaatttccaaattgcctccaccaccaagagcaatgaaataaccacatgtgggaccgggcacagtggctcatgcctgtaatcccagcactttgggaggcccaggtgggtggatcacctgaggtcgggagttcgagaccagcccgatcaatatggagaaaccccatctttactaaaaatacaaaattaactgagtgtgttggcacatgcccgtaatcccagctacttgggaggctgaagcagaagaatcacttgaaccctggaggcagaggttgcagtgagctgagatcatgccactgcactccagcctgggcaacagagcaagactctgtctcaaaaaaaaataaaaaaataaaaaacaagaaagaaggaaggaaggaaggaaggaaggaaggaaggaaggaagaagggagggaggaaggaaggaaggatcacatgtaagatgaaggagaagatataggaatggtgtgtgtgagagcaagacaggctgtgtgcaagcccttcctgttttgttagtattaatttcttttagtaagaaccatggccgggcggtgaggacagaggccctggaatcagatgatcctgatcggaatcttgggccccttccccaaacccagttacaaattgtgcacctttggacaagttgcttaatttcttggggccgctcttttctcatccataaaactggaattaatcatagggctgtatggaaattccatgaaatcaaccatcccgggtgctcagccgggacctgcctcaacaggggttgagagcatctacttctttcctcctgggctgagacaatgagactgtgatttccagcaatttattcatttcagaaaaatgctgctgctactcagatgcccggagaagttcattagaacaggattttcctgtaatgcctccaggtcaccgggtcactgcagcaggccaggggtgggattctttgcctggcagttggagataattgcagttgccaaagtggtccggcctcctagcatgggggcagccaattaaccaggagagtcaccctcctggttgacagatgacgcctggtgttggccttgtgcaccccgattaacctccaggcgggctccccctccgccctggacattttcagtttcctgcacttattatgaagcctgcccaagaatccctaattcactaataagaaaatcaccatctaacatcagtgtttgaaaatgaccttgtgttagaactgtggtgggaagagtgctgtattctcaaacgatcactgttttttaaaagcgtggcacgggcactccctcggccacccgcctgccctccccaatccctcacccactgctgcgaccacccggtgctcagctcagggctgagccgcagtctgagggccgggcctggcatgggctccatcagatcccgtaatcggatccgggcgctttagccctcacgtgactaggggccaccgcctaaccctgattagcgctctacatcacccaccgctcagcctcctctggggtcgggtggcttctccacgtcttaaataagattcagttgtcatgtgtagtatattgggagtgcgtttgaaatggtgtttcctaggggagaagaaaggaaaacagcacccacaattgaacagcttaggaaatacagagagagagagagagagagatctagaagcacggagggaaccctgagcctgagcctgaacgcagcgcagaggtctggggcccgaccaccctgggaggcagtgccccagctgtgctcaccggtgaggggaacacaccaccttcctgctactttagggacatcagcaaagtctcccttaaatatctccctttctttaccaagaaagctataaatcggagccccatccttccagatgaagcagcattttaaaacctcagtttcatctggaaagcagctggggaagcaccccatggccaggtcgacttccctccaggcaccagaacacaggcagggaggacagaggaagtgcaggaggagggacgaggaccgaggaggcagagggagggtgctctgtgggccctggcaactcaacccgcgtcccaaagcagctctcattagggctgggctcctgacgtcttgtttaaaaaataaacaaaaagccaggggtggtggttcatgcctgtaatcccagcactttgggaggccaaagcaggtggatcacctgaggtcaggagtttgagaccaactggccaaattggcgaaaccctatctccactaaaaatacaaaaattagccaggcatggtggcgggcacctgtaatcccagctactttggaggctgaggcaggagaatcacttgaacccgggaggcagaggttgcagtgagccaagatcatgccactgcactccagcctgggcaacagagccagactccatctcaataataataataataataaacaaaagtaaatggcttctaaagggaagtttttaaatctcaaattaattagatggcactccgcattttctaacccgactttccaaaggtgttccctccgtggactcataacccgctcgccctgccaccaccgcctccacaggtccgtttcccaaagcgtagactgccagccagagagcacctgcaagacggccgaggctccggggctccaccaccagggtcaccggttcaggtcctggcatcgctgctctctagctatgtgatcttgggctagctgcttcacctgtctgtgcgtccaagtccctgtctccacgatggtggggacagtgataccctcctgtgcttgtttcctgggctgccatgacaaatgacaaaaaactgggaggctcaaaacaacacacatctcttctctcatagatctagaggccagaagcccagaagccggggtggcaagaccagctccctccaaagctgcgtgaggatccctgcctctgccagcaccggctgcctctggggactcctctccgcggccacatagctctggttccgccttcagagtcacacggatgtgcctgaaactgagtttttcacaaatcaatgacactggaggatgcatgagttaggaagaagatgcctgcacacccgaagcccaggagaaccaatgagatgttaatattcccactggtgaaaagcagagaccaagactagacaggctcatgaagccgcccggagcctcccggccagtcaccacgcaacaaagaccggggccctggctgccgcaccaccgccctgtgcttcctaatgcatctttcacctctggggaaaaggaggttcagtttccccatttgtcatgtccgtgactgtgggccacagatgcctcctgggggagaggctggcagggaagggacgcagctgtcccaggcccacacaggagcccacgtggttccctgtaaaacgctcttcctgaccagctcctcactaacgaacaactcagcacaggcgtttgctgtgtttctctgcggttctcacacctctcctgctgcacaccgctttcctgctctttctctccttctgtgacgctggagcacactgggtatggcaggagtgaactgctgcagggccacaggcgcccagcctgcaaaaacgtcccaacacagacagggcaggccagtgcccaaggcaaacgccaccaatggggtggccaggtgtggctgggaccaacggaggcagaagccgttctcttcccagcctacccatccctgcaaggtcacaaaaatgctgatggttacttcgtgcaaaagtgtctccctcctaccgtgaccggctcacttcgcacacactttagacagctctgctcatgagaaaggaaaaataaatacactgcggaagcatctacaagaaatctgggctgcacaagcttcagaggacccgtttctgggactgtctgtattattctactaattccattcacatgctaatgattggtctgtttggagtttaataataatagcaggaatcgtaatagctaatgtttgttgaaccctcacactattccaggccctgttctaaatgctctgtgccattgaagtcatttaatcatcaaagcaccccttctgccgtccccatctgaatggaaataaaggcaattgctaatctttattgagtgttgcaagatactaagcacttttccccagtgaatgccttcaataacaatccgtcgaggagaagacggatgctattgttacctgcattttatggataagacaacgaaagcgcagagaggttcagaagagagcctgtggtcacacagccggaagtagcagagcagagatcggggcctgccagcctggctccagactctgccctgtgactgtggctaattccaccagtgaaggctgcttccgagggacacgttcacggagcagctccccgcacagatgctgtggggcacaggcaggtccgcgctccccatggcagcatggcgtagtggccaggggcaggcgctctggcgaaagtgcccagtgaatcttggctgctccactcaggagccataaggatttgggcaagtgacttaacctttctgggtgttggtgccttttgacagttaaatgagctagctggtgggaagagtgcagaacaggcctggggtacggtgaggattcaatgaggccggctcttgttttcatggctcatgctattgctctccaaacagacttatcaccaaaattatcatgcagtgattcggcagccgccagtggtcccaaatgctgcaggctcattctgcagattgatggagaatgggcatttcccacaagctccgccaggtctagcttgtgcctctgctgagagacccaccttcccagccctaccccatggaagagagaaaaatcctaaattaacaatgtgaaatcctgaaatgaccaagaaaacatcaagtaactgaacgtgtcctcaagcgacaagattctctttcctgttcttgagcagggcccgggcgtgagagctgaagcaggccagggtatacacaggacagtggcccaggggacacccaggcctgagagcaggaagagcggtggggtcacagaacaacccggaaagacgcagacacactcagaacttccaactgccagtcgtatccagctgcagatgctggcataggtacgcagaggattcgtgccctcacagaatggaacggtgcccacctgaagggaggcagccgggaggagcagggaacaaggtcccacccacgcccaggagtcctcccatggggagggagggaggcacatcaagaaacagaacaggtgataggacaggaggtccagatggctgctgtcatggcaggcagtcagggaaggcttctcagaggcggtgacctttgagcagagccctgaacaacatgatgagtgagtagctgggagaagagccttccagacaaagacatgaaggaggaagagctggcaggcctgtggccatcaggaggcccttgcgcttgctctaagtgagaataaatgcaatcagaagcttccaagagtgggcgtggactgagccgtttccaacaggagccctctggctgctgtgtgagagtgacttgcaggcagaggtggacacaggaggcctgggggcgctgaggcagtgtggcccagggacaagaccaggggtctctggccaaggggaccgaggcggcccgagcaagaagagctcagaatcaggatgtgaagggaaagtggcggatattagtggatcacatgtaggcaacagctagatagaggctgggaagaggacatgtttggcaaagcaaatgcttagccaagaaatggggggattgagagagagggagagagagagagactatacgcattacacatgactatatttgcaataatctcaggccttttagaaagtactgatgcctgtgggtaaacatgtggtccagccacacagtggaatattattcagccataaaaagggatgacgctctgacacacaccacaacacgggtgaaccttgaggatgctgtgctgagggaaagaagccggccacagaggaccatgtgtagtatgattctgttcacgtaagatgtccacggcgggacatctatagagacagcagattcgcagttgccagggctgggaggagaggagagaggagactggttgcttaatggcaatttctttttgaggtgatgaaaatgttctaacattgatgacagtgatggttgcacaactctgaatatactgacaacccctgacttgtactttagatggatgaattggatggtaggtaagttatatctcagtaaagcagtcttaaagctgggcatggtggctcgtgcctataatctcagcacttcaggaggctgaggcaggaggatcgcttgagtccaggagtttgagaccagcctgggcaacatagcaagaccctgtctctacaaaatataaaaaattagccaggcatggtgacacgcgcctgcagtcccagatactcaggatgctgaggtgggaggatcacctcagcctgtaggtcgaggctgcagtgaaccgggattatgccactgcactccagcctgggcgacacagtgagaccctgtctcaaaaaaacaaattagtgaaataaagctgctttgaaaatactgttatacctgcgccccagctcactgcaccttctctaagaggctcgcgtgggccctggacacaggcgtgtttcagagctccctgggactgcatctgacccagaaccggctccgccccagcttctctgggatctcacaggtcctgcagcgctgtagtcccaacccagcttcgcggtcaggcagcccgggtttgaaactgggcccatctctccccagctgtgtgatcttcagagagcccctccatctctcaaagactattgtctcatctgtaaaatgggtctacatgagcaacagggcctgccgcagaagggctgtgtcatgcatgtaaccgaggaaggcacccagcaacgtgccggcaacagcagtccgatgcattgctgcatttgagctggaaaagctgtttacacaagttcccatctttaattctcacgatccagaagccacgatgcgggaggcagtcaccagggctggtgggcttggggacaagcaggaaggaagctggggaactgtctggacagaggcatggcctcccggggccccaactgccattcgctgcatccacccttcccacagagacaattattgagccccagccaggtctcagccactcgctgggcactggggactcagccacaggctgaagacgcagaacccacaccacagctggggctggggcaggtctctgggcgtgacgcccgacagcagagctctggcacccgcagcctgcggggcagctccaggctaaggagtcaacacgcagctcgagcccttggcccttgaacatggagcgctttacagacctggagctgagtcaaggcacgtttcccaagattttggggctccctctcagggagagggaaggaagagtcggaaacaaagctgcctgttgcccccgtcccaatatctccgtccaaggaggtacaggggcagcgtgatggggtgtgttcctggtcttggaaaccacgtcggtaataagcatgaagaatgccttgaggaaacccccccgcttcccacccaacccagcggcccgttcctgacattcccatcgcggacacacactgggtgtggcaccaggagcgtttaatcagaggaacctgtaccaacgcacccccaggccccctcaggaggcccctgctgccaaaatggccaaatgggctttctttttggtagcactgggcaggagggaggcaggggaaggagcgcggtaagaggcataggaggggcaaggaggaccttccacccaaagggacaccatgaccaactccccatggatggaaatgacaaaaagtacaccactggccccctggtttccgggtatccctgggagctcacgggtggacaccgagggtctccaggagaggggttggctctgcagcccctgtggtcccagctgctccaaaaacacccaaggagcaatttctgcacatacctatgagaatcaaagccaccgagcagctcgcagatccattcctccctctgccctcgggcgctgaacctctctcccaggtgtctgcacctctggctccttctcagggtcctgtctcagcttcaacgccacctcctccctgagaccctcccagatcatccaggtgcggcccctgacatcagccattggaaccctctgctgggcactccatcagggcagctgtctctggtgtagtgattattcattcacttgcccgttgtcttacacatgcacacacacacatacacgcaggcgcacacacacacatacacacacacacgtacacacacacatgtggtctccccatgagggcagcaccctcctctagcttgttcactgctcacctaaaatgtgagtcagtatttagcaggtgcttaaaggtttgctgaatgaataggtcatgccctgccttcctgggtcccacacagatagagaagtggcaggtgctgcacctcccccgccccaggctcagcaccaacaggaaggacctgtccacacagctaggccaaggagagagcccccctcatctcccacactgggtctctccagcaagtgcttatccagcacctactaatgacagaccacaaaacaccaacaaatgagaatatcccaaatggacgtcttcaggcctctccctgctctacctgctcctccacaagccccactgctcccaatcctcacaggccccgcacgtcacacgtggggtcccatggagccctgacagccacctccctttctcgtgtaggtgagcattaagaagaggctatctgaccaggcacagtggctcatgcctgtaatcctagcattttgggaggccaaggtgggcaaatcgcctgaggtcaggagttcaagaccagcctggtcaacatggcgtaatcccatctctattaaaaatacaaaacttagccgggcgtggtagcccacgcctgtaatcctagctactcaggaggctgaggcaggagaatcgcttgagcccaggaggcggaggctgcagtgagctgagatcatgacactgcattccagcctgggtgacagagcaagactctgtctcaaaagaaaaaaaaagaagctatccagcctctcacaaatccagagaagccccaatttcctccattttctgaggttccttgtccagggaaaaattaagaaatgtctattacccttttcacgttttgctggattccattttctaatttactaatacttgacttagaatgtggtgtctgtgaccatgagagtttggccagcacatgttcttccttctgatggcctcactggggttttgtatcaagattattctgggcttttaaaatgagtgtgctttgtcttttttctccattttttgaagatgctatttggagtgatttacttaggacgtcatttggacttaaagtttatattgtgtgaaggtttctcattacagatgcatttgcttctcacacatatgaaaataaccacaaaaaagttaaaatagatttagattaaatgttacttttcagggacccacctcataaatgaatacttctaaccccacaaaccctagtacagtgtgactggcttgttcaaagataaatgcagtcacgccttgcttaacaaggatgcgttcggagaaatgcctcattaggtgatttcgtcactgagcgcacctcacacacaggtacactgcacacacgcccgggccgcacagcctcctccacgccctggctcgatgggcaagcccattgcttccggtttcacagctgtgcagcccgtgactgtactgagtactgtaggccactgccacacaatggtgagtacttctgcatctaatcatagaagagaggcagcggaagtaagatctaaaagataaagcatggtgcacctgtatagggcgcttagcatgaatggagcttgcgggactggaagtgactctgggtgggtgagtgagtgagtgaggagtggacgtgagggcccaggcattcctgtacgtgtctgtagaccctacagaggctgcacgtttagactacgctaaatttatacaaaaatattcttctttcttccataactgccctcagcttacttcgtgccttatacatttcttaattttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtgtaaattcagtggcatttagtgcattcctaatggcatgcagctaccatttctgtctagcttcaaaatacattcatcacgtcagaaacaaaccctgttgccattagtagtcactctccattccctccccacatgaatctactttctgtctctgtggatttgcctgttctggacatttccagccatacagtatgtggccttacatgcctggcttctttcccttggtgtggtgctcgcaagctccatcaatgttggaacacgggtcagggcttcatcccttttgatggctgagtgacttcccaaggtatggatattctggcattgagattgttttaagtccctggggtggaggtgtgggcaggagtgaatacacacttccaagaagctgctctgaagaaactcaagctgctgtcccgctaccagcactccatgacatcatgaacacgacgacatcatcaacaccatgatataatcagcactgcatcattaacaccaccacatcatcggcaccatgacatgtcaacaccatgacatcaacaccaccatgaaatcatcaacaccacatcattaacaccatgacatcaacactacatcatcaacaccaagaccatcattaacaccgtggcatcatcaacactgcatcattaacaccatgacatcaccaacgtgacatcatcaccatgacatcatcagcaccatgatatcaacactgcattaacatcatgacgtcatcaacaccatgacaccatcaatgccacgacatcaacaccatgacatcattaacaccacatcattaactccacgacatcaacacaacatcagcacaatgacatcaccacgacatcatcaacaccacatcaacaccatgacatgatcaacgcatgacatcatcagcactgcatcattaacaccatgacatcatcagcactatgacatcatcaacaccatgacatcatcaacaccgcatcattaacaccacatcattaacaccatgacactatcaactccatgacatcaacacagtgacatgaacaccacatcaacaccatgacgttgtcaacaccatgacatcatcaacaccacatcagtaacaccatgacactatcaacaccatgacattaacacagtgacatcatcaacacatgacactttcaacaccatgacatcatcaacaccacaacaacacatcatcaataccacatcattaacaccacgacaccatcagcacatcatgaacaccatgacagtatcaacacaataacatcatcaactccatgacatcatgaactccacaacataaacaccatgacatcaacaccacatctacgccacgacatcagcaccacgacatcatcaatcccatgacatcatcaaccccatgacatcatccacactgcatcaccaacaccatgacatcagcaccatgacatcatcaacactgtgacatcatcaacaccacatcaataacatcacgacatcagcaccatgacgtcatcaacacaatgacatcaccatgacaccatcaacatcacatgattaacaccgcatcattaacaccatgacatcagcacgacatcattaacaccacgacatcaacaccacaccaacaccatgacttcatcaactccgcatcattaataccaggaaatcatccacaccacgacctcagcaaccccatgacaccatcatcagcactatgacatcgtcaaaaccacgatattatcaacaccatgatatcaacacatcaacatcaacaccacatcagcaccatgacatcatgaacacaacatcatcaaccccatgacatcatcaacactacatcattaacaccatgagaccagcaccgtgacatcatcaacaccatgacaacatcaaaaccatgacatcaacatggcatcattaataccatgacatcatcaacacaaggacatcatcaacactgcatcattaacaccatgagatcagcaccgtgacatcaacaccatgacaacatcaaaaccatgacgtcaacacggcatcattaataccaagacatcatcaacacaaggacatcatcaacactgcatcatcaacacatcatcaagaccatgacatcatgaacaccatgacatcatcaacttcaacaccacgacatcatcaacatagaagactcctgtgagcaaacgcagagttggggcttctccccaccactgagtgagcaacactgctgtagcggacaccaacaggggcatcctccgattctattctgacccctctacctggagacggtgtctgatcacacagggagagggctcagtcctaagacctccccccctactccagacatgagctgcacgtctgggccttctgaccaacttcttgatgttggggttcccacaaccccctctttgggtttgattaatttgctagagtggctcacgggagtcagggaaacacgtttcctggtttattataagtgatattgcaaagaatatacatgaagagatgcacagacgaggtacggggaaggggcgtggagctgccatgccctccctgggcagcccctccaggagcctctgcgtggtcagctctctgaaaggtccctgaaccctgtcctcttgggcctttgatggagacatcgttggacaggaatgattgacaaccatgtagaaatgcaactggatacacagggcgtggtgtaaactcagcagggcttgtctgtccagattcttctttttttttttttgagacggagcctcactttgtcacccaggctggagtgtagtggtgtgatctcggctcactgcaacctctgccttccaggttcaagcaattctcctggctcagcacccccagtagctggttttacaggcacgtgccaccatgcccgactaatttttgtatttttagtacagatggggttttgccgtgttggccaggctggcctcgaactcctgacttcaggtgatctgcccgccttgggctcccagtcttgggattacaggcatgagccaccacgcctggcccagagtcttctcagcttctcggcagcatttcttcctctaggggatggggcagaacccaccctggaatgaggatcttctgacccacagtcagattagggtcttgagattcagcttcctgaggcctaaactgccccaacgtgataacaaaaggctataaccagggctgtgtgagttaggaggcaggagctgtggatgaagacacacacatttatttcacggtgaagctcacataacataagttaacaatcttatcaactactccagagtggacgattcagtggcatttagtgcactgtggacggatgattcagtggcatttagtgcactgtggatggaaatgcaggggagttgattgccctgccacttgctccgagcctctgagaggtgactgccacaccctttggcattgaactctacatcctttggatccgtcagcacctttccagcaattccttgggtcaagcatgtgggattcacttgctcttaaaatgaatggttaactgtgcctgggctggtacaacttggtgctgtgtgaccccagccgtcctcagccctccttctcacacctccaccttggccagtacccacctggatttctctctggtcctccaagctgctgagcttgtcccctccgcaggcctccagcctggcatgctcttccctgggagcgccgcgtgctacttcttacaattttgggtcttgctcagatgataactccttggggcagccttccccgaccaccctccccaggcactccctgccacaaatgtccccactgcacttacgctgcggggagttctctatccgcttccttgttcaccctcactggtctccccaggaaagctccaggagggaggcgctggttctgtgtattcacctgtgctggggctggcactccaggcagagctgtggcggaaggaagtggcccgagacagcctgattccatcttttggtttctgtgtgtttcctcctcatagacccgcaccagcgaacagggaacctgcaaccagggggtggacactgaaataaaaacaaagtgagacagaaacttctgctcctgcaccgcggctgcccctgagtgctcagtggcggggctgtggccgcctgtggtcgcggtgcggaacttgccttgcaggatgctgtgcggggtagcctggaccccaccatggagggttagcctcctgtccccggccctccaatgcctgcacagggcgggttctgcatggctgtccaggggatgatgcaggcgtccagatgcgggaaacggtgactggatggagcgactgctctccagccttgtcctagcagacagcaccatctgctgggccctgggtttgtgtctgcaactggatgggctctagcggggttctgcccaatctagcaattcgaggtggcacatctacaccaatatccacctgctgtttaccagacgccatgccaggcaggtggtcagcagtgtgcatgcgaccacttgctcacggcctgcactgagctgtgtgtggagagggacctgtgggacctgggtgctgcttgtggtgcaggcccaaccaggctcagggaggggcgtctgctgctctgaggcctcggggggtgcccacccgcccaatggtcacccaccacgtgcggggcaaatgcccaccgcagtgctcacctccagacaaacatcgctgccttcctgcagctccgttccaggcagggaggcacagatgagacgtggtgggcagatgaggttgtttcaggttgtgttagacagtgtggaggaaatcaacagaatgctgtggacagtgccccggcggtgatgggcagattagggactgcacgcaggagtcagtcacgggaggggaatggcaccactgtcccaaaaacagcaaaaacgagtccaagcatggcactgatgggacatcagaggagacaaaaggtggtggctgttggtggtgcggtgaggggaggaggctgggagggaggtggaagcttgggcaggcgccgttggcgttcgcattctattctaagcaccatgggaagctgtcaccgggctttaggcagcgcgacgacaggatccgatcgaggctttccgtgttgctagcaaaggaattcaacattcctgacacgggtgaatggagagaaaagtgatggggctctttccagaggtcaaggttaaggggactctcatggatgggatgcatcctgggaccagcaaagtgggaagtggtcgcctcgcccaagcctgtggggaccagagagggagtggtccccggaggcccacagagtagggccgaggacaggggaggacacaggaacacgaggggctgccgagggagcaggaggtgcagccgccctcagatctggcctgcaggggtggagcaggaaatgacaaacacccacctcttctcctggggatggtggagcctgaggcaccacgtccacgaggtcctcttggggtggaggcagacctggaggggcagacacactctcagcttccagaaaaccttgactccaagaagtcacactgagagatacccctgtcgctggagagatctccttttccgatataaccactttattcccatatctttggggtgtctggggaggtgactcagtccctccaaagggaatgagcatgaactgggagggtgtgttggacccaggagactttcactgcaataaccacatcttccccttgccctttcagcctccttcagtgggacccacttcccttccctgcaccgaaagggagtggctcgtgagtatttttagatgaggaacctctgcccatgcagtcccaggcaatgagctgcgctctcagtgtagctttccacttcactcccctctaagctgcaccctgctgtgggctgaggctttacgaggggccggaccagggtcctctgtcagcgccctgctcagcccttcataggctggttgtggttttgctccccacagcaggcaatgctggcaccagggaagaggggtaaagagacagggctgggctcgcttggcagggctgtggtgcttgtgtgggctgtggtggttggcaggctgaggtggttgtgtgggctgtggtggttgtgtgggctgtggtgtttggctttaggtgtcagcttggctaggcatggcacccaattatgtaaacacacatgaatctcagtgctcccgggaaggtattctgtggacatggtggatgtgtcccgtcacctgacttttagtaagggcaaatgctaccacagcgtgagtgggcctcacccagtcagctgaaggaaggagacattctgccccaagactttagcctcagcctcagcctggggtttccagcccattggcctgtcctgcagatttcagacttgacagcttctaatcacatgagccaatcgcaaaaagaaatctcctatctggatccacatctacatttatatacccatatccatacatatatccatgaatacctccatatccatacctccatccatgtccacgcctccatccacatccatgcctacatgtacatacatgtctacgtctgtatccatgcctacatccacatctgtgcctacgtccacctccatatctacacccacatccatatctatactcacgtccatgactacacccccatccatatctacacccacgtccatatctacaccctcatccacatctacacccacatccatgactacacccacatccacatctacacccacatccatatctacacccacatctacgcctacacccacatccacgcctacacccacatccacgcctacacccacatccacgcctacacccacatccacatccatatctatacccccatccacatctacacccacatccatatctacacctacatccatatctacacccacatccatatctcactctcatccatacctccgtccacatccgtgcctacatctgtatccatatctacagccacatccatatctacaccctcatcatgtctacacccacatccatttccaagtccatgtctatatctatacccatagccacctctgtatctatacccatatccatttccatatctgtatctatattcatagccatatctgtgtctatacctatatgtacctccatacctatattcatatctacatccaaatttatttccatagccacatctgtatctatatctgtattcatatcatatctgtatctatacccatatctatgtccacatccatatctatgcctaaatctgtacccatatctgtatccatatccatctagatccatattcctatctgtatctatacccatattcatgtccatatccatacctctctctatatcaatatccatatccatattcatccattcccgtgctcatgtccacttccatatccacgcatgtcctgttactctgcttccctggggacccctggctgaaacaggaggcttctattgaactcactggatgtggcaaattaagaaaggtttctcttgttctggggtcttaggtgacccctgctggtcccctctgttggtgatttccttgaccctggggtgctgccctctctgcagcgtcagcctctactggttcttgaagagaagcagcaggccagccccatccctctggatttatatgtgggggcagatctctcggtcatgggtctctcaggtgctagcaccacagcatggagttatctgagttgtcatctcagagcaggaactcatcaccaaggagagagtgccaagccatgcatgaggaatccactgccatgatccaacacctcccgtcaggccccacctccaacactggggaccacatttcaacatgagatttggaggggacacacatccaaaccacatcaccacacagttgtggtgataagatataaaatctgtcatggcaaaggcaaaaaataaaaagaaatgaagttgagtttaacaatcagtggtaagtggcagttataaccactgtgtcttctgtctcatagtggaacaccgaggcatggggcagcttcccatcaccttacctttgatgatggtacctcttagctttcttcttggggcctccgtctctccatttgtaagcagaatattggatttgctagttcctgcggtcctcccagagtgacatgctaggctgctgactggaattgcggaggggccagagcagaccgtccctagaagggtccgcccaagtaggaaatgacagcctccctgccttgtcatctcctcctccagagtggacatatggagacttcactgcacatgtggggattgtgcttgttgacctcgtagttccctctgaagagggcatttgggtctcaatagaggcccagttgctgcccagggaaataagaaatcctataacatccacagcttatatggccttaaaaactcaaagaagagctgggtgtggtggctcactcctgtaatcccagcactttgggaggccaagatgggcggatcacaaggtcaagagattgagaccagcctgaccaacatggtgaaaccccatctctactaaaagtacaaaaattagctgagcgtggtggtggatgcctgtagtcccagctactcaggaggctgaggcaggagaattgtttgaacccggaaggcagaggttgcagtgagctgagatcgcgtgactgcactccagcctggcaacagagcaagactccatctcaaaaacaaaaacaaaaacaaaaacaaaaaaaaaccacacaaacaaaaccaaaaacaaagacaaaagaaacccccaaaaaactcaagtccatatgtttaaatatttgacaaccattgcccttttgggggattcgaagggagcaggaggtcttcagggctgctgaggcagaattggcaccatttactcaaagcttattgctttctgagctcttgtctgttaaatgtccctggacagtcctagccaatgaaactcaccttagtttgcttcaattttcctgtctctgttcattcatgaccaaatgaactattttggggagagagaaattgcctttcctggtgaataacaagttagtagatcactggaggccaattcaaggcctgttaggagcaaatccagcctttgcaaggattatttcaaaacctggcatttccgtcgaaaaatcaaactgggcttgctgttgacctgaccatgtgtgttgagaccacagtcctccatcttacttgggtcatgttgactcatacatcggtagtttggaacccactttgtccatggaaatggtggtgttggtggaaaataaagcatggataattaaaaacaaaacttctgaagttactgtctgattttttttttttgagatggagtctcgctctgtcgcccaggctggagtgccgtggcgcgatctcggctcactgccagctccacctcccgggttcacgcctttttaccgcctcagcctccggagtagctgggactacaggcgcccaccaccatatccggctaatttttaaaacttttttttttgtatttttagtagagacagggtttcaccatgttagccatgatggtctccatctcccaacctcgtgatccgcctgtcttggcctcccaaagtgctgggattacaggcgtgagacactgtgcctgacctactgtctgatttttaatttacctttgagccaacttttaaaatcagtctccctaataaatgagggaggttgaggggtgaaaaggaggaagacatcccagcagcaggctaggtgccagaaggaagctgtcctggggttaaatgctggccaaggctattactgaaatgggtaactcacattcagatgatggaatctggctgcatttagtgagctcttgcatgtgtatatttttatgccatatactggacttccttaaactcaaggtatttgatgcacttcacgtagtggttctcagcagggaggctgcagctagactgctgtcatttaaatacagtgtctgccactcactagctgtgtggcctagcgctgggcttggggtgaggggagtgaggtccaggggcagtgcacgtgcaggcagacccctgagcagggtgccttcttaaattccgggccccaggcgcttcacttgcctcgtcacagtcccagccctggagtgacccggagccttgtttagctctatacctcagtctcttcatctgtgaaaggggggtgactgtgacacccaccccatagtgttccaatgttggggatagctgaattaaaaggctggaggtatttaggatggctcctggcacacggcaggcgctgggcgagcatcagctgtcactcaacacacacagaggctgctttctcaagggcaggaagcaggggaccttgaagcttttccttctggtggtcctggagtttccatgcatgtgctacttggaagccactgactttcaacatcaagctcctgctgcacccattttctggggctggcctggtgcttgggagcctcattcttgccttgccagggtctccctgctggactggccactggtaggctagaggaggctgcaaggatgagtggaagggaggacctgttgccctgcttccctctggttcctgctttacttcctgttcctgcctcatttcctgctcctgctttcctttctgttcctgcctcacttcctgcttctgctttacttcctattcctgcctctttctggctcctgctttacttccttttccccctttagtttctgctcctgctttacttcctgttcctgttgtgcttgctgctctgctttcctttcccgctttacttcctgctcctttgcttcctgctcctgcctcacttcctgttcattcacttcctgcttctggtttactttctgttcctgcctcacttcctgctcatttggttcctgcttctgctgcttgttcctgcctcacttcctgctcctgctttacttcctgctcctttgcttcctgttcctgcttcacttctgattcctactttgcttcctgcttctgcttggcttccagtctcgcccttcagctcccactcctcatcctgctcctgccactgctgccccacagcatgacttcctgttggtggcaggtgggcttgaccttaggactttagcacccagaatggggaaataggcaggagaaaggggtctcctagaaaggcagaaggcggggactctgtggctgtgggaatgtggggatgccaggagcctcctaccctgctggtgggagtgaaaaatggtgcagccactttggaaaactatttggcagcttcttaaagagttcaacagagtcttaccatgtgacccagcagttctcctcctaagtattaaactaggagaatgaaaaacctaccttcacacaaaggctttctacagatgttcctcatagcattattcctaattactatagaaacttcaaacagcctgaatggccatccgcaggtgcccacctgagcaagtgtggcccatgcgccctgggactcactgccccgctgtcagagaggatgcgctgcagcttcacgccacagcaggcatggcctccaaaatagtgcctgacatggaagaagccagatgacactgcaagacttcatggataggaaatttctgggagaggcaaaacggtagagacaaaaagtagatccgtggttccctgaggatgcgggtggggattgactgccaggggtacagtgaagctttctggactgatgtggctgccttagaactggattttggtgatggttgcttaattatacgtttactaaaagccatccaatgccatctttaccatggatcaactgtatattcattataatcctataaagctgcttttaataaaatcattgtccaaatatttaaggtggtggatatcccagttacactgatttgatctttataaatgatatgaatgaaatgatcacatgaaccccccacatatgtacacctgctatgtatcagtttaaaaaaaaaacagtgcctggccaacatggtgaaaccccgtctctactaaaaatacaaaaattagccgggtgtggtggcacacgcctgtaatcccagctatttgggaggctgaggcaggagaattgcttgaacccaggagctgtaggttgcagtgagccgagaatgcaccactgcactccagcctaggggtcagagcaagactccctctcaaagaaaaaaacaaaaaacaaataaaaagcagtgattgtccccatctgcgtgcaggacttgggaccgggacctgccctctcacgggcgtttggggcgttctgtgttcgctcctgcaggcctgcggagcantggggtgagcagcagagagcgctctgccacagctcccaggagaagctcgcgcccagctgtggatgcggctgctttgtctctgtggcaactgttttcttaaaaaccttgggtcaatagaatctgtgtcaatcaaatcccattttctccttgacctacgtgaccccttaagagctgtgtaaggtgctgctgaagagcggcctcggggacttaaggcctggaaatccagcttgtaggaatgatccgcacacaatggcacctgtagggcgttgctgctggggcatcctgcggagagtgcttttgtgagatggagaccattcaggccccgtggaggatcccagacagcagggggctctggtggtccatgggtgggatgacccgccggcctgtgctttcctgcacaagggcctcctgaggggaggactccagggagtttcccacaatgcccagcagctctgagtaatcctcctgggatgggagagagggagcacacggaagagaattcctaggtgaccgtggcagggacaaacggctcagcaggtggcttgtccggaagtgctgtgggagtctgagctctggtggaatcccaagattaaaaaacaataataagaagaaaacaggctgggcgcggtgctcaggcctgtaatctcatcactttgggaggccgaggcggacagatcacctgaggtcagaagttcaagaccagcctggctaacatggggaaaccccgtctctactaaaaatacaaaaattagctgggtgtgatggcacacacctgtaatcccagctactcaggaggctgaggtaggagaatcgcttgaacccgggagatggaggttgcagtgagccgagatcgcgtcactgcactccagcctgggagacagagcgagtctccgtctcaaaataaaaataaataaataaataaataaaagcaaacccactgtgctaaaggaatgtaacaatgccctgacagtcatctcgctaagcctctcttgataagatgaggctggccaggtagtgaaagggtttagacctggctggaaagcgactgtgtctacatgaaatgggggttattttatcctcaggctgctgcggcatccacatgcctgctctgaggcagcgggacacggttcgtgaccagctgaactgagggtggggtgggaggactgaaggtttgaaagctgtgaggataatgatgccactggctttgatcttgttaactgtgagatgctgctcagacacattggggtgaggtctgtggccagctttcactatgggtgtggacagagaaggggtttgagttggagacagacgggaaagttatcagggggaagtgacggccgaccacctgagagtggtttcacttcctggaggatgcacatttacatatattaaaaaaagagctgagtgccagaccctgtaaaaacaatctgaaaatcagtcaaagaagacagatctagctaaaaagacggagaaatccacgtggccagagtaaataaatgaaacaatgcaatgaaagcagctcttctcatcaacaatttttatggcaattttgaaacatctaagaagggggaaagaattgttctgtaacacggacgaaccaccatctggattctgcggttaacatttggcagcatccatcatctcaccatcactctctccatcatggagtccgtcgtagtagtctttaaccaaaagcagcttttaaaattctgaaattgaattatagactcaattctaactttcaattacacaattgaaatttacgtcggcatcctaaagtcccttccactccatagggtaatatttagatcaaatcttcctaatggtaaatgtcctagaagccagtgcagctcacaaataaagaatctcatttcaagagagcaactgtgaactcagggtaacgaaatctgtccaaatacacaggtgattgaaaaagcgtgcgaacctttcattgtatgaacggagaataccttgggcctcttcaagctgggaccatgcagggcaaacctgcctcccattctattcaaagtcacccctctgctcagagatagatgtatattctgattgcctcttttggaaagacttatcagaaactcaaaagaatgcaaccatctgtctctcacctacctgtcacctggaagcccccagtgtaggggacttgctttgagttgtccccacctttctctacagaaccaatgtacttcttacatgtattgattggcatctcatgtgtccctaaaatgtataaagccaagctgtgccccgaccaccttgggcatgtgtcatcaggacctcctgaggctggggcatgggtgggtcctcaaccttggcaaaataaactttctaaattaactgagatctgtctcaaattttcagggttcacagttagttaaacatgggacgatctaggtagccaatactcgtgtgtgcaaggcactgttctcagcgccgttcacggattcccttatttcaggctcatacaaacctacgcaaaccaaaaataaaattctaaggcccccaaccatctgaatgggcccttcctctcgcctaagggcattccaaattgaacctgaaaaactagttcagggtatgatggaaagcgcgggtcagtcatgcctcattttcctatcctacctttttttttctgagatggagtcttgctctgtcacccaggctggtgcaatctagactcactgcaacctctgcctcctgggttcaagtgattcatgtggcctcagcctcccaggtagctgggattacaggtgtgcaccaccatgcccagctaaattttgtatttttagtagagatggggtttcaccatgttggctaggctggtgttgaactcctgacctcaagtgatcctcctgcctcagcctcctaaagtgctgggattacaggcgtgagccactgcgcctggccttcctctccttccttttggaactcaggaaaagctgattagcatttaacatcaacgcagaccctaagtctgaaaagaaacatttacagtctattttctctgaagtctgctacctggaggcctcatcggcatcatgaaaccttgctctccacaaccccttattgtaacccagacatttatttctattgatagtaatgctttcaacctgtgaacctagaacatttgacggaggtctcagttactatttagaaagtttattttgccaaggttgaagacacacacccatgacccagcctcaggaagtcctgatgacatgtgcccaaggtggtcgggcacaggttggttttacacattttagggagacatgagacgtcaatcaatatatgtaggaagtacactggttcggtctggaaaggtgggacaactggaagcaaaggcaggaagactcgaagctgggaggggacttccaggtcactggtaggtgagacacaaatggttgtattcttttgagtttctgatgagctttgccagtggaggcagatcagatatgtgtctatctcagtgagcagagggatgactttgaatagaatgggaggcagatttgccctcagcagttcttagcttgagttttctttagtgattttgggggcccaagatattttcctttcacaaaccaactgctaatcagaaaattttaaatttacatttgacctggaagccccacccctgctttgagttgtcccacccttgcagatggaaccaatgtaaatcttacatgtatttggtggaggtctcgtgtctcccttaatatgcataaaagtaggctgtgcccccaccacctggggcacaggttctcagcaccccctgagggctgtgtcacgggtcatggtcattcatatttggctcagaataagcttcgaatattttacagagtccgactcttcgtcgatacctgtggggcatcagcgctctcatcattccgttttatggatgaagaaactgaggcccagagagtttaggtgacctgcccagggtcccacagctggtcaggggccatgctgggatttcaccagagcccagatctctggcacctgtcagcacaccatgctgcctcccagacaaagcaaagaggtgccatcttaaaccctccaagttagccgcgatctgtaaaaaaggatgatgcttcctgttggcagggatgcagcgagagaggcctgcccacaggaatgtaaatcggtgcatcccggaaggctgtttggcaacatgacccaagagccatgaaatgcgtgtgtcgactgatccaggcattttgttcccaggaataaatggccatgaaacaatgcaagaggtggagccaatgtcctatccaggggtattcgccggagaatttgacgagtgaggcaccaagcagcagaagatgcttattgtatacattatgaaatgctcctgtaatagtaatgttcacaggtcacgatttaaagaaaaatttatatgatgagaaagtgtttactctgtagaacacatcaggttacaaaacagaatttaggaaaacaaaataaaatcacaaccgtcttcatctactgttatatgtgtatacaaatacacgtaattataatgtatgtatagtccataaaataataacataaaatacattggaaaggtaggtcccaaaaataccagcaacgcgttatttcaaagaagggctttttggggtggacttgacattttgctttgggcttttttgtgtcttctgcaaggggcatgcattactgtattaccttaggcatctgaatgctatccttccattctcatagtggtagttacagaagaggctgcagtcagctcaaacgcttcccttttttattgcgggtgcagaggcttcgagggagagggaaagctgtcagtaggtggcgccagagggtggcagttgtctcaggctgcgtcagggctggtgcgagccactggtccttaaagtgaagcccctggttctctgccatcccatgtgcaactggtgattttgcaatttctgcatgtgtgtggggcctggctcccctgtggctggaggcctgcatggagcagggggcatgccaagctagacagtgacaaattactaccatcgagggcacctaagcacaccttgggctctataaagcacagccagagccaagtgctgcccttaaaaatcagataatctcaggcggttgtgaagcaaagtgaaaacaggaaaatgcaaggggcggagaagctgtcggtggagagagaaacagtggagagttctgccaagaagcttatgcagctttttcctctgaggggacagagaggctgggagagtggagagctgaccctgttggtctaaaccctttcctatggagggagcaggagtgaaaatagcaaccctgaggacacggatactttaggtcagtgtagcagttgagagactttgacctggacatagaagccagagatgtatgggttcaggctctcagaaaaaatggagtcagtttctccctccattaatgagaatagataaacccagctcagctaaattcttttttttttttctgttgccaggctggagtgcagtggcacgatctcagctcactgcaacctctgcctcccaggttcaagcaattcccctgcctcagcctcccgagtagctgggagtacaggcgcccgccaccacaccccactaatttttgtattttagtagagacagtgtttcaccctgttggccaggatggtctccatctcctgacttcatgatctgcctgcctcggcctcccaaagtgctgggactacaggtgtgagccactgtgcccggccagctcagctaaattccaaaagtgtttattgactaccttggaaatgatcataatgatgataatagtaattacaattgccaccaacatttatgaaacccttactgtgttaagtacttaacatgggttattgcatttaagccccaccatggtccagcaggtggatatgactgccatcatccccgaattacacatgagggcactgaagcttaaagaggtgaaacaacttttccaaggtcacccgtggctaggtcttattgcacacttaataggagccaaggagagtgagtcacgatagggcaggttatgctgctgtaacaaacacattgaaaacctcagtggttgaaaaatatgtttatttctcaatcatgttatatgtccattatatgtcatcaggagggctctgcttgttgtagttcctaggggtctgggtggaaggaagctccatctgaaagcatttttccatgtgggtagagacaaggaaaagatcatggtaaaccacacatggactcctagagcgcctcacctgaagtgacatgcacaccaatgactgctcacagtgtgttggccggagcaggtgccatggctctgcttcagtcagtagagggggatgggcacgaatatgttcctcttgcaagaaagggaaccaagtatctggtttccttattctccatagcaggggtcccactctagccacagagtggtgccattaggaaccgcaccacacggcaggaggtgagtggtggacgagcgtgaccacctgagctccgcccctgtcaggccagcagcagcattagattctcatagcagctcaaaccctgttgtgaactgtgcgtgtgaggggtctaggttgcctgctccttaggagaatccaatgcctgatgatctgaggtggaacccctccccacctcggtctgtgggaaaaaccgtcttccatgaaaccggtctcaggtgccaaaagtttggggacggctgctctctggctcctattaacgtgcattggtttggaaaaagtgcattattttatttgattttacaacacgctgtgtcaggcgttattattatttttgttttatgcaagagaaaacagagtttctgtagcacacccggctcacatggctactaagtggagcaggtatgattcaaccttagctctgttccagcctcaaagcccagctcttcaaaaacagttatatcccatggcggggagggggtctcagtagatacgttccaggaagagtacgcttcttggtttataaaataagatatgatattaaatatttggtatttaaatattgcatttaaatattcgtatatatttaaatacaatttaaacattacatttaaatattcatgtatatttaaatacaatttaaaaattgcatttaaatctttgtgtatatattgttccattatttaaatattgtatttaaatattgtacatggtatatgtatatgtacatacatgtgtatatacacatatccacatatatacacatatatgtatatgtaacatgtgtatatatacatatacatatatataacatatacaatattgaatattatatatatatgatatacatatatcacttctcaggaatgtgtttaaagagaaaatgtaaattttgggtccctaagttcaacacaatattttaaacaaaatgataagtggacaaaatctcaactcacactcaacatgcaatgggtagagccttgaaatcttgtgtagatattttgaaaaggtcgcccagtgtcagcaaaagaaccgggcatctcaccaggcatctcagacgttatggcactaagggagaaatcctggagctaccgcattcaaaacgacggtttgtaacaatctcatgaattgcttgatggccagggagtgatgttctgagatttctacctactaacacaacaacgcgttgtgtatatttagggcatgtactggttttcagttatgttttaggaaattgggtggcacgtttgggtttatgtgtagcatggaatagcttagtaatagaaagaaactaggattctggagaggactttcacaaagaaattccgatattttgggaagagattgttgaggtactaaatgagagatgaatagtggaatcaagtatgtggtacagttgaaaaatactacaaattcttgagtccctgacatcaagacatagaatgggaaataagacctacgcacctgtctgtgtgtgcacaggtatgcatgtgtgtgcacatatgcttatgttcagatggaggctgtccgtctgaacttaaaaaataaggactaatcaaaatatcctccagggactctaagaaataaccgagacaggggttggggtggcctaagagactctgttatgtacgctgtggtaataaacctgtgaacagcacattgctatgttaattcacacttgtagacatgttggcaacacatacggatatttagtctttggaagactctggggaagtctcctgtgtgaagcataaaacccctagcattaccataaaatgatgtttcttctttccaattatactgggctttttggaatcgtcgtctcttaacttaaaggattatctttcagcggtagaatattcgatctttgagcaataggttgttgcatgagatgtatttacaccaagatttcatcctggccctttcactggtaccattctttctttagctgcttctgccccaagagtcttatcgtcctctcattccagtgttgtgtattttagttgctgttgtttctggatcatgcattaagcagtaagcatgatattgacagttttctgtgtcctttcctgaggtgggctggagaggatctgttcctggaactagatttcctttctggatctgttgacaaatgaatctcacacacaacttctctgctggcatcagcatttgctattccccatggagtccagggttcatagcttttctgggcatgaaccctatgatctatcagccaactggacaaacagaccaggcagaagagctgctcgcaaagccagaaacgtgtgcatgagctgctgggtggctcagggaaggtgggctggagcagcttggcgcttagttaccagtctcgtggagaccctcgctggtgttttaaacatccttcctgctgggctcacctcttaaacacatcagcagtatctcagtagcgaagtagatgtggaggacgctgactctgggaaggagaggaggagtggtcagcctcatgcagagccttcccccagtgggaatgtcacctgaattagggcctaagagctgctcatattttaactgaaaactaccttgtggggagaaggacaggaagaaaccctaagaaaatatagtgcggtctattttactacaactatatctggagcttaaaatgaaaaggaagaaaattgttacattcgtttaaaatgggtttgagcaaagcaatagaatacatggctaacagtggcttaacacatagggctttgtttttctcacaagaggaggggtttgaatatggtcaactgagagcaaggattcaatgcatcgaggatgcctggctgtcgttcttatgattctctgggcctttgcctcgtggttgaaggatggctgccacagctccagccatcacatctgaattcagaatgggaagcagaagaatgaggaatgagggataacactaatttcatttgtttcctcttataaggaaagccagcactttcccagaactctctcctctctatgcccgtcagatttttgcttagacctcattggccagaagagtgtaacacagctacctgttgctccagcagaatcagggttcactgccaccctgaattaatcagtatatttctgtttatataggaaaaggggtgaatggatatcagaaagcattagcagtatctgtcccattaggggtactgagttttgcctaatgactttctcctcttctgtttaggagaactgttcaccctgtacctcaccagggagaggcgatgccctctgcaagggttctctccaccaaatccaaaggtcatcagtgccacagagaatcccagcccctccagcaggtgcccagggatgccagtctggacagacacccagaaatcagtctactggaggtgaacagtgagggcctggggtggggtcggtgttcaggtagctcagagtaaatgccctttgcattactggcctgtagataaatgagcctggagagcatggcccccaggaatgacacaaagaaaagagctttctctgtctttgggatgatttagagatttttctactgccttaaaaaacttttattattttgatataatttaatgcagaaaagcagcaagaatagtgtaaataactccttcaaacctttatccagaatcattaaactgtttatattttgccccaattttttatcattggtttcttggtatctatctatctatctatctatctatctatctatctatctatctatatctattaatcatctatcaatctattgatcatctattatctatcatctggctattatctatcatctgtctacctatcacctatctattaccttattacctatcaattatctatctatccatcttctatctgtcatccctctatcgtctgctatccatacagagagaagagagggaaatagaggaaagtgattttcccccagaattatctatttgaaagtaaattcagatatcttatcctttatccttaatatttcagtgtgtttttttctaaaaacaaggagattctcttataccaccacaatacaaagttcaaaatctgaaaatctaatactgatacaatactatgacctaatctgcagtccctattctcatttgatcaactgccccaataacttcctaatggccactttgtttcccagtccagaggccgacccaggatctcacactgcatgtgttggccacgtgttccagtctccttccatctggagcagtccccgtctctttgacccgattgaagagtatagcaagttactctgcaggccgtccctgggtttgggtttgcttggtgtttcgtcatgatttggtttagttgtgcgtccttggcaggcccatgatatgtagataagttactgtggaagtgacgtcctggcctcagtatccctatcaggacgcgcaggactttggtcggtcccgctgctggtgatgttgactttggtcgcctggttcaggtagtgtctgttatagatttcccactctgaggctactggtttcccctttgtaattaataaatagttcatggggagatgctttgaagctgtgtaaatatctggtatttcacccatatattagaggtgcagcccccatagcttttttaccagtagggatatctaaaatttagaaatctttgatcattcctgccagtagaggtatgctaaatatatgtatatgatcaaaatgtttggaaaaaactttgtccaaaaacaaacaaaacatttgaccagggaacagcaaacgttttctgtaaagaatgagacagtaaatattttaggctcagctggccttatagtctctgtcactactagttaaccttgccataagagtgcagaagctgccatggagaatatgtaagcaattagctgtgacagcgttccattaaaacttcatttataaaaacaagcggtgggccagaattggttcatgggccatagtctactgatctgcaccttatgccacagtcaacttgtttggccctgaaaactcagaattcctccttaggggtgatatttctactctctagcctctgacctagaagctttagggtcttaattgctggcacataaatttgcaatgaaggaatcaaattgtgcagcagcctgttgtatgatctcaagggcgctgacatcaactgggcttagaacggccaagtcccctttgcctgtgtcaagaggttttcctctagaaacttgtattagtcttttctcatgctgctaataaacacatactcgagactgggtaatttacaaaggaaagcggtttaatggactcatagttccacctggctggggaggcctcacaatcattgcagaaggccaggagaagcaaaggcatgtcttacatggcggcaggcaagagagaaagatcagctctcgtgagactcgttcactcccacaagaacagtatggggaaaaccgcccacatgattccgtcatctccaactgggtccctcccacaacatgtgggaattgtgggagctacagttcaagatgagatttgggtggggaacagccaaactatatcaaaattattataaagaaggacctcaaccaagagctgacacacatgggttttgtttgtcttgtacagttttaaaataatctgagttatttttggtgggcatgggctcctccagttcccacgagccccactccctgcttctgcctcccgcctccccgcatttatgggttccgcttgaccgtgagatgatgtttcttttccacctctttgtgaggtcttgacaatcagggaatcattttctagaattcctatctcttgcagccataggatgctaaatcccaaaaggaaaattcaccaaatcaggatgtttatatttagtgcctcaattagccacactccaagaagagaattttcatcattgtaaggcacactccagggaacccagcgcttcagaaggatgtggctctttgcttagtttgtttagctctgtctggttgtgcagattgggcaacataacctggatcggccaggacacttctggatcaaagtgttgcacccacagccggttcttggtgcacaagagcccaggcttctagtcccagggtgtttcgggtgggcgccagcaagtcagcagccgaggggaatgagtgttctaggcttgggggttggttggagacaatctgttagtttattttctcagagagggaggtttgtgggcaattcccacagtgggactagattgagatagtcaaccttctgtgtgatagctgccacacaggcttgaccagcagtggggttcttgctcctggatttccagccaatggggcaggggtgtcagccagtgaaacacacaacgtgaagatgtccggcactggcggaaacatgcagcgtgcagcatgtaggaacgtatctggggagacgtatatatgtggactctgtaggaatctgtctatcggggaaggatgtgggggtgctggagacccacatctcaagccatctctgtgtattctgtttttttttcctttgcaaagaggattgatacgtattttaaaaagttgaagtggatgtttcatgctcatgttttgcagccctgattttggggttttggaaatagtccagcaaaagtttgcctgattccattaaaaaatccaaatacagactttctcatcgcaagagaaccttctctttaccagagcactgggagcacccagaccgtggaggggaccctcttagggggaaaggtcaaactggagtcactgagctgaagccgctcggtgtcaggtggaaccaagtgtccccaaaggccctctcctgggcttcctcccgtgggggcccctctgcggggatggggtcactggccgtctctcatgccctgctttccctctcatgctgtatctgtggtctatccttatgcctggcaggtgtcaccaactttaagttgtgcgacttggggctcacacactcacacccttccagggtgggagggacgaacaagcgggtgaagccagacagaggatgctggggtgggcaggggagcggagggcccaaggacagtgggcaccccctgcccagaggctgccaactgctggcctgagggcagagggccagtgtccctagatctggtttttcaagagaagtcagaaatctggaattgcgtgtgcaacccccagatttttaaatcttgccatcaaattcagtttaaaaattgggtggaccaaaatgtatgcaggctcagttccacctcaggctgcaggctgacttgtggaatcagttcaagggcactgtaaggtcatagttatcctggaggacgtgttagtctctgggtttgctgaataatccagctgtgccagttaggcctgggcgcagctgcttctacaggcaaaaataatagtggcttagacatagacgtttactcctttctcatgtaacagaaatctagggctgaggtgggcagatcatctgagctgaggagttcaagaccagcctggtccacatggtgaaaccctgtctctacaaaaaatacaaacattagctgggcgcagtgatacacacttgtaatcccagctacttgggaggctgaggcaggagaatcgcttgagcccaggaggtggaggctgcagtgaacaaagatcatgtcattgcactctagctggggcaaccagagtgaaaccttgtctaaaaaaaaaaaaaaaaaaaaaaaaaattccagaagctagtttggcagctccaagagggactgagcttttatctttttgctttatcatcctcatgtgaagactccattcttaaggtgacctcataggccagtatggtggctgaagctccagccatcacatccacattccaggtggtagaccagaagaaggggaaatgggacaagaatgcccctcccagaggggcctacctttaagcagcctttcctgcagtttgacacacaatctcctcttatactcattggctggacttagatgtgcaggaacttaattaaggaacttaatttttattctggacagcaatgtggccagataaaaatctgggttctattactggagacaattataagggtaaatattgtgtggataaagaaaatgtggcacacatacaccatggaatactatgcagccataaaaaaggatgagttcatgtcctttgcagggacatggatgaagctggaaaccatcattctcagcaaactaacacaagaacagacaaccaaacaccgcatgttcttactcataagtgggagttgaacaatgtgaacacatggacacgggaacatcacacaccgagacctgtcgagggtggaggggctgggggagggatagcattaggagaaatacctaatgtagatgacgggttgatgggtgcagcaaactgccatggcacatgtatacctgtgtaacaaacctgcacaacaaacctgcgcattctgcacatgtattccagaacttaaagtataataaatttttttaaaggtaaatattatgtagcatctaacttttatttttaaaaaaggaattcttcacttaggtgatctcatgggggaggtcagagggaggcactggaccagtttgaggggacagcgcatgactccctcctgcctcgggtctgaactttcctgcagtgaccacccttcctcccgggtcataaggaattctaaaaacaacaagcagaccgacaaaaatgacgatggtgatggcgcgggacttacctgcagcctctgtctgccgtctcctgcttctccctaggtctcagtgcagatgcctcctgcccagggcgactttctgcatccctggagtggctcgggacccctgttctgtgttcccacagctctcagcacttttccttcatgcacgttgctgcagtttgcaatgacagcttctgcgactagagtgctgatgccagtccctccccaagggcaggcctgagcccactgctttcaccgttgtgtgtcccagtgcaggagcctgcacgtaggggccacgcgacaaagaattgctgaatgaatgagttaccacaggacccgatataaaaataaagggaactataagaccagatgataagcaaaataaaaaaaataaaactggagaactaagagagctaaaatcatgtaagtagaaaaatttaatagctcaagagctagatctcaaggcatcttctttttaagataaggaaagctaaaggtgggaatcagtagcggaagaacaaaaggaggaaataaaatagttaaaacaggggcagtagagagacggctggctccagctctgacgtgtaggaagcccagaagccatcatttacttccagcaagaaacagctgaacaggctcagaacccgaggatgtcctcggccccctcagagaacaggttgtggatgagccaccaccccgaaatctggaaggatgggtgaatgcaggcctggggcagaagtcgtggaaacctcgaatgagtgggggaggatgggaacaccccggtggtgactttgctgagctgctggaggttgagtgtggaagcttgagagtgagaaaccctggggcctccctcctaggggtccctcacactcctgcggttcaaacctccaggaagcccacacgttctcacaagtgaaggtccaagaaagatccccgttggctctggaaaggggagcagaagagtcacccttgtggaatctgcccagagtgttctccccaacacaggcttgctccgaggcctgccgaggctggggaggcacttcttccaccccggccctctttagcctccctgtctcacccaaggggaacagaaaagctacgtcactggaggaacacttgtgaaggtcatagcccctaaaaacggagactccatcgtgggatgactggatgctttccttcccccacacctcaccgccacacatacacggctccggtgccgtaaccctgggttccagccgaaagggctgcaagatgtggaccctccctgaggaggaggacttagggaagccccaggtcaacaggtgagacaccagcagggacgttagaggagccggaagcctccgcgaccggcagctgcagcaaccagtcagcacaacccaggcccagccatgtacgtcctcaggctgcagccctgctcacctcagtcctgttacctggcacagcatgtctggtctcaacagaaaattgcaaagcctgtaaaaagggaagaggaaaatacagacaaagtaaccatcagagccagacttaaagatgacacagatgttggaattaccgtacaaggatttaaaataactacgattgatgtgttaaaggctgtaatggaagatgtggacaacatgtaagatcagatggggtaatgtggctgcaggtacagagtttcacgtgtgcaggatgaatacgttctggagattgaatgagcggcatgatgattatgtttaataatactgtattgcagacttaaaacctgctaagagagcagatctgaaatgttctcatcacacacaaataccaaaaggtaactgtgttgctggctgtgttagcttgatagtggtaatcatttcacagtgtgtaggtggagcaaaacatcacattgtataccttaaatagatatgatttttatttgtcaattatacgtcaataaacttgggggaaaaaagaacagatgggtaggtagagaaatgaaaatgctaaaaaggaatcacagaaaatgctagaaatgaaaatcactgaaacaaaaatggtgaaatcctttcccggactcatcggtagatcgggcgtggcccaggcgagtcagtgaacttcaaagcaggtcggcagaaacttcccaacctgacatgagaaaaacacaatgggaaaacaaacagcaaaacaagtcaagtcgaaacaacattcaacaactgcgggacaatatcaaacgtgtcatatacgtatagctggaatattagaaggaaaagagattagagcagaataaatatttcaagtaataagggctgataaatttctgaaattaatgtcagaaccgaaccaaagatcctggaagctcagagaacaccaagcgggaaatataccaacagacatggctggacatggtacagtcacaccgcggaaaaccaatggagagacagccttgggagaagccgggggaaatcacctgacttgtgcaggaacagggataagaattccaggggaattttcaccagaaaccacatacgcaagaagagagaggagtgaaacatttaaagtgtcagggacacacacacacacacaccccaacctagaattctatatccaccaaaattatccttcaaaaatgaaggagaaacaaagactttctcggacaaaaacaaaaacagagggaaccagggaaatgaaaattaaaaccacagtgagatatcacctgatggccattattaaaaagccaaaaaacaatagatgttggcttagatgcgttgaaaaaggaggatgtgtacactgctggtggacatgtgccttagttccacctctggaaaacagcatgcagattccttaaagaactaaaaggcggtcccatcactggatccagcaatcccactactgagtgcacaaaggaagtcattgtaagaaaaacacacacacacacagcggtgtgtttattgcagcccagttcacaattgcaaagatatggagccaacccaagtgcccgtcagctgatgagtggatggagagaatgtggtatgtctacaccacggaatacttcgcaaactcagctgtagaaaagaatgacagaatttctttcacagcagcttggatggagcgggaggccattcttctaagtgaaataactcaggaatggaaaacaaggaccacgtgttctcacatatcagtgggtgctaagctctgggtatgcaaaggtcgacagggtgatagagtggacactggcgactcaggaaggggaggctttgcagggagggaggaaaaactactcattgggtacaatgtacactacttggatgacaggtgtgctacaatctccgacttcaccgatatacaattcatccatgtaaccccaaaccacttgtaccttgaaagctatagaaataaaaaaaaatgtataaaaacggagagaagtcaccaccaccagacctgccctgcaagaaacattaaaagaagttcttgcgggaaaagaaaaacagtatgtcagaaactcagatctatagaaacaagagtgttggggagggaatacgaggtggtaaggtctttgatttttcttactcttaattgatctaaaatagaatgtcttgcttggcatcataatagtaataatgcattggatgattctagattctggttaattgaagtaaacggccatgtcacaaggaacgggagacgtaaaccaggacgccccaccacaaagagtctgcactcactcgggctggagccgtgttattccaaggtggactatagttcaggtgaatgtccgtggagagctccagcacaggcactggaaagatttcgaaaatgtatataagtgaaggtcaaagagagaaatcatatcaaacactcacccaaaaccaataagggcagaaaaaaggatattaagaaaaaagtatgaacgacactatgtccacaaatgtaataattttttttttttttttgagacggagtcttcctctgtcgccaggctggagtgcagtggcacgatctcagctcactgcaacctccacctcccaggttcaagcgattctcctgcctcagcctcctgggactacaggtgcgcgccaccacgcctggctaatttttatatttttagtagagacggggtttcaccatgttggccaggatggtctcgatttcttgacctcttgatccacctgcctcagcctcccaaagcgctgggattacaggcgtgagccactgcgcctggccaaatatgagaatttaaatgaaatggatcaattctttgatagacccaatctgctaaaactcactcaagagaaacaggtgatctagatagtcccatatctattaaagaaacacagtgaacacttaataagcgtgcaaaacaagcacggcccaggtggctgcagccaacatcatagttagtggcgagaaactggacactttccctctaagattggggacagggcagagatgtcccctcttacctgttcaactttgtatactgcaagtcccgggtagtgcagtaagatgagaaaaggaagtaggagatgtacagattgggacagaaggaatgaaactgtctttatttttattcgtttatttttttttgagatgaagtcttgctctgtcgttcaggctggagtgtagtggtgcgatcttggctcactgcaacctccgtctcctgggttcaagtgattctcctgcctcagcccctccagtagctgggactacaggtgtgtgccaccacacctggctaatttttgtatttttgtattttttttttttttagtagagacagggtttcaccatgttgcccaggctgactcctgacctcaagtgatctgcctgcctcaacttcccaaagtgctggagttacaggtgtgagccaccacacctggcctcaagaaatttttaagcacaaagtacagtattgctgactgcagacctgatgtagtgtgccagatctctagtgcacactcacctagcgtggctgagactttacaccattgatccacagctccccgcgctccctctccagcctacggcagccaccactctcctctctgcttctgtgaggcatttgacagtttcagagacctcatctaagtggcatcatacaagatttgtccttctgagactggcttattccacttggtgcaatgttaaggtccacccgtgttgttgcgtgttgcagaactgacgtcgtttgaaaggctgtgtagtattccacggtgtggatcgtggaccatgtctggtgtatccattcatctgttgatggacgtgtcagttgtttccacaccttggctgttgcaaacagcgctgcgtgaagtccacattctgtctatggaagtcttgcagggtggggaagagcacagtggtgggaagcatgcgcagaaagcaggaggtggtcgttgtgagcaacgcacctaggctgagacgtgcactgggaataggacattgcgtgaggcatctgcaacggcccagcctcttgtaacagccaggtggcccctacctggccgatagctattgatcacgaagccagcggcgtccttagcccagggtactgcgcaaacaaccaaagcttgctcaggaaagactggatagttcgacaaataactcagacattgactacagacgtcactggggggattctgccctgagtccctgtgaagggattggccaatatcctcaccacaggctggacaccaaaccccctggcctggtctgtcttcctcttacgttgttcaagatagactcctgctcattccacgtggcgccgtcttgttccctcacagttttctgagatcagaatcattatttggtaaagatcctggtttaggaacattctagattagctctcgggatggcctcatccatagtgttgtgggggctgctttctccaggaagccctcctgcttcctgctttatctaggccctttgggaggggctctgtgcccccatggctcttgggacagggtcctgtgtgttccttgtattcactcggaagaaacctccatccaccatctttatcactttaaactgcacattgcataccggagacctacacacaagagaaataatgggaagatgccacataaacacacagatctccaatttgtcttaaagactcagaaggttcctttcttaggtggcgacccacctggtggccctgagcaggtcagtgactgtgtgctcttgggtccacccccttcacttcctgctctgctccgtggcccctgaaaatacacccccaggctctcttgctgggtggccgcagggaggatccatgcaggaagctatggatctccagagattggcgagtggggcagagaagggccagggcatttctcctgccgtctctgctcagagcaccacctatgcccgtggatctcttgtggccccagctttccctggacagcaccttcttctgtggctccagcttctggggagcagccccgtcctgggctctccctacctacccagcctatggtgttggcttcctgctgtggtctctggggtgcctctctatcatggctgagttgtgtcttcccagatctatacattgaagccctaattcctagcaccttagcatgtgactgtatttggagacagcgtctttaaagaggtgatttaattaaaataaggtcatgagggctggctctgacccaataggaccagtgttcttacaaagaggagattaggacacagatatgcatggagggatgaggacacagggagaagatgccatctgtaagctgaggagagaggcctctggaggaaccagccctgttaacaccttgatccagaacctccagccttcagagctgcgagataatatgcctctattgtttaagccacgtgtctgctgtattttgttatggcagcctggacaagctcatatactcaccatcctctgtttggcaatggatatcaagttcctccgatgaaactacctagtgttttcttatcacttttattatagtagaagtaagaggaaagtgacatatctttaatcctatgtgtctatcaaaagctggaagatacgagaccccagggcgacacgtgtctcttgctaggtgttgactctcccatgtgacctgcttagtccctggtcagcatctgactttgcaaaccctgatttaagctttcaactgttctgctaaagcagtatcaagaaagacgagtgctttttatttgagtttattgggtttcctgacgagctgggtaaactgatgctggtttcatcgctggggccttctctgtaattggtgggacacatacatttttgaaatttctgtaccaaaggaaaaaaaaagtccaaaatgtctctactgctccttgttcatgaacatgggtctcctctgcttttaggtgaaatattctcagtgtgttttttttttttcacgtaatcaaggagatgaaacaattcagagctgtctaaggccgtcagaaatgtctccaaccaatctccttcagggtttatctgtgcttcgctatgttgggcttcaaatcattctttttataatttttggagaaattccaaagtctgtaaacagctcttgttcttaaagggactgaagaaaaacacacacactctaagcagaaggaagataaaataagagaaaccgcgtctctgggacttctgggtttgaacatgatgtctttgtagatgtgagcacaggggctgagcctgatgaagcgccaggcacgtgggttctaagcggctttttgcttctctggggaagtgtattaagagtgatgcgtggaaacagccagtggccagcgtgtgcccctgccccttcccgggttccttctctgcagggcagctgccttcttgttggctgttaccaaacgatttcatcccggagccagtggagaattgtgatgtttgactttgcgctccgctgggatgactgttagagccagcttttaaaaacagcagacaccaggccgcgttgctctgcccagatccctccagtgactcttgtcttgctcacaatgaagcaggagttcttgcacatctaaaagccacaccaactggcttccgggtcccttctctccctcccttcctccctcccttcttccttccttgtaacccatccatgctggcctctgcagttcctcagacatgctgtacatctcctcctggggcctgtgtcctcactattccctccaccaggcacgcgttcctcatgcacaccggctccctcattccccagatcactccctccacggccaccttcccaggccctcccgtgccaccccaggcccatctctccccagtccctggtttcttagcactgattgtaactgccttgctagtgttgattggtatttgtttactgtttgcttttccgtcctgagcacagaggcccggtgagagtaggggccctatcagcgcctctgctgaactctgggcaccgcgggcagtgcatggcacagagtcaatgcttggaaagatgtcctgatggaatgaccccgtcctttaagtagaggggccaggcagatcctcacatcagccctgaggcacgggaagacctgctgtcctgcatccactctgcaagctgaccagcctgggcaggaagaatgcctggaagcagtttcagcgcaggggtggggaggaggggtgggggaaggtgggggagggggtgagggaactttctctactccagccacagagtccacagcaggagaaccttctctactccagccacagtggtcggcctgtctctccccctttcttcctctctttcttcttctgctcctctttctcctcccccccctccccacccccgtcacacccaccccttgctggaggtggaggaaggcctgtctcacctgcagagggagaccgcgtgtgcgctgtgatgggacgcaggcccccttagcatttcctgaactcgggggtaagtttccccagtagctgggcccggtggttcagcctttcttactgtgccctgaaggactgtgattttctgtttttctcaggttttgaaagtaacctttatttttaaaaagttaatgtatgtgttataggaaactgaaaaacacaagaagcaagcgcggagtcacccacagccacagcagtgtacggcgggacgtgggactgtgattttccagcccaggaagagctgctcggtggcagcccgggacatggagccattgctcagacagcctcagtgggagctgctgtggctgttgggacaggtgtctccacagggagtgtgagtgcacgtgtgagtgtgagtgagtgcgagtgtgagagtgagtgcgagtgtgagtgtgagtgcgagtgtgtgagcgtgtgcatgcaagtgtgactatgtgactgaatgtgagtgcaagtgagtgtgagtgtgtgtgtatgagtgtgagtgtgtgagtgcaagtgtgagtgcgagtgtgaatgtgagtgcgactgagtgtgtgagcgtgtgcatgcaagtgtgactatgtgactgaatgagtgcaagtgagtgtatgagtgtgagtgtgagtgtatgtgagtgcaagtgtgagtgcgagtgtgaatgcaagtgcgagtgagtgtgtgagcgtgtgtatgcaagtgcgaatatgtgactgtgaatgtgagtgcaagtgagtatatgagtgtgtatgagtgtgtgagtgcgagtgtgagtgtgtgtatgagtgtgtgatgtgagtgcgagtatgagtggtgtgagtgagtgtgagtgctagtgcgagtgtgaaagtgcgagttcgagtgtgactgagtgcaagtgagagtatgtgtgcgagtgcgagtgtgagtgcaagtgagtgtgtgagtgcgagtgtgagcgagtgcgtgtgactgtgagagtgcaagtgtgtgtgtgagagtatgagtgtgtgagtgcgagtgtgagtgctagtgtgagtgtggatgctccaccttccccctggcacaaggctctggatgagaggagagctcttcccacagtcccagaacccaggagtcaggggacctgagataccaaccttccatcctgcacggcgcagtcttactttggtggattatcaagggccgattttgtcttcgatgcttgcatcctatgtggatatatgcgcatgtgtgtgaatatgtgtaatatgtgtaatatctaacatgtatatagtataaatttagtgatatttaataatagcttttaaaaatacctgtaagattttatcgtaaatacagcaaatttaccctttttaggcttaagttcaatgatttttactaaataatagagctttgagtaaaagagagatagtggtgtaaaagggatctttcactcccagactctcagtccccagcctctctccctatggaggtaaccgccattcccatggtgggcatcctgtaacagtcagtacacatacaggcatccttgtctaatatgcaaatacaagactacataataccattcttttttccccactcagtatgttttggagatcgtattgtagcaccacctcattgggggctgctcaactgtgtgtctatatcctttgccaatttttttctattggattgttggtctttttcttattgatttgtaagagctctttatatattaagcaaggtagtcctcagcttgtcaagagacagacttatgaaaccaatgacgcttaaatttcagagacctcccttgcataagctctcatgagaccccggagaggaccgagcaatgggttcacaaagttgactcaggtttattttaactgcaagcatttaaaatgattgtatctttccaccgaggttttccctggtgtgagtgatgtcagagaggctgtgggcatttttggggactaggctaagataaatctaagttacagttaccttgaatttgaatttagagggatgtgttttaactggtttgctgtcacttctgggtctgtattatcagcagccatcatggtaccacttcctgtcatgcttcccccactctctgtactgaattattcttcatgaccctgtgtgaccaaagcttttatcatcatataacatgtatggtatttggcaccacaaacatgagtagcgggtgagaaaggaggtttgaaatgggtggagaccaaagccagtctgtggctaattctttcagtcttcagatataaactgcaaatgggggatgtggctgtcaccaatgcacggtgagaagagaagttcttctgtccggaatattctcaataatgcagcaaacacaagtatgaaccatcttaaatttattttgtttcttaatggtattcaaataaaaaagacgtcagaattcctatgcttaaaggacacactctataatagtagcctaacagcaagcctatttttactacaactctacttgaaataaattcattaaaaaaaccatttttttaaaactttcgttttagtttcgagggtacaagtgaaggtttgttacatacataaacttgtgtcggggggtttgtcgtacagattatttcatcacccaggtattaagtccagtacccaatagtgatcttttctgctcctctccctcctcccaccctccaccctcaggtagacagtagtgtctgttgtttccttctttgtgttcataagttctcatcatttagctcccacttataagtgagagcatgtagtatttggttttctgttcccgtgttagcttgctaagaataatggtctccagcgacattcatgttcctgcaaaagacatgatctcattcttttttatgactgcatagtattccatggtgtatatgtaccacgttttctttatccagtctgtcattgatgggcatttaggttgattccttgtctttgctattgtgaatactgctgctatgaacattcacatgcatgtgtctttatggtagaatgatttacattcctctgggtatgtaaccagtaatgggaatgctaggtcgaatggtagttctgcttttagctctttgggaaatcgccatactgcgttccacaatggttgaactaatttacgctcccaccaacagtgtgtaagtgttcccttttctctcaatctcaccagaatctgttattttttgacttttaaataaaagccattctgacttgtgtgagatggtatctcattgtggtttttatttacatttctctaatgatcagtgatattgagattttttttcatgtgcttgttggccacatgtatgtcttcttttgaaaagtgtctgttcatatcctttgcccattttttaatggggttgttttttctcttgtaaatttgtttaagttccttatagatgctggatattagacctttgtcagatgcacagtttgcaaacattttctcccattctgtaggttgtctccttactctgttgatagtttcttttgttgtgtagaagctcttaagtttaattagattccacttgtcaaattttgcctttgttgtgattgctttttgtatctttgtcatgaaatctttgccctatgcgcaggtcggtatcgccaaggttgtcctccagggtttttatggttttgggttttacatttaagtctttgatccatcccgagttgatttttgtatatggtgtaaggaaggggtccagcttcaatcttctgcatatggctagccagttctcctagcatcattgattgaatagggagtcttttcccccattgtttttgtcagctttgtcaaagatcagatggctataggtgtatggccttatttctgggctgtctattctgttccattggtctatgtacctgttttcataccaaaacagtactatgctgttttggttactgtagccatgtagtatagtttgaagtcaggtaacgagatgcctccagctttgttctttctgcttaggattgccttggctactcaggctcttttttttattccatataaattttaaaatagcttattctagttctgtgaagaatgtcattggtggtttgataggaattgcattgactctgtaaattgctttgggcagtatggtcattttaatgatattgattcttcctatccataagcatgggatgtttttccatttgtttgtatcttctctgatttacttgagtagtgttttgtaattttcattgtagagcactttgaccttcctggttagttgtattcctaggtattttgttctttttgtggcaattgtgaatgggattgcctttctgatttggttcttggtttgactgttgttggtgtacaggaatgctagtgatttttgtacattgcttttgtatcctgaaactttgccgaagatttttattagctgaaggagcttttgggctgagactatggggtgttctagatatagaattatgttatctaggccaggtgtggtggctcatgcctgtaatcccagtactttgggaggccaaggcaggcagatcatgaggtcaggggatcgagaccagcctggcttacatggtgaaacccatctcttctcaaaatacaaaaaattagccaggtgtggtggcacatgcctcgtagtcccagatacttgggaggctgaggcaggagaatcacttgaactcgggaggtagaggtttcagtgagccgagatcgtgccactgcactccagcctgggtgacagagcgagactgtctcaaaaaaaaaaaaaggttatgtcatctgccatcagagatagtttgacttcctctcttcctatttggatgccctttatttctttctcttgcctgattgctttggctaggaattccagtactatgttggataggagtagtgagagagggtatccttgtgctggtttgtcttgtgctggttttcaaggggaatgcttccagattttgcccattcagtttgatgttggctgtgagcttgtcatagatggctcttactattttgaggtatgtttcttcaatacctactttattgagagtttttaacatgaatgaatattgaattttattgaaagccttttctgtgtctattgagataatcacatggtttttgtctttagttctgtttatgtgatgaatcatatttactgatttgtgtgtgttgaaacaaccttgcatcccagtgatgaagcctacttgatcatggtggattagctttttgatgtgctgctggatttggtttgcaagtattttgttgaggatttttgcattaatgttcatcaagggtattggcctgaagttttctttttttgtttctgtttctgtcaggttttggtatcgtgatgatgctgtcctcatagaatgagttggggaagagtccctcctgctcaattttttggaatagtttctgtaggaatagtagcagctcttctttgtacacctagtagaatttggctgtaaatccatcaggtcctgggctttttttggttggtaggctatttattactgatttaataaatcagagctcattattggtctgttcagggaatccatttcttcctggttgagtcttgggagggtgtatgtgtccaggaatttatccgtctcttctcagttttctagtttgtgcacatagagttgttcatagtagtttctgacggttatttttatttctgtgggatcagtggtaatataccctttgtcatttataattgtatttattggaccttctctcttcctttttattagtctagctattggcctatctaccttacttattttttcaaaaaaccaactcctagattagctgatgttttgatttgtgtatgtgtgtgtgtgtgtgtcttgatttccttcagttcagctctgatttttgttatttcttatcttctgctagctttggggttgatttgttcttgtttctctaactctttcagttgtgatgttaggttgttaatttgagatttttctaactttttgatgttatgaatacttttagtgctatgaatttccctcttaacactgcattagctgtgtccccaacattctggtatgtttatgtttgtttgcattagtttcaaaaataacttcttgatttctgccctaattttattatttacccaaaagtcattcaggagcatgtttttaaaatttccatgtaattgcatggttttgagcaatttttttagtcttgacttctatttttattgtgatgtggcttgagagtgtgtttggtgtgacttcagttcttttgaatttgttgaagattgttttatgtctagttatgtcattgatatatgccatgtggcaataagaataatgtatattctgttgttttggggtggagagttctgtagaggtctatcagatccatttggtccaatgttgagttcaggtccggaatatctttgttaattttctgccttgatggtctgtctaatactgtcagtagagtgttgaagtcttctactattattgtatggcagtctatgtctctttgtaggtctctaagaacttgctttatggatctgggtgctcctgtgttgggtgcatatgttcttaggatagttaggtcttcttgttgaattaaacactttaccattatgtactgttgccttttttgatctttgttggtttgaagtaggtttttctgaaattaggattgcaaccattgcttttttttctgtttttaatttgcttggtagattttcctccatccctttattttgagcctatgggtgtcattatgtgtgagatgggtctcttgaaaacagcataccatcgagtcttgcttttttatacaacttgccattctgtgccttttagatggggcatgtggcccatttacgttcaaggttagtattgatatgtgtggattcaatcctgtcattgtgttgttagctacttattatgctggcttgtgtgtggttgctttatagcaacactggtctgtgtgtttaagtgtgtttttgtatcagctggtagtggtctttcctttctatatttagtgcccttttcaaggtctctcgtaaggcaggtctggtggtaaattccctcaacatctgcttatctgaagaggatcttatttctcctttgcttaggaagcttagtttggttggatatgaaaatcttggttgaagatttttttttctttaagaatgttaaatataggcccccaatctcttgtggcttgtagggcttcagctgagaggtccactgttagcctgatggggttccctttgtgggtgacctgccctttctctctagctgcctaaaaaagacatttaagccttcaataataactttaaaaagccaattttgatcatcatgctagaggaaagagttttctttctgttctctcaaaagaaaacaaaattataaaatcattgtcatctggagaagtaatcaaagattacacaaatagtgttaaaaacaaatattatacaaatattataaggtggtaggtagcccaattaccctgattttatttttacacttacatgaatgcatcaaattagcacatgtacccctaaattatgtacatttatcatatatcaataaaattgatattatagtagagtcttaggcagttaattacaataaatatatgctatttttctggattttgtgatatttgtgggatttgtcaacattttaacatctggaatttgttgtgatttattttcttattctcgataaatgatcatttgtgtattttgtattggtgttctttgtgttttatttttcttaactagggctctccacattatataaactccaggccccacaaaattggacccacaactgaatctgaaatatgtgttgcaaatatgttatctcagttgtagcaaatcttttggttttatttgtggcattttcccactgtgcagaagtttacatttccacataatcagatttaatcagcatttccttttattgttcctgagttttcttagaaagtccttcttcatttgacaataatgaaaaaaattcataatttttctagaatgtctaatttttcttttatatgtttgaatacttgattgatctggaattaacttatgtgtaagaactttttcccttaattatcctgtattctgaccattatttattgagtattctatattttcttattgattagaaatactattttatcatatattaaattctcatatgtaattggatttgtttatggaccacccggtttgttctatgggtctgtctgttcatgtaccatgacaaaacaattttatttatatatttataatatattttaaagtctggtaaaactagttttctttcattactttttcttgccttcaataaaatgtctgggttatacttttgtgcttatatttccatactaagtttagaatcagcttccagaggtctggaaaaaaatctcggctttatgttgattgtaatcatattaaatgttaaggttgatttcaggagaattttataaaatttaaggaccctctccaagtgtggggttggcttttctttttgctccatttttcttttattttttcctcagttttcttcatatatatcttacacatttctaggcatgcctttctttttgtatgctattataaatggaattttttccccttccattatacttcctaactgattattgcttttatataggaaacctattgacttttgtatattatttttgttcctccaaaataatatgcaataatatacaaatatatatttgctgggaacctaaaataatatactattctattcaattatggaatatatctagagctctcctttttttttttttttttttttttttgagacagggtcttgctctgtcacccaggctggagtgcagtggtgtgatcatggctcactgcgaccttcacctcctgggctcaggtgatcctcccacctcagcccccgagtagctgggactacagacatgaggcatcacacctggctaattttttgtatttttcatagagacaggcttttaccatgttgcccaggctggtctcaaattccagagctcaagtggtcctcccgtctcagcctcccaaagtgttgggattacaggtataagccaccacgccagacctattctatcctctcctattcaattcttatttgtaacagtttttctgtgattggttcatctgggtttccaggtagatcatcatgtcatctccaatactgcctagtttttagacctttctgactaccctactacttgtaaacagggcaggtttttccgagagatgttcctagctgagtgctgcacttatggtgaacacccagcttcaaaggctacttgaaaggatttagggggctgcacttacccaccggccttggaattggcctcatagaaaacttgctgtgctttgtggaagctcaggcccgcagaggtgctgatggtcagtgtcagcacagacctattattagctgtccagcgacaggagattccactttaatgctgaagcttcagaactacgttgcaaacaaaatgactggcattttctcagacagcagttccaagtggaaactgtctagttgtgctgtctccatacggagggctggaaaactgtgaatggcaattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttaaataatagtaaaaattgccaatattgtaactttttttttttttgacttaccagttttccaaagtaaaaaaatattagcagcactttctggggtggtagataagtggttctcaaagggctttgagcgggcagttttgcctttcagggttggcgttgggagacacttctgtttgtcatgattcagggaaacgtgtgtgctactggcctctggttgctactggcagggatactgctaaacaccccatagtgcacaggacagcctgcacaaggaagaattacctggccccaaatgtcacactgctgagtttaagaagctctgtggtaaatgaagatttagttatcttagtttccctcccccagtctatacacatagttaaattgctactttatttaagtgaatacttagttgttacgttgttattgtgtgtatattgctaatggtagcaccaattagtgactgtggttacatccctttcgttgtatggctttttagttttcctggagttattaatagcctgattttcaattgtgccatttgcaatccacatattaaaaactcttctcccgttctttctgatatcaaaagcttttcttgagtctctcttttctctagattctttatttctaaagctctttgtaatcttgtttcaaacccattgctcttgagagctaaggctcagctgtcaccttggaattcttctctatccctgtttagggtaggatttgttgtttcctggatcccgtggctttcccttttatcttttttttttccccacttgttttgctgcagcacagcttccagtcatttcctaagaaagaacaggctgcggaggtacattttatgagtctttgcatgtatggtaatctctcttctctatcctcacacttgactgacagcttgttttgggtatagaaccttaagttggaaataatagtcaatcagaattttaaagacattctgttggcttctaagattgctgctgagaagtctaatgccctaacccatttttttcctttttaaaattccacctcttctttctaacggttatgggaagtatttagggccttctctttatcattcaccttcttgaatctcatggtactctttgcttaggtctgttctcatctgtgttgcagagcactcagagatcctttaatctagaacatgttcttatgtttttctgacaattttcaatttatcgtgattctgggcagtttaaaaactctaacaaaatagaagtaaaggaatttctgatattttggttgtttatgtcaacgatgaaggtctactgatacatatatatataggaatttttgttttggggatcctgctagagtcggagcctgcagtcagatgcgaaagcttggcaactcaggcacctactgtataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactaaaatgttatcgagtgttcttaccgtcaccttcgctttgaacttgctctcaatgcaattgtgacactcattcctcagcattgggtcgggtttcgcaggttaagggcatggtccacctgaggcccccacactgcagacaccagttacaagctccagggaggtggtttcagggattgcagcggtttcgggccacttgtgcttctgaacaactgggtgcaaacctgaggaattcccacaaccccctcaggtttgaaaattccctaaaatggctcagggaactcagcaaagtgctatacttattacagatttgtcataaaggacacaagtcaagagacacacaaggccaggtctgagggagggtcccaaatgtgaagtttccatatcctcaggacacggcaccacccccatctatcactggcaaggaagctccttgagcctcggtggccagagttcttactggggcttcattccatgggtgtgattgatgggagtcattgccaggtgatcaaactccagctccagcccccgccctccctgggggtcaggctgatatcacctggctccaagccccaaacctctaatcacaaggtccacctttccttcacgaccagtcctccgcctgcagctgtgtaggggctcagcatgatcccctcaccaggggtcctggctggaaggaagcagggtggtggctgtttcctccctgctggaagcttcatccctttccccaaacccacagcgcctgccccacattgctctcctcccatgccgcttcataccttctctcttctcacaagggtgggcttccagattttgccagcctgtggaaacatcactgtctttttgattcctgtatcctgtgacaactctgtaaacaattcctctattcatgctcttcaaattatccagtttaagtgagccatctgtttccagctggggcaggaaactgtcaagtctcttttctcccctgaaagacagggatgttgtctctctcttctccctccctccttcctgccttcctttcttcctctctccttccttccctccctcactccctccctcactccttgcctcctcccttcctccctccctcccttcttccctcccttcctctcttccctccctctctccttccttccctccctcattcctttttttctcccatcctccctccctcattttttcctccctcccttcttccttttctccctccctcccttcctccctctacttcattctctccctccctccctccccgcccccagtcctccccctgtccctccctncttccttccctctctccctcctttcctccctccctctttctccctcttcccctcccctctctgtctccctcccctttcgttctctccttccttccctccctccctcctctccctactccncctcctccccccactcgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcacggcagagcacatcgtcgtcattgctgactacctccttttagtgcaacccccaaatccttacctccaccaacacacatcctattctgctcctctaaggaatcatgttctctcagagaaatcattaagaataacatgaaaaaacgagattacaggaagtcacgataatctgcaagtgatgtacattttttttttctagttctattacagaagaaaaaattgcgggggtggggcaatgattcctggcttctcaatgcatttagtgcaggtcggtgccctccgtacagaacaagtaaacctaccgctttctcccctcatcttcctgggctgccgggatgtgctttttcaaccaccctgttctctttgctctggggcccctcctgtcctcggctcggctactccatcgttaaagaggctaaggggctttaatatctcaccaggctgactggagagcttgtaatgatgatagggcataaaaaactactctgtatggttacatgtgaagtatgttaattattaattcaaaagtggtccagcaacgttaaaggatttgtggggctgtgcataaccaaccctaatgagcccatgtaaaattgagtacagagcttgaagaccactcttacacaatagtatttaagttatacagagccatcttaggcagcagaggaaaacaaaaacaatgattcattgatgtacgttttactgctgccgtggaacaccaggacacataaaacaccggccacctgctctgccccataaacatcttcctcacggagcacaggatcatgccttctgccaggagggaggagccagttcttgctatttaatgttaggcatagacgcagttcatttcatctgtttactacaaggtcctcgctacatagaataaaaaaagaaccccccaggtcttaagccagagtcagcaccctcacgttttgctgtatatttcaactaacagcggacctacatgaaattaaaatgctacaattatatctattgtctgagtatattcattatctaaagggtgttcaactttgtctcatcatttgagctcaaagaattgaaaatgttgcacaaaaattgaatacagagtaggaatttccacttgagatttcacaactttgaatggatgctgtttctaatgccagttctgtgatgcttaaactagcaaaaccaaactgttcccaccagaacggtgaattcctgagggaggaaagttggagggacaaataaccggacacccagcccttgcctttcctcctgaaccacatcctatcccgagtgtcccgcccacagcccaccgaaactgatcctcgagaccaagggtcttttctagcctgatacaaggcctgaggacagatttggaacagcatacccacaggggtagtaacagtgatttgagccacaattaagacccaaaggtttagaaacaggggttatcacaaccccttgaggctggaaatgcctcttcccacctctcagcccagaaaacaacccttgctctacagcccacagcctagaaagagattgatttcccgtctgtgtctaagctgtatctcattaacccacggggctctttccccagccccagaagcaggtacttacaaggcaccggagattagtggtctagtggaccagacagactggtccaggcctccccgccggccccccttccggtccccgtggacgccagcctctctgagcctcggatgtttgtgctcggcaccaggctggaaggctatttacttattcatgggctgcccaagccggccaggaactgctttgtgtcagctgaataggatggtaattcaatctgcgaatgggagccgttggcacacagcacgcctgtcataatgagtcacaggggggacaagcacccagcgttcagagccactgggaacctgtccttcgacaacgagctgtgtcacaagacaccaccttcctttcctcagtcgctctcttccccccgaatctccccacccctgatcaactctcctggagatgcatgacacagaattacatatccttgggagcggagacggggaggcgggtaatgccacctgttctcttgagctgtatacatggaaatagaggagacagaagtgttgggaaggaatctgaagcaagaaacgcggagtgaggaagcgggaggaaaagctcacctgcaccaggagtcctcaggtttaatgttttctatgccctatctcacacactcctcatcaaagcccttggagcaaatgaacaattagcctcaggcaggttaacaatcacacccgaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgtgtctgacccaaattgataagccattgatgctgcagtataacgtgcgtcagactgcgcacatggcggtctttcgcgagcctcgacggtacatagatacacggggatatctagccggtcgtgcagaggaacttctttacatgctggtcagtgatactcgtggtgtgtccgtgccgcagcctccaatgaggtggtggcagtccacgcgtccgatttctatgtgacgccacggaagatgtccatgcacacacttttgcgtaaatctggttatcgaatatatatcactatgttacggatatataaaatatatatgtatataaatacatatattttatatgtactttacaaaatgttttataaactatatacatatttttgataacttgtgtgtctagtcatcttcagatgtgtaggtatgaaataggacagcttggacagctccccatttgtctggcaggaaacgtgcagatactgtgtatgtgtataaatacacatgtatatttcatatacatatatacacgtgtatgtgtatatatgtgtattatgtatatatacatatgtgtattatgtatacattatgtatatacatatatattatattgtatattatatgatatatatattacaatattacaacatatacatcatattatatattatatacataaatgtatatatgtacacataattatgtatatatacataatacacatacatatatatatatatatatgtgtgtacacacaaacatatatagatatttttttgagatggagtctcactctgtcgcccaggctggaatgcagtggcatgatctcggctcactgcaacctctacctcccgggttcaagcaattctcccatctcagcctccagagtagctgggattacaggcacctgccaccacacctggctaatttttcgtgttttcagtcagagacggcgattttcaccttgattggccaggctggtcttgaactcctggcctcaagtgatctgcccgcctcagcctccccaaagtgctgggattataggtgtgagccactgggctagctagattctcattttaataaaccaacaaaccccccaaggcctagctgtggggatacaggtgtttgtctttgattatagacagggagaaaggggtggagggacatgcattgcttacctgggctatggaatgtgacactgtataagaattaggagaggagaattaagaaaaccaatgcccactaagtttaaacagcaccatttttcatgaacagtgacaggcattttcctgtggtggttggcaccggtttcaaacgtctgccatcactcttggaagccccctgagcccacccagacaagctacatggagaagtccccatacgcctcttagatgccctcctgctccgggcggggacgtggtctggacaacagcgtttgctttttcacctctggcaggcaccagtctccatgcctggcaggagagtgacgcagtcggatgcacacacaccctagccttttgcattcttaaacctacccgctgggctctgtgtccaagaagggatgtctgatgttacagatcacaacgttccgcctgcacgtttcccaccagacaaatggggagctgttcacggtgtcccctttcatccctagacatctgaagaagatgactagacacatgccacattctgtctccggttccccgctctcctctcctttctgtacccccatctgttctccccccatgtctctctctcttcctccgctgtcttgctcccttctcctcctctctccttccttatttctgcctcccctattagtctcctcctctcatcttctctgactgttgccgttttcagaagggctcctggctcgggccagtgcggaatcacctgagcaactaccacggttgcaaacctcttcttgagggcttgctgatttctcctccaacctgtctacaaggcaggaatattttgacacccatttaagagctaaggatacctgaggtatacaaaacgtcgccaacccatcagccatgtctactgggcgcccaaatgtgcagacaccatcctaggagacaatgaatgagatagaggttacggaatcttcccaatcccgcaccttcccagctcatcatagcagacccagggctggcaggaagacgtgaatgtccca

SEQ ID NO: 698 - DNA, 97825 bp, Homo sapiens
  misc_feature (1)...(97825): n = A,T,C or G
gtacccaggggacntgacgggcgtngggtgggtaaagntcaagcgtcctctctgggagtgaggagcgttctctacccggccgcgaccccatccgggaggtgaggagcgtctctgcccggccgccccgtctgagaagtgaggagaccctccgcctggcaaccgcccgcctgagaagtgaggagcccctccgcccagcagccaccccgtctgagaagtgaggagcccctccgcctggcagccaccccgtctgggaagtgagaagggtctccgcccagcagccaccccgtccgggagggaggtgggggggtttttntttttttgttttttgggttgtgggtgttgtggttgtggttgtgtggtgggnttatgtttgttaggttggttggggtgtggggggggtgtgggggggggtgggggagtaggtggtgcgggggtggagtgtggggtgggtgggtggggtgttggggtgaggggggtggggtgcggggggccgtgggggtcgcgcggggggcgacgccgggcgtgttgtgtttgttgggggaggggttgggtggggggtgggtggtggggagtgtgggttgggtggaggaggagggagagttggggtgctggggtggtgagtgagggtgagggttggtttatggtggcgcgggtgcagtattttgtgtgttggttatgggcgtggtggagcatgggtgttgcgtttgtcgggtgtgtggtggtgtgctgatcttgtgacagcggacgaatggagcagcgtaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgtggngcaaaaatcccgtcttggtctanagatacccccacccggcacatggtaagtcctcagcagtactcagtaggtgttatatttcaagcagaatgatctctctaaaatgaaaatatgaacataaaacccttcatgttttctgttatgtttcaatattttctaataagatgctgggggctgggggacagctctccatgctttctcagtacctgtgggatgcagctcaaggcgctccatgatcaggcccctgctggcttccccagccccacctcagcctcgccttctctgccactgtaccggccagctgtgggcctgtgaaaaagccagacaaactgctccttcctcttcccaacactgtgctacccatgcagcggggctgggaggctccagcccagggtgggaggctgcactggggcagcatccccggaggcctgcaggtgcaggagagaaacctccatcattaccccttgaaacaagaaaatcagacgcggaggcagcttttcataagtccacagccattcatttgaaagaatcatgcttatcttttgacatgatatgtttccagctattttggtgttttggtgttagacatgaaaaaaaggatgcggatagatggtagtaggcaggtgttttaattgcttgcctgatatcctttatttatgtatttatttatttatttatggggtctcactctgttgcccaggctggagtgcagtggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgggtgcagaaaccccgctcnggcgtanagnaaaacccctttgcccactagtttgctgtatccatttctcttcatgcatcccaagaccaagccaagaaaccaaaagcctctggtcccactggcccatgggctccctcggtccccaccgtcactaatggccattttgcatgtctctctcccaggcctgctctcttgaacagtgccgaaaacttcactgtgctcatcaagaacaatatcgacttccccggccacaactacaccacgtaagtgcccaggctgcctggctgtcttagttatctactgctgagtaataaattatcccaaacctcagaagcctgaaacaacaaacgcctattgtctcccacggtttctgtgggtcaggaatctgggaatgactttgctgcgtggttctggctcaaggtctgtcaggttgtagccaagctgtcaaccagggctgcagtcatttctaggcttgactggggctggagaacccttttccaagctctcacacagttgctcgtgggagagctcagttcctcaccacgtgaacctcgccctagaccacttgagtatccttggtatatggtggctggcttctcccagagcaagtgacccaagagagacagagcaagcaaccaagagtataaccaagatggaagccacagtctttggggggagaccccaacacttctgccatatgccattggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacctgtgcaaaaccncacttgggctangagaaacctactggcatcgtaaaagagtatccttttgtgtctggcctctttcacttaagcgtagtgttttcaaggttcatccatgttggagcatgggtcagtgtttcattcctttttatggctgaataatattcccttgtatgggctttcgtgcttttgtgtatccatccatcagctgatggacatttgacttgtctgcctgttcactgccatatctactattcctggtgctcttgggaatgagtgaatgaatagcataaacagagctgtccagggtcacagagctggtaagatgtgaagccaggatcggaagccaggccattagtcccctagagcctatgttctaagcatcagtaaatttacttcaaaatatttatctttcttcaataataaattaatcttagcttactgtgactgttttactttataaatttttaaattttttaaactctgtacagtggtataaaaatattttctttctcaccgggagtggtggctcatgcctgtaatcccatcactttgggaggccgaggcaggcggatcacaaggtcaggagattgagaccatcctggccaacatggtgaaaccccatctctactaaaaatacaaaaaaatagccaggcatggtggcaggcgcctgtagtcccagctactcgggaggctgaggcaggagaatggcgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactaggggcaaaaaccccacgcctgaggggtanagnaaaacccctctgggctcagtggctcacacttataatcccaggactgtgggaggccgagtgggtggatcatttgaagtcaggagtttgagaccagcctggccaacatagctaaacaccatctctactaaaaatacaaaaattagccaggtgtggtggtgtgcccctgtagtcccagctacttgggaggttgaggcaggagaatcacttaaacctgggaggcagaggctgcagtgagccgagatcatgcctctgcactccagcctgggtgatagagcaagactccatctgaaaataaataaataaataaataaataaataaataaataaataaataaataaatgacaaaattggcaagtcctagacataaaaatttgccttccctctatcttgcccctccatttttgtttccattcttctctaagaccaaaaaatttatctgagagttggttgatcggggtagagcccagcgacgtatccactacaggatgaagcctgtgatttgggcctaattttcgtgcatttctgagtgatttcatggaatctctccgtgtcttggtgtcctgtgaacacagcggcctcaccggctttggctccacaatggactcgcacttcttcctgtagtagtattcgttgaccacacagggctgacagcacttgcaccagggataaatatgggagcgacagcagttactggaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgggtgcnagaacaccgcgtcttggtgtanagnaaacaccctgtctcaaaaacataacaacaaaaacaaaaaacaaaagtgtccacagtgtctaggctgaggaatccactgtgccacactccctggcacacagcctcacacattgtagtgagcaataaacatttattacctcagtgaatgaacacaagaatggggcaaggattctgagaaaggcctggagaagcataggctgcaattggaggcttgatgttctggagggacgtgtattatcttaattatttccatccatcagtccatccattcatcgatccagccactcattcaccaagcattccccaaacacctgagttgtgtctggcacctaggaggaattctggtttcaagatctcatagctggctgggcacggtggctcatgcctgtaatcccagcactttgggaggctgaggagggcaaatcacttgaggtcaggagttcgagacctgcctgaccaacatggtgaaaccctgtctctactaaaaatataaaaattagccgggcgtggtggcatgcacctttagtcccagctactcgggaggctgaggcaggagaatcacttgcatccagcaggtggaggttgcagtgagctgaaatcgcaccgctgcattccagcctggacaacagagagagactccatctaaanagaaaaaaaaagaaaaaaaattctcgtagccaaggaggacgcattaattgtgctcaggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactgggngcagcaaccggcctactgtanagataaaaacttgttgttgcattcggtttgcaagtattttgttgaggattttttgcatctgtgttcattaaaaaattggtctgttgtttcctgttcttgcaatgtctttgtctggttttgatatcaaggtattaaccttatagaatgggttgttgggaaatgacccctcctcttacatgttttagaagtttgtgaaagatttaattctgttataaacttttggtagaattcaccagtgaatcaatcgtgccctgagcttttctttatggggattttgacttttttttaaaaaaaattaataactcaatctataccttgctataggtatattcagatttcctttttttttttttttttcagttttgttggtttgtccctttnttttttttttttttttttttgaaacggatttttgctctgtcccccaggctggagtgcaggggcgtgatcttggttcactgaaagctgcccctaccgggttcatgccattctcctgccttagcctcccgagtagctggaactacgggcgcctgccataatgcctggctaattttttgtatttttaggaaagacggggtttcaccattttacccaggatgggctcaatctcctgacctatgatccccccattggggcctcccaaaaggctgggattccaggggtaagccaccgggcccgcccaaggttggtcctttcaaaaatttcttatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgggggcagaacacgcgcctgctggtanagnacaactcattgttggattcatacaatgagatgctttgagccaggcacagtggctcacgcctgtaatcccaaaactttgggatgccaaggcggatggatcacctgaggtcaggagtttgaggccatcctggccaatatggtgaaacctcatctctactaaaaataaaaattaactgggtacggtggcgtgagcctgtaatcccacctattcgggaggctgaggcaggagaatcgcttgaacctgggagatggaggttgtggtgagctgagatcgcgccactgcactccagcctgggcaacaagagcaaagctccatctcaaaaaacaaaacaaaacaaaacaaaaaacaaagaacaaaaattagctgtgtgtggtggcacatgcctgtagtcccagctactctggaggccacagtgggaggattgcttgggcccgggaggtcaaggctatagtaagctgtgattgcacccctgtactccagcctgggcaacagagtgagaccctgtctcaaaaaaataataataaaataattttttaaaatgagatgctttgcagcagtgaaaatgaattgactaggcctgacatagtgtctcacacctgtaatctcagcattttgggaggccaaggtgggtggatcacttgagattangagttcaggaccagcatgaccaacatggtgaaacccctctctctactaaaaatacaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacttgggggncaaaacaccccgcctgncgggtnangagnaaaaactcctccacaanactgaccacagcatccctgcagaacagagccagacaaacatccaggcaaacatccgcctgctggaggcagcctgcctgggtgctgggatcagtctcaaatctagcacacaatgggccacccacgctggcatctttcctatggtgtccttgccctggcatctcctggtcattgataggtcctggaataaggtactggaatgtggctcaggtgtctactaccttatagaaccaaagcctcaattcccttccattttctcattccccttgagagttctggcagcttctcctttagtccaactaacacagaagagatgctctcattcaaataatggatgggttgactgcctctaactagtccgcccttccttccttccttccttccttncttnnntnnnnntnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnntnntnnnnnnnnnnnnnnnnnnnnntnnnnntnnntnnnnnnntnnnnnnncnnnnntntntnntntnttnntttttttttttttttttttttttttttttttttntttttnnntttttttntttttttnttttttnnttttttttttttnnttttttttttttttttttataataaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactggtgcagacccacgcctgcggtanagatacccaccttgctcaggaaagctctgcccccaatcctattctttatattccctaacatggaccctcatagataggacagcttctcaagtcataaagtctcgccccggtgggttcgccagctttgtctggaggctcagtaacacatcagcaccttccagtctaaggctgcatctggtgcattttcagaaacacccacctgctttatcaataacattgaaaatggcagctactctctctctctctctttttttttttttgaaacagagttttgctcttgttgcccaaactggagtgcaatggtgcgatcttggctcactgcaacttccacctcccaggttcaagtgattctcctgcctcagcctcccaagtagctgggattacaggtgtgagccactgcgcccagcctctcttttttttttattccaaagaaagggccttgctctgttgcccaggctggagggcagtggcgtgatcgtagctcactgcagcctccaactcccgagctcaagttgatcctcccacctcagcctcctgagtagctggaactacaggcatgtatcaccatgctcagctagtttttattattttttatagagacgggggtctctttatgttgcccaggctggtctcaaacccttggcctcaagcaatcctcctgccaacatgttgagcctnccaacatgttgtggttacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgggggctanaatccccgcttccgggtanagnaaacacccgtgagggcagtacagtggcttcaagagtccttactgaagccaggcaccggggctcacgtctgtaatcccagcgctttgggaggccgaggcaggcagatcacctgagatcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtcccaaaaaaaaaaaaaagagtccttaccaatagcaggggctgcagtagccatgttaacatgacatttaccagcaacttgaacttcacctgcaaagctctgtggccacattttcagccaaagggaaatatgctttcatcttctgttgctctctgtgtctgagagcaaagtgacctggttaaacaaaccagaatccctctacatggactcagagaaaagagattgagatgtaagtctcaactctgtccccaggaagttgtgtgaccctaggcctctcacctctgtgcctctgtctccttgttgcccaactactatctcagagatattgtgaggacaaattgagacagtgcacatgaactgtcttttaatgtgtaaagatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtttttgaaaagggattagttgactgaaatcttcgctcgtgggctnangagaaaaaaacgactatgccattgggnattatcaacggtggtatatccagtgatttttttctccattttagcttccttagctcctgnaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttattggaaatgtggaactgagtggatatgctgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttgggtgncagaatcccccctcgaggcntanagnataacctttgtggggtagggctgggctgagtggaggaagggagagaacacatggcagggtctctccatggccaccagatctttgtctgcctgcctcagtctctggttctagcactagggacccgtgcagacggcaaccctgctctttctatctctggctctcttcgcagcttatgacaatggtgattcttggcatttgcacaacatttcacattttacttgaggctcacaatgactttaggagaaaaatggcattttacaaaccagaacacagattcagagatgttgtgacttcccccagggtcacacagcttgctgcaggcagagccagggttaggacctgagtgtcctcactcacagcttctcctaccatggttcacagtgaactgtctgcagggctggtcttggaaaaccctggcacacagctctcttgctcattcatccacttcttagagtctcagcctctccatcacgtgcatgtgcccccatgactccctgccaccaccccagacaatctttcccaacttggctttgctctctccaaagagccgcctctttctggaagagcttcttccctatcaaatcatatttgttttattctgggctaggcacggtggctcacacctataatctcagcactttgggaggccaaggcaggaggatcactggagcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactggggcaaaacccgtctgggtanagaaaaccgtatcccacctttgagagataagttgggaggattgctagagcccagagtttgagaccaacctggacaacatagggagacccccatctctataaatactttaaaaattagccagccatgctggtgcatgcctgtggtcccagctacttgggaggctgaggcaggaggatcacttgagtttaggaggtcaaggttgtagtgagctgcaattgtgccactgcactccagcctgggtgacagagtgagaccctgtctcaaaaataaataagaaggcgggatgcggtggctcacacctgtaatcccagcactttggggggccgaggtgggtggctcacttgagctcaggagttccagaccagcctgggcaacatggtgaaaccccatctctacaaaaagtacaaaaattagctgggcatggtagcacgcacctgtagttgtagtcccagctacataaaatttttaaaaaaataaattggccaggtgtggctcacacctgtaatcccagcactttgagaggttgaggtaggtggatcacttgaggtcgggagtttgagaccagcctgaccaacatggtgaagccccatctctactaaaaatacaaaagttagccgggtgtggtagtgcatgcctgtaatcccagctacttgggaggttgaggtaggagaattgcttgagcccagcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgggtgcataanccnccgctcggctctaaagaaaacccctttctcccgcctcagcctccatatagttgggactacaggcgtacaccaccacaatctatttttgtatttttaatagagatggagtttcaccatgttggccatgccggtctcaaactcctgacctcaggtgatccacccacctcagcctcccaaagtgttgggattacaggcctgagccactgcacccggcctacaacaactgctttgaaagggctttttctctatgattaggaagatccatgtttagaagcttggtaaataaatccaaaacctcttcccagacaatgaattgacccttcgatgtcctatgttttttttttttttttacctttgctagtcactgtatcaaaagtaaaaaatatttttataatcttactatttttcttacatcacaacttacataaaatgagatgcacttttttttaaaaagttttcaaaagcattttgttgtggttttagatgattaataggtgatcagtttgaagagtgagaatgaaaaaaccagcacatgtgggggaaggctggggaagggatttgattatatatttaagtgactgaattcagttctctctcatttcctggacaatagttctgtttttttcagattattctgatcatttcaaattaaagcgaagacacatgtatcagctctcaagtcctatgttctcattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccttggggggncataaaatccngcgcttgagtggtagnagnaaacccccactgggcaggcagatgctaagtgggcgactgttctaggctagagaatgggggtgggtatgaaaaaagcaagagaaagagagagagagagagagagacaagggaaatttggtttgactggataaaaaggccagtgaaaagagggagttttggtaagagctatgccatgggcagggagaagtacagagatcttcaatcatggactctatcgccatcccctcttctcttcctgcaggtgggcagaaccaaggtgccctccctacaccttcctggggcctccagcgatcctgagctcagcctcctgacctgcagacccctcagctctggccctcacgtcctgcttgctgtacctgctttatcccatatcaccatctccattcctcagcatagtgacaatcccagttcctacccattccactggcttctccatttggcttggagctctttagctggattgagacgactactctgatgagtgccatgtcactggctcaacaaaatgggcccaagtgagtcaatgtcattgacatgaaggtgctgtcagtttggtgggaaccaagggaatgagactgtgttttagctgcgttcgtttgaacagttacacacttagggcttcttatgcngatgctcagagagaaatatggaagacgagatctcgtagaaaacaagaagacatgttgtaaatgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgggggngcnaacaccccggtttgggggtnanagnatcccccgcttttcaattaaaaaaaaaaaaaatcacagagggtggagcaggatggctgaatagaaaccaacaccatttggccaggcgcggtggctcatgcctgtaatcccagcactttgggaggccgaggcgggcggatcatgaggtcaggagatcaaggccatcctggctaacatggtgaaaccccatctctactaaaaatacaaaaattagctgggtatggtggcaggcacctgtagtcccagctacttgggaggctgaggcaggagaatggtgtgaacccgggaggcagagcttgcagtgagccgagatcgtgccactgtactccagcctgggcgacagagcgagatctttcccaaaaaaaaaaaaaagaaacctacatcatttgacccctcacaggacccaccaaaattttttaaaaacacaaggggctttttttttttttgttnnggtggggggggggggcgccggggggttgttttttttgcttgggtgttgggtggggcgcgggggcggggcggtgcggtgggggtgcggggggggcggggggggccgcggcgttgtcgcgtgttccgtggccgcgctgggcgctcctgtcctgcgctgcgggccgcggggcggtgggggcggggggcgtggtgcgtttgttattgaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgnggggcnagaaaaccgcgcttactggtanagnaaacacccanctttcagcccagcatcccaacacatacatggtgcatgcagcgctttctcatgctggatgttgcaacgttctcctggaacaacactgggtcatgtgacccaccatttgggaagctcaattctgatctctcatatttatcccagaatgtgcaacatatgatcgatcagccttaatggaatcaggccctctcctaaacagaaaacgtgtctctgtgtcatcatgaacatgtaaattttaagaattaaaatgcttcagagctgcgtcaaagacaaaaagggaatgaaagcgagtttgcacactttacctgtcgggggggatactgtgatcatgaaagtgagtttgtagtatcctccctttggaaagaaagtgctaatgaccatcccagaaatactctcccgaccttgcttggtgactaaggtgagccatgtcacccctccaggtggtaggtttaatccctgaatgaagagagaactcccagccttccccatccccatgacctttttgctctaagaggctataatgttatgcattctgtagaaggcaaagccgctggtacctggagctaacgggagtgtgaaggacctanggatttcactgagccngngaggatgggtaagttgtgggggtgtgggtggtgtgcacctatattcgcagctacttgttagaccgaggtaggaagatccctttgagcccagagttcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgcgtgctaaaaaccngcgctttagtggtanagnaaacacccaccgtcactaatggccattttgcatgtctctctcccagcctgctctcttgaacagtgccagaaaacttcactgtgctcatcaagaacaatatcgacttccccggccacaactacaccacgtaagtgcccaggctgcctggctgtcttagttatctactgctgagtaataaattatcccaaacctcagaagcctgaaacaacaaacgcctattgtctcccacggtttctgtgggtcaggaatctgggaatgactttgctgcgtggttctggctcaaggtctgtcaggttgtagccaagctgtcaaccagggctgcagtcatttctaggcttgactggggctggagaacccttttccaagctctcacacagttgctcgtgggagagctcagttcctcaccacgtgaacctcgccctagaccacttgagtatccttggtatatggtggctggcttctcccagagcaagtgacccaagagagacagagcaagcaaccaagagtataaccaagatggaagccacagtctttggggggagaccccaacacttctgccatatgccattggtcacacagatcaaccctggtccagtgtgagaggccactgcccaggggtcccaggaggcagggatcatttggggctttcatggaacctctccaccacactggctcactcctgggaaagagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgggggcagaacccncgcttgcgggtanggnaaacccccacacccagctaattttgtgtatttttagtagagtcggggtttcacaatgggggccaggctggacttggactcctgacctcaacaaaaccagtgaatttctgaagtctcagcatctaggacttagaagaaggagaagcctagcatttcctgattctataaataacaacactgatagtctctagtagatgtttaacagcagttcgaaggggaggggttctgatttgtagtactggccaatttccacggtgtcagtacttgctctgtgaccaacgatgactcacaaacattgttgtaaacatttgacctacattaattcttttaccctcacaagaatcctgtgaagatctactatcattcccagattatagatgggaaaaactgaggcacaatgaggttaagcaccttggccaaagttatgcctcgtgaatggtggagctgagccatgaaccaagacctctgcctccagtctgtcctaacccctataagctaatgcctgtagatggttttttttttttgagacagagccttgccctgtcgcccaggctggagtgcggtggcatcacagctcactgcagcctccgtctcccaggctcaagtgatcctcccacctcagcctcccaaatagccgggatttttattggacagcacagctctgtaggaatccttatgacgtattcactgtctcagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgaggtgcaaaaaaccngcgttggggctanagnaaaccccatagactaaaaatgatttggcaaaatgcaacgccctatcataataaaaatagttggaaaaactaggaatagaagctaacttcctcaaccttataaagggcacctatgaaaaacccaccactactttatacttaatggtaaaagactgaaaaatttcccccgatattaaaagaagataaggatgtccactctcaccctaccccccgccccccgcctttttttttttttctaaaacagagtcttgctcttgtcgcccaggctggagtgcaatggcatgatctcggctcactgcaacctccgcctcccgagttcaagcgattctcctgcctcagcctcctgagtagctgggattataggcacgcgccaccacacctggctaattttgtatttttagcaaagatggggtttctccatgttggtcaaacaggtctcgaactcctaacctcgggtgatctgcctgcctcggcctcccaaagtgctgagattacaggcgtgaaccaccgcgcctggccaactctcatcacttttgacccaacactgtaatggaaattccagctacaactactaggcaagaaaaagaaataaaaagcttacaaataggcagggaagaaataaaactgtcccaatttgcagatgacatgacactgtntagaaaaccctaagaaataaatgaaaaactatttggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacctagtgctngagcctcgctcgggggtanagnaaaacctctgtggcccaaccacacaaaaccgtggctggcagaggtgatgatggggggcagattttccacattcttggcaacattatctgtagtgaaactttagacttcagttgagaaggtcgctgagtgcatggaagatccttctttccctgatttctaccaaaactggctgggcagtggctgcagggttactgggaaatttcaaacttggggtggagccacaggactccagtgcagggggctgctggtgtccctggtccaggccttgctgacactggggggcgttggaagggcctgggcagatgggaagaagctcccactggagccaacaagagaccttgcaaggaaaagctgggaagggggagtggcgaccatggggtgacctcaaagacagatgctggcagtgaatgaatattgctgaggaggataaggccgtctgaaaaagctgcctactccatgattccaagcctatacaattctgggagagaaaactctagacacagtgaaaaggattcttgttgccagggcttctggcaaaggggagagggatgcacaggggaaacacaggaggtgtttaaggcatgcagctacttcgtatgggtggtgaatggcattcggagtttgtcacaacccatagagggcacaacacggtggaacctccatgccaaacttctgacttcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttgggtggcagacaaccccgtctgggggtagganaaaccccccagcctgtctcaaaaaaaaaaaaaaaaaaaaagaaaagaaaaaataaaaagggtttttctcaaaaatagattttgtagaatcagggatctcatttccttcaaccaggcttggagtgcagtggtgtaatcatagcttgttgcagccttgaactcctggcttcaagccatcctttcatcttggcctcccaaggctgaagttgtttacatctcctgtgcaatccagcttttgtgagggtgtgaaaatcatatcacaaaccctccaaccaatccctcaaccacctccttttctaactctccagtatttctccttagggacaggtagggtgagggccaaacatttagagaccattcctgtaactcaaaacctactggcattattcaaagtagttaaccctaagctgtttccctagtcctgccttgcccttccactgagtaacacaataaagctctggaccattctttaccctttattctgcctcttgagcggatctggtacttcctcctgtggccctgtctagcatggcatggcctggtgtggcctgntatggtgtggtgtggccccatctcttgggaaaagtatgtaataaattcttcttggccaggcgcaatggctcacgcctgtaatcccagcactttgggaggccaaggtaggcagatcacctcaggtcaggagtttgaaaccagcctggccaacatgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgggtggcaagacacccgcgctcgggtcgtanagnaaacccctctcatatctctgcaccttcactccatttcttttcaaagaaacagagaaggcgaaaacaaaatgtcatagttctgggccgggcacggtggctcacacctgtaatcccagcacttcggaaggctgaggtgggtgggtcatttgaggtcaggagtttgagaccagcctggccaacacggtgaaactccacctctactaaaaatgcaaaaattagccgtgcgtggtggtgggcatctgtagttccagctgcttgggaggctgaggcaggagaatcgctgagggagcccgggaggtggaggttgcagtgagctgagattgtgccactgcactccagcctgggcaacagagcaagactctgtctaaaaaaaaaaaaataaaagtcacagttctacttgacccagcagcaggctttaaaaccagaggctttaattctcccaatttcctcatttgtcaaaatgcagaagccaatctaagtaaatcacctagaacggcagcaagctacgtaagttcggggctgaaatgtgatatttcttctgaatctctcttttcttacaacatcagagaaatgggtaataaatagcaccaaacccaggggctccacatttattcctctttccggaggaaataaattctagccaccatatttctcaataggaaccgatatgtaaggagaatgaatttattcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatcttgggctaaaacccctctttgtctanagataccccaattgccaagggcttaatatcaaagctggacgagcagccctgctgagctgagggagagtgaaggagcgtttgaatgggttgaagagtcatttaccaatgcagtctcaaaagcagccttttcatgtttttgtttttgtttttttttttttttacgcagtaaaaatctcattaaattgaaactcaggaaacctggggaggcgagggtaggggagcagccttcatcacaacactgttcagattttcccagactttaatgaaagggcactagggcatcccaccacctgagcaatcacaggattttaatgacccactgttagaaacaaacagcagcttgggcttcatgggtctttgcaaagcattttagccccccaagccgcaaacgtgcccctttgtccctctcgcccccttatctgttttttggactcctcaaccctactttaatttctcttttttggcaattctgctttcattttccctgcttgcaaatctagaagtcacacgccttctctcagtgaccgatgcctttcttctttttgtcatttacatcctttctttgtggaaaaatgtacccaagaatggtctcctggagtcatttttgttgatgaaatgctacacaatctanaagggctggtgctctttggtagaaaagtctctgtccttctgaatctcagcagaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgcgtgnggtgggcagaaaaccccgccttacggtnanagnaaccccctttttttgagacggaatctcactctgtcgcccggactggactgtaatggggggatctctgctcactgcaacctccgcctcccgggttcaagcgattctccttcctcagcctcccgagtagctgggactacaggtgcgcgccaccacacccagctaatttttttgtatttttagtacggataaggtttcaccatgttggccaggctgatcttgaactcctgacttcatgatttgcccgcctcggcctcccaaagtgctgggattacagacgtgagccactgcaccctgccgaatgtactttttttttttttaaactctatcttacttccttctcatcacctaattcagaattcctataatcgttggtcgagagtctattgcctagtgatgtcagagggttcgcagaaaccccagtgccttggtatccacaaatgtttttcttttagttatgctgaactggtgctgcctaatagggcagccactcacacatacttcattttaaattaattaaaatgacgtaaaatttaaaattcttgttttcagctgtacaagccatattttgatagccccctgtagctaatggctaccatattgaacagcaaagatatacggtacttacccagcagtatagaaagctcaccggacagtgctacaacagttgcaggtaagcaagcagagtaaggatagtcccaatcagatagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctggggtggcagaatccccgcttgggtctnanagnaaccccctgtgttcgttgtggttaggatgggcttgatggaagctgaagctgcgtgggggggaaagcctggtcaaagcctagtctctcgcccgggttgagttaatgatgtccctcctggagaacgtcctctctgcagttctttcacatctgtggttctacgatgctttgacccctataggaattcagaccggaaggtgtgtagtgcatgaagggaaccagaagacctgtgaagtctctgcctggtgccccatcgaggcagtggaagaggccccccggtgagtcgcatggggagacagacacagtggccctcagcggcgaccagatgaggccttgccgaggctgcttgggccttcccctctcagcacagccctgcaaagtcctgggtcctaccggcttggggacccctgcgctctggatgcactgcttggcacaaactagtatctctgggagggccatggtggttggtaaactgttgtaacactcctgtaccaactggtaaatagctactaccctgagcatccttgggtgtccctggccccttccttcccccagatcttccagggtacccccagaccccctcctgtagtgccacagcaggatcccttctgacttgtcagtgtccctactgagtgatcaaggataggagggaaggagggagatggaagggaaggacgaancgagggaagagaggggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactggcgggcnagacaaccacgccttactcgtanagnatcacccctgttataagggctaaaggtaaacacagacacagcctagagaaaatgacgggtacttcataagcactgcctacctaagtgttcaatgattacacatctggaaaaataaaaaagacaagcagcattggtgacccccagagaggcaacatggagggtgacagacgggggaaggacagggccctactattccacatgggcatgtgcacgacactttacacctcctggatgggcagagcaggggctgtaacatttactttatggttcagggcactgaaattgacagagattcagtgacgtgctcagaatagcaacactgatgaataatgaagctcaggcagggaatttagttggctcccaagggatggagatccctgaacacctgagactgaggcaggagatcaacaggactcactttctgagcaactatcacagccctgctgatgaaaacaagatgtagcaaagaaaccagcccaaaccagctaggactaggaattctattgtatactcttgagtcacccncaccagggccatgacagtttacaaatgccatggcaatgaacccgaagttaccatatggttccgggactcctggttcttttccagaaaatcgtgaatagcccaccccttaattggcatataattaagagtangtataaataaaagctagccatcatgccactggtgctacacgcctctgggacagccctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactacgggnctaaaaacccggcctgacggtanagnaaacccccaggtggcacaatccctatagggagaatcccaaaaaattcacaagaaaactgttagagcaaataaactaattcagtcaagttgcaaggaacaagatcaaccacaaaaattaattgtgtgggttttttttacaccagcaatgaacatttgaaaaggaaattcgaaaaagtattccattcactgtagcatttaagaaagctgaggctgtgaagctacatggctgtgtttggagctggtgctgctatttaccatgtgaccttggacaagcttctcacttcattcatgacaccgtttattcagctattaagtgggggtaataatagtaccttccttatagagttggttttttgtttttgtttttgtttttggtgggggagagtaaggattgcaagagttaatatatgttagcaaaatggacttagaagagtggttggcacatggtaaggactatattagggttaccaaaaaatgtttataattgggaaaattgaacaaaggttccagtaaatatccatcccagaggctggttgacaaattatcacaatgtaccttttagcttgaacatatggaactgcctatattctatagctatggcctacaaaatgcaaaatgggcangttnttnttgttgtnngtgtttggttgtttgtttgtttgncttgagacagnctcagtctgtcaccaggctgaaatgcaatggcacgatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgcgtgcagcacccngccctgcgggtanagnaaaacgcctccccctggctcagagctcaggtactcccatgccagccacacccataggacagagcctcccaaaaaattcgcttcactgtaactgacaaactcttacgagcagggaaggcgagttaactggggaggaggcctgctggactggtgctctgctatctcaatcagtgaagcccgtcagccccctgcttccctttccctttatggactaaagatctgagcagctgtctgagcatccccgactcaggcctggctgggaagaggcagtgaatgctccagcacatcatgggcacctccttgctcacattcttcctcaccaagacgcaggaggtgctgccaaacatcaccaaagactttggagttttactgacgcaaaggcaggaaagacacggttttccgggaaagatcatttttaaaaaatcacagcaagaaaagatgatgacaaacactgcacactcaaagcccagaggcaccaaacctctccctattgagtcagtaaggatgacaaggacaaagcagccttccatacacgtttcctttcactttctaatttcatcccccacttcctcagtctctaaggcagcaggccaaccccaactgctacaggcaccctccttcgttgggtccctcctgggtttgtntaaacctgnagtgtcttcttcatcactgcttgaatcatgtcttctgttgacaatggagtctctagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgtggggcaagacacccgcgctgngcgctnanagnaacccccgnaaaccccatctctactaaaatacaaaaaatagccaggcatggtggcaggcgcctgtagtcccagctactcgggaggctgaggcaggagaatggcgtgaacccaggaggcagagcttgcagtgagccaagatcacaccactgcactccagcctgggcgacagagcaagactccatctcaaaaaaaaaaaattctttctctatatccttattctatatacttttttctatttttaacattttttatttttatttttactttttaaatatttttgttaaaaactaagtcatggccgggtgcagtggctcacgcttgtaatctcagtactttgggaggctgaggtgggtggatcactcgaggtcaggagttcaacaccagcctggccaatatggtgaaactctgtctctactaaaaatataaaaattagccgggtgtggtggtgcacgcctgtagtcccagctactcaggaggctgaggcagaagaatcgcttgaacccaggaggcggaggttgcagtaagccaagatcatgccactgcactccagcctgggagacagagcaagactccatctcaaaaaaaaaaacaacaacaaatacacacacacacacacacacaaaaaccatttccaatagtgctaagtcctatgaagaatgtggaataccacagtgtgataagggaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactggggtgcaagaaacccggcctgacgnctanagnaaacacccatttcctgattctataaataacaacactgatagtctctagtagatgtttaacagcagttcgaaggggaggggttctgatttgtagtactggccaatttccacggtgtcagtacttgctctgtgaccaacgatgactcacaaacattgttgtaaacatttgacctacattaattcttttaccctcacaagaatcctgtgaagatctactatcattcccagattatagatgggaaaaactgaggcacaatgaggttaagcaccttggccaaagttatgcctcgtgaatggtggagctgagccatgaaccaagacctctgcctccagtctgtcctaacccctataagctaatgcctgtagatggttttttttttttgagacagagccttgccctgtcgcccaggctggagtgcggtggcatcacagctcactgcagcctccgtctcccaggctcaagtgatcctcccacctcagcctcccaaatagccgggatttttattggacagcacagctctgtaggattccttatgacgtattcactgtctcagtcacgagaatctttaaagcagtaaatgctttgcttttgtccatcttgctataatcaaaactgaccatgcccggctaattttttattttttgtagagatccctatgttgcccaggcttgtctcgagctcttgggcacaaatgatcttccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttacggtactgtagtgccgtggntacgtctanagntaaacttgccaaatatcaacacctgggtttcccacaactcttgctcttaagcaagaacttaatgtctcaaagcttccatttgctcacctgtaaaatggtgataataattgtaccgacctcacagtgttatcagattaaaagaaatatgatttgccagggcttggcgcacagtgggggttttttttacggnnnnccnncnnntnccgggggggtgtcccttcncgtctcctctctttgtggggggcttgtggtgggttggggtgttgttggggttttttttgttggtcgtttctcctcccttgttttgcttcctctgctttgttcttttgtggtgctgtgttttcctctttgttgtggtttgttggcgtccttgttttttggtttccgcttcgcggggcttcgcgtgccttttcgccgctttgtgttcgccgcttgcgtgtcgtcgttgtctcctcgtcgtcttgcgggggggggtgggcgcgggggcgtggcctggttgttttgcggtcgctttttcggcgcggctcggttcctctttttttttttttgtttgtttttgcgtggttgttgtgggttttttgttgccgttgttcttttgttctccgcctcctcctttgtcgttcgtgtggttgtgtgtcgtctctgtggtgttctgggcgtttggtcgcgtgtgtgcccttgtgtgacaaaaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgggtgcataatcgctcctgcggtanagnaaaaccatgaggggaactgagccaggtgcagtggctcgtgcccgtaatcccaacttgggagactgaggcaagaggatggcttgaacccaggagttcaaggctgtagtaagccatgattgtgccactgcactccagcctgggggacagagtgagactctaactcaaaaaaaagaagggaaggaaggaagggagggagggagggaggggagccaggcacagtggctcacacctgtaatcctagcactttgggaggccaaggcaggcacatcacttgagcctaagagtttgagaccagcctaggcaacatggtgaaacccatctctacaaaacatacaaaaattagctgggcatggtggcacatgcctgtagtcccagctacttgagaggctgaggtgggaggatcacctgagcctgggaggtcaaggctgcagtgagctgtgatcgcccctcaggactggaagtcctcctggtctgggttcaaaccctgcatttctgaacactactgtgtgccaagccctggcaaatcatatttcttttaatctgataacactgtgaggtcggtacaattattatcaccattttacaggtgagcaaatggaagctctgagacattaagtatcttgcttaagagcaagagttgtggggaacccaggtgttgataatttgccagcatttgacgtgatgcttcattggtttattcctcccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgtgtggcaaaaaaccnncgttttgctctanagnaaccccaagtgctgggattacaggcgtgataagcccggcgcccagcccccagaacattttcatcacctacaaaggaaaccccaaatccagtagcagtcactccccattctccccttcccctgtccctggccacagtctactttctgtctctatagatgcctattctggacatttcctataaatagaattgtatatggtgtggccttttgtgtctgtcttctttcactcagcatcatgttctccaggtccatccatgttgtagcctgtgtcattgcttcatccttcttatggctaaataagattctgtgtatgaatgtaccacattttatttgtccattcatccgtcagtggccacttgcgtggtttccacttttttggcgattctgagtagtgctgctataagcattcgtgtgcacattctggtggatatcgaatcacttctccacgtcttagtaacacacgtcacttactccccactctgtcatccttctatctgcagtatcccacccgcaggacgctctgttcctctgaccgaggttgtaaaaagggatggatggacccgcagagcaaaggtaccttctgtttcttttcccgagaccctangggtggatggtctggcatcttggtgacatttgtgatgcccaggtcaggtcttcagcctctgctctcagctgccctcttcaccatcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattgggtngcagaatctncactgggtctanagnaaccccggctcacatgttggcaggaggattgcttgaggccaaggtttgagaccagcctgggcaacataaagagacccccgtctctataaaaaataataaaaactagctgagcatggtgatacatgcctgtagttccagctactcaggaggctgaggtgggaggatcaacttgagctcgggagttggaggctgcagtgagctacgatcacgccactgccctccagcctgggcaacagagcaaggccctttctctggaataaaaaaaaaagagaggctgggcgcagtggctcacacctgtaatcccagctacttgggaggctgaggcaggagaatcacttgaacctgggaggtggaagttgcagtgagccaagatcgcaccattgcactccagtctgggcaacaagagcaaaactctgtttcaaaaaaaaaaaaagagagagagagagagtagctgccattttcaatgttattgataaagcaggtgggtgtttctgaaaatgcaccagatgcagccttagactggaaggtgctgatgtgttactgagcctccagacaaagctggcgaacccaccggggcgagactttatgacttgagaagctgtcctatctatgagggtccatgttagggaatattaaagaataggattgggggcagtagctttcctgtagcaagtgctagctatgtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacatcttggtgctaaaactnctcttggtntnanagnaacccctgacttgtaagatgtgtgtatatgtttttaaaaatattactaggggctgaactggtggcccactcctgtagtccagcacagggaggcggaggtaggaagattgcttgaggtcaggagttcaagaccagcctgggcaatgtaggaagacttcatgtctacaaaaaaaaaaaaaaaaaatttcattagccaggcatggtgatgcatgcctatagttccagctacttgagaggctgaggtgggagaaccccctgagcctgggaggtcgaggctacaagaagctgtgttcgtgcaactgtactccagcctgggcaacagagcaagaccctgtctcaaaaatatatataggctgggcgtgatggcttatgcctgtaatcccagcactttgggaggctgaagcaggcggatcacttgaggccaggagttggagaccagcctgaccaacatggcggaaccctgtctctactaaaaatacaaaaaaagttaaccaggcatagtggctcacacctgtgtaatcccagctacacgggaggctgaggtggcagtgagctgagatcgcgccattgcactcaagcctgcactcgaggtgacagagtgactccatctcaaaaaaaaaaaaaaaatatatatatatatatatacacacacacacacacagacacaccacacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgggggcaaaacgctgttggtgtanagaaccccgaggccgcagtggagctgcctgccagtcccgcaggtgcgcccgtgctcctcagcccttgagcagtcgatgggactgggcgccgtggggcagggggcagcacttgtcggggagactcaggcagtgcaggagcccacgggggcggggtggaggttggggagactcaggctcaggcatggggggctgcaggtcccgagccctgccccacggggatgcagctaaggcccggcgagaagtctagcacagcagctgctggcccaggtgctaagcccctcactgcccggggcggcggtgccggccggccgctccgagtgcagggcctgccgagcccacgcccacctggaactcgcactggcccgcaagcgctgcgcgcagccctggttcctgctcgcgcctctccctccacacctctccacaagccgagggagccggctccagtcttggccagaccagaaaggggctcccacagtgcagcggcgggctgaagggctcctcaagtgccgccaaagtgggagcccaggcagaggaggcgctgagagcgagcgagggctgctagcacgctgtcacctctcactggggggccaggcagtcctgctcttatcccaagtcagtttcccacaggaggggatctgcccaacctagtgctggctttttcaagtgcttcctttgcatattctaaatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactggggngcaaaacgcctttttgcgtctanagaatccccctcgggggcctcggtccaaacatctggacaaaggccctatgaaaggacctctgacaaaatattttccaccatattcagctagagttgcatgtttttctatttttcctaatgagaacataggacttgagaactgatcatgtgtcttcgctttaatttgaaatgatcagaataatctgaaaaaaacagaactattgtccaggaaatgagagagaactgaattcagtcacttaaatatataatcaaatcccttccccagccttcccccacatgtgctggttttttcattctcactcttcaaactgatcacctattaatcatctaaaaccacaacaaaatgcttttgaaaactttttaaaaagaagtgcatctcattttatgtaagttgtgatgtaagaaaaatagtaagattataaaaatattttttacttttgatacagtgactagcaaaggtaaaaaaaaaaaaaaaacataggacatcgaagggtcaattcattgtctgggaagaggttttggatttatttaccaagcttctaaacatggatcttcctaatcatagaaaaaaagccctttcaaagcatttgttgtaggccgggtgcagtggctcaggcctgtaatcccaaactttgggaggctgaggtgggtggatcacctgaggtcaggagtttgagaccggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttgggtggcnaaaaaacccccgtttgggtggtanagaaacccccctccttttccccagnaagaaggcaggagagtgtcttctgcatgaatatggagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacgtcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttaatcattgctttgcgtttttttattaaatcttgcaatttactgcaaagcaacaacaaaatcgcaaagtcatcaaaaaaccgcanagttgtttaaaatangagcaacactacaaaaggagataagaagagcacatacctcagtcacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactggtggctgaaagccggcttacgctangagacaccccactgccttcagtttcaatgcacttctgggccaggcaatctttggctagtgctgtctacagagggcgcttgacaggcaacttccagaagcaggtggaagatggaaactggtttctgtccagccccagaaaggtcagtctgggaacttctgtgtgtctggcctgaccttgacaaccatccctgctgaactatgagccccaggaaggtcagtctgggaacttctgtgtgtctggcctgaccttgacaccatccctgctgaactatgtcccccagtctggctcagaggaccggaaacctgattcctactctctgcctctcgccagcttccaggatggaaaggcctgctttgtcacacagcatgatgaagacgcccgtccccagctcctgtcacagcttcaacaggaaggaactaccctctcttaagaaatgtcagcgatgtccatgcagggtcactccagccaggaccgtcccccctgctctttcccacttagaaggagcaggaaaatcataggactcaggggatgatgatgtcatgagtctcctgacattaaaaccctggaatctatccttcccaaccccaactcacccgggcccggggacccttgtgacttccttctatccctctatatcttnctccctctgcaggcccagcctggggccggagccctgccttctcccacagagtccactgagcggccatctcttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgggggcaaaccccctttgggtctanagnaacccctagnatgtctgctacacccctgttacggacgagctctaaggattaacggacacgtgggaaggactgtttcaagcacgcttctattaccaattaccgggtagggatatggcccacactctgggtaaatggtggctcacctacagattctcattccagcctgtgagatggtgaaagggaagagtggggtgtgctctttatttttaaggtcctgacctctgcatacaaagttccctctacttcctgacctgagtaagacctggctcttccctgacagtcctcgaagcccttcccaggggatggtagtccgtctcccacccccatggtgtcctctatgctccacacctctatttccagatccatagtcctccatcttgagtaagcactgaggctcctgacatctagctgtaccaccttctgtgccttctcattgatgatgcctactcatcaatcaatcaatcaactgttattctcagagggctttggcaactggcttacccttctcgccccagttcctaccgccatattggtgactttaatgacccaggacctggccgaactcctggcccttcagctcctgtcccttcttattccaatgaccttcacctccactctactttagccaccatctccctggaccatgtactggccctcagtttctcctggaacgaatcttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttgggtgcntaacaaccaggcctgagtggtanagnaaaacccctaatgcctagcagtaacacgctggtatagataaacttagaagaaagctggtttaagaggagagagcaggatggtgaggtaaagaataggacaaatacagtttttgttttgttttgtttttagagacaaggtctcactatgttgcccaggctggtcttgaactcctgggctccagtgatcctcctgccttggcctcccaaagtgctgagattataggtgtgagccaccgtgcctagcccagaataaaacaaatatgatttgatagggaagaagctcttccagaaagaggcggctctttggagagagcaaagccaagttgggaaagattgtctggggtggtggcagggagtcatgggggcacatgcacgtgatggagaggctgagactctaagaagtggatgaatgagcaagagagctgtgtgccagggttttccaagaccagccctgcagacagttcactgtgaaccatggtaggagaagctgtgagtgaggacactcaggtcctaaccctggctctgcctgcagcaagctgtgtgaccctgggggaagtcacaacatctctgaatctgtgttctggtttgtaaaatgccatttttctcctaaagtcattgtgagcctcaagtaaaatgtgaaatgttgtgcaaatgccaagaatcaccattgtcataagctgcgaagagagccagagatagaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgggggcaaaaccccgtttggtgtangagaaccccttctcctgcctcaccctcccgagtagttgggattacaggcgcacaccaccacacccggctaattttttgtatttttagtagagagagggtttcaccatgttggtcatgctggtcctgaactcctaatctcaagtgatccacccaccttggcctcccaaaatgctgagattacaggtgtgagacactatgtcaggcctagtcaattcattttcactgctgcaaagcatctcattttaaaaaattattttattattatttttttgagacagggtctcactctgttgcccaggctggagtacaggggtgcaatcacagcttactatagccttgacctcccgggcccaagcaatcctcccactgtggcctccagagtagctgggactacaggcatgtgccaccacacacagctaatttttgttctttgttttttgttttgttttgttttgttttttgagatggagctttgctcttgttgcccaggctggagtgcagtggcgcgatctcagctcaccacaacctccatctcccaggttcaagcgattctcctgcctcagcctcccgaataggtgggattacaggctcacgccaccgtacccagttaatttttattnttagtagagatgagggttcaccatattggccaggatggcctcaaactcctgaccctcagtgatccatccgccttggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacctcgggcaaaaaccncgttgngtgtgngagaaaaacctcataaaaattaaaagcctggnaagaaagaggaaaggagaaagagaggcatgttcctcccttgaaggatgggatctgtcactgccacttgcaggtcattggccagagcgtagtcacatggtcacacctacctgcagtagaaggtaggaaatgccatcctcattctgctgaccatgttccctaccgaaaatcagggagccagacattgaagacaaccaagaattcctgccaccagtacccatgaaacagtcctctgagctggggctgaatgagtcctacacatggaaggaaatctttgggtttccaggggatctgggcagctctgaggcatataacatagcccagccaggaaaaagctcccaaaagagaatttatttgtccaggaatgtacaggcaaaaaatcaccattctgtgtttttccatggggtagaggcctgaccaacctcatgtggtttgttccgtccagcttggcactgacagaggctggtggggcctgggggagggtctgaaaatccagggtctcaggtatgaactactgctctgatcaactgctaggctgtgtcctgtgggaatgtgctgggtttctacatgacccagaggtcactgatttcacaagatctgcanacaatccaatattcaaatatttaactatagcagagattgatagatttttctgccatgcccagtatccccctatagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgggtgctgacgcgacgctggagggtanagaaaaaatctaagggttcgagcctgatgtacgtattttgcttaccaaatacaggaatagtgatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgtttcggtcgaagagtatctggtgtcatagaaattgccgatgggagtccccgtcgtaaagctgctgcacttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgggggcaaaaccncgctgactctanagatacccccctgggnagtcaaggctgcagtgagctgtgatcgcccctcaggactggaagtcctcctggtctgggttcaaaccctgcatttctgaacactactgtgtgccaagccctggcaaatcatatttcttttaatctgataacactgtgaggtcggtacaattattatcaccattttacaggtgagcaaatggaagctctgagacattaagtatcttgcttaagagcaagagttgtggggaacccaggtgttgataatttgccagcatttgacgtgatgcttcatggttttattcctccccatttgcagacaggaaaaccgagttgcagacaaatgaaagtgacttacctcagggcctttgcatgtgacatcctctctgcctggaatgctcttctcagatatcaccttggcatcccccatcaccttcttaaggtcttcacttaaaagtcatcatctggccgggcgcggtggctcaccctgtaatctcagcactttgggtaggccaaggtgggtggatcacgaggtcgggagatcgtagaccatcctggctaacatggtgaaacccagtttctactaaaaatacaaaaaattagctgggcatggtggcaggcacctgtagtcccagctactcangaagctgaggcaggagaatggcgtgaacccggaaggcggagcttgcagtgagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattgtgtgcagaaaccccgtctgggctangagaaaccgtgcccacagtggatgggaagtaggatttagtggtgagtattaagaaggggcagcacagcagaaagccctcacgagtgcagggcccactacttgtccagagggccacaatgaggatgtacttgaccccacacccatctcagatgagccacttctcagccaccgtgtcttcaaattcatcttcactgaacttggtgaagacccacttctgtgagatgtggatcttctggcagccaggaaacttgaacttggccctgagcagggccttaatcacatgctccttgttctctgggttcaaggcggatggacatgataattggccaatgtgaaccccagccacggtgccccggggctttccaaaagcacctcacatacctttttggagcctacactggggtagtgcaaggtcagagacatgaacatccatctgagggcctgtctccaaggtcccttagagcagccatacaagaaacaggctgcatacaccaccaaggaagctgctgtttgcagccattgcacacgtcccccatgaggcgaggaactcagccagctgagttggctgtagatgcccgcagcatattacctggctatggctgttggttatacagggcccaggggctccttagtcagcagatgatgaatgctgccaggtctctgctgtgatgggacagcactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacgtggttgcagacaccccgtctggtctanagnaaccccccctccctgggtgtttccttgcagtggggttgggtgctctgatcccatcattcatgtgtggcttctgagggcctctgcaaggaaacaggattttttttagcacctgcacaagggccaggcactgtgtgagatatggggatacaaccatgaggacagtgccttggcctagagggaagccgtggggagggggttacacttgcacacagagaagtgaaaccaaccttgtctaaacagcatcagagcagagagaccccaggaaaatggacatcccagggtctgcaggagcccaccctcaccaccctctgacttgggtcagatcctgggaagacgcctcgttcagtgagaaggtccaacaggctgaacagtgtgaggagggaacctttgcccactcgagctagagcccagcccaggggtgttttcatgagaccttcatgtggcctaagacaggctgcccagggctgagcgctgtgatgagaggaaatgcggagggcacattcctgcccctgcactgaacagctgcagccgcattgcggatccccatgagtgcgaggactcaagagtttgggcctgagaactctaagaccatttcagagaaaatctcaaacccacgtcctctgggctgtgaaacagaggatcaaggatgatctgggctctgggatcagcctccatcactttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcctacgggcagaacccacgcttgcgtgtanagnatccactcccctcctcattaccctctgcctctggttttctctgagtcaacttaattccctgctggcatgacggacaccaagagctttaggcttatgtcctgccagcttagcaactccaactcaaagagcaccactttttcaatgattttagccaaaattccaagacttgtctcagaccaacctgaatcatgtgcctgctcttgaacaaagcacagtagccagggaaaaattgtgctttgattatctaggactggatcctggacctgcccctgggacttgcggaaggggacagctcaatctgagccatatcaactgagaacacaggaagcatggtcctaccaagagatgtctattccaggtatggtggagcctcagaggacagcatgactctcgttcagctggtggatcagggaatggtccaataagccacagctgtggatatgaaggtctgttgatttcagattgagctatagggggatactgggcatggcaganaaatctatcaatctctgctatagttaaatatttgaatattggattgtttgcagatcttgtgaaatcagtgacctctgggtcatgtagaaacccagcacattccccacagacacagcctagcagttgatcagagcagtagttcatacctgagaccctggattttcagacccttccccaggccccaccaaccttgtaatggccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctggcgtggcagacaacccccgctgncgtgtagnagnatcacctcttagcatttcacactcctgaggataacagtcagtagtggngagccatggttgggggatcaggngcaactacagaaaccaaccagtctgtagacatccccaaccccacggtctgacaagtggtggaagctctagaaatagctggcgtcctccaaaggcctagggcaaactatgttgggagacaaggagaaggccacaggaggaggcgtgaggatgtggcatgagctgcagcctctctcccgccacctgtcacgttcccaggtgttcaatgtacaaacacactctgcatttggtgttagagaaggccgctcctacgactctcctgagttatacttggaacaatccagtatggtctacttttcgtttcctatctctccttctttctctctcttttagagttggggtcttgctctgttgccctagctggagtgcagtggcgtgatcacagttcacttcagcctcaaactcctgggctcaagtgatccttctgcctcggcctccaaaagtgttgagattacaggcatgaaccaccacatctggcctgtttcctatcacttatctacttcaaattaagggtaatttcagtctggagatgagccaaggggctgcaaatagatgactgtgttccatctacaaagaacacagacgtcgtggaagctcatgangaaagccctggggaactcacacggcccncgcccagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgnggggcnagaaaaaccccgcccttctggtnanagnataaactcctgnnaccttctcaggnaggggccagnanataacaaaagaccctttcggggaagaggggtccgcgaaaaaagatgacctcccatttgggacagagttcaagtgaggggtaacgagcgacctcccttaggggtactgataggtgccagggatttccgtagaggaccccggggctgtgcggagtagccatcgctcacgagtgcgggctcctaaacttgggcagctgtggttgggggagctggggccgcgctgtccttagcctcttggggaacagcctaaatatcaggtgtcctgtgagccctgggtgagagccacacgccctgtaaaatacccctcctggatttgaagcctggtcgcattctcactccaaatacttccttagttgcagcccaggggagataattctgtggtcatcctttccactgagaaaatgctatcacaactttaggagagaaaatagtgaaagggggggaaacagccaccgttctaccccatgaatacaattttccgcatgtgtatttgttcattcccttcagatacgtnnnttctttttctttttctttttttttttgagaccgagtttcactcttgtccagtctggagtgcagtggcgcgatctcggctcactgtaacctncgnctcccagttcaagcaattctnctgcctcagcctcttgagtagcttggattacaagtgcccgccccacgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacttgcgtgcnagaaatcccggccttgctgctagnggnaaacacactacaggtctttccaaagccagaattagggatttctaagtgtacctctctagtcctggcttgtctcagccctgcagctgggctgtggagactccatcagcaattgctgaccccctattcttacctcggccccttcctgagtcccaccaggagccctgctcctcatctgggacatgcttcttggcccatggaggttgccagctcaccttggtactttactactatttggtttctgtgaccaccaagctgttgcttaaaccaagccgcctatggtggcaccactttggagaattcttttttattttttgagacaggttctcactctggttaccgagactggagtgcagtggtatgatcttggctcactgcagcctcgacctcccgggttcaggtgattttcccacctcagcctccccagtagctgggactattggtgcatgccactacacccggctcatttttgtatttttagtagagacggggttttgccatgttggccgggctggtcttgaactcctgacctcaggtgatctngccccctcggcctgtcaaagtgctgaaatacaggcgtgagccaccgcacccggctggataattctttagattttattccaagtgggttgagaagccatgggaaagatngtnagcaaagggaataaaggttggttgcattctccttggagggatttcctctttccctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgcgtgcntgaaagccgcgccttcgggtagnagnataaccacagccttctaanaatcctgtccaaacaaatcacacaggcacagaaaatttctccaacgagttgcgacaacatgtatgaaacattgtccaccagggaggctcactagggactaagtgcccacagtttttaacgggaactggttatttggtgtcctcttcctagcccatacctaaattccagtatcccagatagaaaaatatctttggcaagaaccatagtgtttgtgaaagcattttaggcacagtgagctcctcttatcggagaatgggacccctgcgcattttctagatacccaggaatgtgtcagaacttttcacaagccatatggtcatctaacttcccagcttttcttttaagctttttagttagtctattgtttgccccaactgtaatccaccacttcaagcagccacaaagttaaacaattgcctctcattgtttttgatagttgtgccacagaaaaggcttttttttgccttggacaaatttcaagtcaggtcaaatacagtctaacaaggtggagtcttatacagacttcaaatatgacttcaaatagtgataattctctgggaatgaggctttgagggagctccagtcctattctgctccctgcagtggctggcaggttgctggtcacgggcaatgtgggccttaattttctgggttacccatggactacagagtaggaaataagactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgcgggcaaaatccgcgttggggctangagaaccccttcttattgcatacagagtctcactctgtggcccaggctggagtacagggacataatcttggctcactgcagccttgaccttccagggtcaagggatcctcccatttcagcctttcgagaagctggaactacaggtgtgcactcccgcaactggctaatttttttattttttgtagagacagggttttgccatgttgcccaggctggtcccaaacttctgggctcaagcaatcctcctgctttggcctctcaaagtgctgagactacaggtatgagccaccgcacccggtctgcacctatctttgtgtttaatacgtgactccaccctgttccaataatgtgtctgtcagttcccttactagagctgctttaattacacagatttaccatcgctcttaatatctccgtggtcaccggtttatttgtgaagtgttcaccccatggcctctggggactcactgtctttcggctttcctctcctccctactctgcctcagcttagtctccttggtgttggtgtccttcagggatctgtcttcggtccccctccatgtcactctaccctctccctgggcagacccctggctccactcttgccccttccgcccattttccatggtgcagctagagtgctctgactgagctgcaaatgagaccatgcacacccgtttataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttaggggcaagaaaccnaggcttgngtgctagnagnaacacccttttttttttngaaaagggtctcactctgtcgcacaggctggagcacaggggtgtgatctcggctcactgcaactttcacctcccaggttcagacaattttcatgccttaacctcctaagtagctggtattacaggtgcacgccaccatgcccagctaattctttcgtatttctagtagaaacaggatttcaacatgttggccaggcttctttggaactcctgacctcaggtgatccacctgcctcagcctctcaaagtgctgggattacaggcatgagccactgcacctggcctattttacagattttggaaaatgaaattcagaaaagccaggcctctgttgagatatcacctcttgtcctgaccaccctatctagcagcttttctcccacatgattcccttatcacactgtggtattccacattcttcataggacttagcactattggaaatggtttttgtgtgtgtgtgtgtgtgtgtatttgttgttgtttttttttttgagatggagtcttgctctgtctcccaggctggagtgcagtggcatgatcttggcttactgcaacctccgcctcctgggttcaagcgattcttctgcctcagcctcctgagtagctgggactacaggcgtgcaccaccacacccggctaatttttatatttttagtagagacagagtttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgggtggcagaaaaccccgcctgagggtnanagnataccccctgctggtctcactagggatctctcaaggagctgcagtcagatggcagctggggttggcatccctatggagcctcaattggcacccagggatagctagacgtctcttcctctctgggaacccctaagagttaccctctcttcaaggtctgtccgcattgtctctccagcagggtagtcaaactttctaatagtggctcaggttcctcaaaacaaaacaaaaaaatagaagcttccaggccttcttaaggcttaggcctggaactggcaacagcattccttctgctgcttctattggctttgcagtcacagcacaggctcagcttcagaaagtaggggaaacactccacctctcaatggagaaagtgaccaagaatttgtggccatctttaatccatgcaacaatcacaaaagagaagattaaaacaaaactaatgtgctgttttttaaaaaaaaaattagaattccttttggagagcaaaataaaactgatttctcttctttcctgagattcatctccagttgataatgaaaatgtaactttccatgagccacaatgaatgatcacacattcattccttccatgactatcaagacctactatttgccaggcacttgggctgcaaagatatgaccttggctctgtattcaaagggttgggtaccgagctcgaattcgtaatcatggtcatagctgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcacttgacgttncatgcactcgagccctgnatggtganagnaaaaacccttgggcaaaaggcttaacctctctgagtttcagtgtcctcacctgtgaaaggcgaataataatttaaccaacttcatagggctgttgtaaggattaaatgagatgatacttgtacagttattgtaagggaagccccatgcatgcctgggttacacacacacacacacacacacacacacgcacacacacacacacacacacacaatgtacccctagaagtgtggtggttctagaccagcactgtccaattgaacttgatgcagtgatggaaatttctgtatctgtgctgtccaatagggcagctactaggtacatgtggctattgagtacatgaaatgcgactactgaatttttgaaagagatgatagatgatagatagaaagatagatagatagataaatagataatagatagatagacaggtggatagatagatagatagatagatagatagatagatagatagatagatagagttttgctatgttgcccaggctggttttgaactcctgggctcaaacgatcctcctgccttggcctcccaagtgctggggttacaggtttgagccatttgctccagcctggaattttaatttaatttaaatgtaaatagccacacatgtctagtggctaccatattggacagcgcagttctagaccgatgtgattcaggaacattcccttaacatcggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgtgttgcaagaatccnncgctcgagtgctanagaataaccctggccaacatagcgagacctcgtctctatcaaaatacaaaaaaaaaaaaaaaaaaaaaagcgggcgtagtggcgctcgcctgtagtcccagggaggctgaggtgagaggatcgcttgagcccaggaggtaaaggctgccgtgtgagctgtgatcgcgccactgcactccagtctgggagacgaagcgagaccctgcctcattaaaccagaaaccaaaaaaggcgagttggggagtaatgaccttctcaggagggccagagagaacaagaaaccctttcggggaaaatggggtccgcgaagagagagtgacctcccatttgggacagagttcaagtgaggggtaacgagcgacctcccttaggggtactgataggtgccagggatttccgtaaaggaccccggggctgtgcggagtagccatcgctcacgagtgcgggctcctaaacttgggcagctgtggttgggggagctggggccgcgctgtccttagcctcttggggaacagcctaaatatcaggtgtcctgtgagccctgggtgagagccacacgccctgtaaaatacccctcctggatttgaagcctggtcgcattctcactccaaatacttctcttattgcagcccaggggagataattctgtggtcatcctnttccctgagaaaatgctatcacaactttaggagagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatccttgggcaaaaaaccggctcgggtctnanagnaaccccanctggccggtacagtggcagataagcgaggctgaggtgggngctgggggaagccagcaggggcactgatcatggagcgccttgagctgcatcccacaggtactgagaaagctggagagctgtcccccagcccccagcatcttattagaaaatattgaaacataacagaaaacatgaagggttttatgttcatattttcattttagagagatcattctgcttgaaatataacacctactgagtactgctgaggacttaccatgtgccgggttctgttcttagcatgtgacatgtattggcctatttgattctcctacataatcctggaagattggttgtgggagtgggtgatcatgacctgaacagcctaaccatgtttagggaacactctgtgttatgcgttccaccacacaattcatgtcacagctgaatgtcccagtttcccttgcagctaggacacaacgggagacccaagctttccaaacatatgccccaggcaacactttgatacacaaggaataacactggatgctgggtgtgcacagaattcaaattcaggaatggagggaagtactgccctttgacccatacaataggggatccccttccttggaccccatggcttagagggccccactctgtccctctgcagactgtgagctgccctatggaatgaggggtgtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttgggtgncagacaccnccttcttgcgctagnagnaacccccgcaaatttgacacaggcacagaggaaagaggtcatgtgatgacacaggcagagattggagtggagcagctgcaagccaaggaaagccaaggatttccagcaaccacctgaagctagaaagaagcaaagaaagataattccctagagccttcaaatagagcacagcccaactgacactttaactttggacttctatcctccagcaatgtaagcaaataactttatgctgttttaagccactgagatgatttgttttggcaaccctaggaaacaaatacaaacccctccaataaatttttagttgtagttttagttttcaattccagaaattctatttagttctcttttatgatttataactttattactattttctatttgatgaaacacaatcgtcatactatattttaattctttatatatagttttatttaattctttgaatacatttaaaacagctaatataatctttgtctagtaaatccaatgcctggacttcctcatggacttcctcatggatggtatctattagttgctttttttctctagtgtatcaatcagcctgtgttggagaggccctagagcactgcaggttcagtgattctctaggataaaccactggactcagtatatagtcatacacctggctgtgatttcttatggtgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccctggtgtgcagaacaccacgccttctgtnanagnatccactcctttctcttttctttctttcttttttttttttttttttttttttgggtttttggagatggagtctccccctgttgcccaggctgtagtgcagtggcaagactttgggtcactgcaacccctgcctcctgggttcaagcgattcttgtgcctcagcctcatgagtatctgcaattacagccatgcgcacgctcagctgatttttgggtttttagtaaagatggggtttcaccatgttggctaggttggtctcgaactcctggtcacaagcgatctgcccgccttagcctaccaaagtgttgggattacaggcgtgagccactacacccggcctgtttgttgtctttctgctgcactcttgcactggtccctcatgctctcccctttccactccttcagcccttgtccgctatttcatcactgctacctcctccactccatggattctgttctcaaagaggttaccaaagacttctcagttgccagactgggtggatatattttattccttatgttacttgatctcttggatgcattcaacatcactggctactttctgcatctgggaccagtattttcccttggtttccatgactttcctgggtcccatgttctcctggtttctcattggtacttctatgacccttaaccttatctttctttttaaaaaattaatttaattaatttattttaagactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactgaggggncagaaaaccgcgctttgtgctanagnanacacccaagnagcacaagctaaaccaaaaaaagcagaacgaaggaataaataggagaggagaatggaaaataaataaaatggagaaaataaacataatagagaaaatcaatgaccaaaatttctttgaaaatatcaaaaaaattaacaaacttttagctagactgacctagaaaaaaagaagactcaaattaataccaaccctacgaaaacataaaaagattataataccatgaacaattgtatggcaacaaatgatataacctagatgaaatgaagaaatatctagaaaggaacaaaccttggccgggcacggtggctcacgcctgtaatcccagcactttgggaggccgcagtgggtggatcatgaggtcaggagatcgagaccatcctggctaatatggtgaaaccccgtctctactaaaaatacaaaaaattagccaggcatgatggcaggcgcctgtagtcccagctactcgggaggctaaggcaggagaatggcatgaacccggtaggcgcagcttgcagtgagccaagatcacgccactgcactccagcctgggcgacagagcaagactccgtctcaaaaanaaaaaaaaaaaaaaaaagggaacaacccaacaaaactgaaaaaanaaaaaaaaggggaatctgaatatccctatagcaagggttagattgagttattaattttttttaaaaaaagtcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgggggcaaaacccggttgggtctangagacccccttacaggtgcctgactcacacctggctaacttttgtatttttagtagagatgggatttcaccatgttggccaggctggtctcaaactcctgacctcaggtgatctgcccacctcggcctcccaaagtgctaggattacaggcatgagccactgtgcctggctttactttttttttttttttgagacagtatctcgctctgtcacccaggctggggtgcagtggcttgatcataggccactgtaaccttgcactcctgggctctagcaatcctcccaccttggcctcccagaatgctgagatcataggtgtgagccactgtgcctggccatctttaccatttttaagtgaaaattggtggtaataaataaagttatatatgtatttttttcccccttgtatctccctttccctcttctctttgctgcttctgttaacaatcaatctgctctccatcttcatgagatctgcttatttagcttccacagatgagtaaggacatgtgatatttgtctttctgtgcttggcttgtttctcttaacataatagtctccaggtccatccatgttgctgcaaatgacaagatgtcattcttttgtacggctgaatgtntatatgccacatcttctttatcctgggataaagcaagtctcctgcttcaccctcctgagtagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttgagtgtgnctagacatcccccgctccggctgctnannagaataccccccttgtccactncaccagnagcaaagctaaatggcagacatgggnaaagcatcagcgggaggcatagcacaacgggttgggatgcaggcgttggaggatgcaggcacttctgttccaatcctagctctgctgcgtgacttgcttccgtgtgacttgttttccctctctggataatgggaagaatagtcatacctgcctcatggattgtgagggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttccgaaatcggcaaaatcccttataaatcaaaagaatagcccgagatagggttgagtgttgttccagtttggaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacttgnggtgncagaaaaccngcgctttagggtnangagnatcaccccgnggnaagcccaagcagtcacgtggacagtgcctgaccagccccagctttgagggcctccaagcccagtcaccaaacatgagagagaagaagccttcaggtgattctggactccactaacatatgactgataccgcatgatacatcccaagtgagaactgccccataaatccagaaaaccacattgctatcttaagtccctaagttgggggcttatttgttccacagcaacaggtaactggaacagagggcaagcctgatgaatgggcacacagactcagcccataccttccctggttctaatgttctcagggagcccggaccaaccctgggagcctcaggaacttaggtttccactggacagttctagaagggctatagaccaaatcaggtaactcaccagaccagccttggaatctatcaaatctaactgctgagctacccagtgcattccgatcctcatcacaattctttgactgaaggccgggcgtggtggctcacgcctgtaatcccagcactttgggaggctgaggcgggtggatcacctgaggtcaggagttcgagaccagcctggccaacatggtgagaccctgtctctactaagaatacaaaaattangtgggtgtggcggtgggcgcctgntatcccagctacttgngaggctgaggcaggagaatctcttgaccctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgggggcataaaaccaggctttctggtanagnacacncccataaaggccggataaaacttgtgcttatttttctttacggtctttaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgaggtgnctaaaatccaggcttgactctnanagnaaacccctctgtataanactccaccttgttagactgtatttgacctgacttgaaatttgtccaaggcaaaaaaaagccttttctgtggcacaactatcaaaaacaatgagaggcaattgtttaactttgtggctgcttgaagtggtggattacagttggggcaaacaatagactaactaaaaagcttaaaagaaaagctgggaagttagatgaccatatggcttgtgaaaagttctgacacattcctgggtatctagaaaatgcgcaggggtcccattctccgataagaggagctcactgtgcctaaaatgctttcacaaacactatggttcttgccaaagatatttttctatctgggatactggaatttaggtatgggctaggaagaggacaccaaataaccagttcccgttaaaaactgtgggcacttagtccctagtgagcctccctggtggacaatgtttcatacatgttgtcgcaactcgttggagaaattttctgtgcctgtgtgatttgtttggacaggattcttagaagcttgtgcctagtttcctctggattttgccccatgcaccttttttcttgtttattttgctaggtgtgctttcaccataagaaatcacagccaggtgtatgactatttactgagtccagtggtttatcctaaagatcactgaacctgcaatgctctagggcctcttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgcggtgcnagacaaccaggcttcggtgtanagnaaacacccgtgtggtggcgcgtgcctataatcccagctactcaggaggctgaggcaggagaatcgcttgaactcgggaggcggaggttgcagtgagccgagatcatgccattgcactccagcctgggcgacaagagcaagactctgtcttagaaaaaaaaaaaaggcggggggcggggggtagggtgagagtggacatccttatcttcttttaatatcgggggaaatttttcagtcttttaccattaagtataaagtagtggtgggtttttcataggtgccctttataaggttgaggaagttagcttctattcctagtttttcaactatttttattatgatagggcgttgcattttgccaaatcattttttagtctattgagatgattatgctttttttgtttgtttttctggttgcttggagtttattttccacttggtgccaggtgcacattttcaggtatcaagagagctcacaagtactggggcagtagggagcagggctttctcactccttttcagtgtctgctgtgttgatgtgaaagtcaacttgctgcagctgcctagtcctacagggtgaggagctgggagggagacagacagggcctctggtggcctagtccctccataggcctggggctggtggtggccactcaggtcaggacaggggtccaggatgggggctgtgctggaccggccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaactgggtggcnagaaggctncccctcgngggctnanagaataaccctctccccaggccctgtgttcatcgacttccnatcgaccttactccagggctgctgtcgctaacatatttatccctggtgcaagtgctgtcagccctgtgtggtcaacgaatactactacaggaagaagtgcgagtccattgtggagccaaagccggtgaggccgctgtgttcacaggacaccaagacacggagagattccgtgaaatcactcagaaatgcacgaaaattaggcccaaatcacaggcttcatcctgtagtggatacgtcgctgggctctaccccgatcaaccaactctcagataaattttttggtcttagagaagaatggaaacaaaaatggaggggcaagatagagggaaggcaaatttttatgtctaggacttgccaattttgtcatttatttatttatttatttatttatttatttatttatttatttatttattttcagatggagtcttgctctatcacccaggctggagtgcagaggcatgatctcggctcactgcagcctctgcctcccaggtttaagtgattctcctgcctcaacctcccaagtagctgggactacaggggcacaccaccacacctggctaatttttgtatttttagtagagatggtgtttagctatgttggccaggctggtctcaaactcctgacttcaaagatccaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgagttgcaaaaaccnccctcgaggtgtanagatacccctaggttgttaccgtgcactacagtagacttcataaacactgtacacttaggctacactaaatttacttcaaaattttatctttcttcaataataaattaatcttagcttactgtgactgttttactttataaatttttaaattttttaaactctgtacagtggtataaaaatattttctttctcaccgggagtggtggctcatgcctgtaatcccatcactttgggaggccgaggcaggcggatcacaaggtcaggagattgagaccatcctggccaacatggtgaaaccccatctctactaaaaatacaaaaaaatagccaggcatggtggcaggcgcctgtagtcccagctactcgggaggctgaggcaggagaatggcgtgaacccaggaggcagagcttgcagtgagccaagatcacaccactgcactccagcctgggcgacagagcaagactccatctcaaaaaaaaaaaaatctttctctatatccttattctatatacttttttctatttttaacattttttatttttatttttactttttaaatatttttgttaaaaactaagtcatggccgggtgcagtggctcacgcttgtaatctcaatactttgggaggctgaggtgggtggatcactcgaggtcaggagttcaacaccagcctgtgcaatatggtgaaactctgtctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgggggcaaaaccnccctcgggtgtnanagnaaccccatgtcctggtgcattgaaaacagatttgattcactcgcgcttgatttacccgcagctttttagacgcacagccaccaagccagcaaggtctgccgagattcagaaggacagagaactttctaccaaagagcaccagcccttctagattgtgtagcatttcatcaacaaaaatgactccaggagaccattcttgggtacatttttccacaaagaaaggatgtaaatgacaaaaagaagaaaggcatcggtcactgagagaaggcgtgtgacttctagatttgcaagcagggaaaatgaaagcagaattgccaaaaaagagaaattaaagtagggttgaggagtccaaaaaacagataagggggcgagagggacaaaggggcacgtttgcggcttggggggctaaaatgctttgcaaagacccatgaagcccaagctgctgtttgtttctaacagtgggtcattaaaatcctgtgattgctcaggtggtgggatgccctagtgccctttcattaaagtctgggaaaatctgaacagtgttgtgatgaaggctgctcccctaccctcgcctccccaggtctcctgagtttcaatttaatgagatttttactgcgtaaaaaaaaaaaaaaccaaaaacaaaaacatgaaaaggctgcttttgagactgcattggtaaatgactctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaccggggtngctgacntccccgctcgagtcntaaagnaaacactccccgctttctattccacaaaactgccattgtcatcatggcccgttctcaatgagttgttgggtacacctcccagacggggtggtggccgggcagaggggctactcacttcccagtaggggcggccgggcagaggtgcccctcacctcccggacggggcggctggccgggcgggaggctgaccccccccacctccctcccagacggggcggctggccgggcggggggctgacccccccacctccctcccagacggggcggctggccgggcggggggctgacccccccacctccttcccggacggggcagctggctgggcagaggggctcctcacttcccagtaggggcggccgggcagaggcgcccctcacctcccggatggggtggctggccgggcggggggctgaccccccacctccctcccggacggggtggctggccgggtggggggnngnnnnnnnggnnnnnngnncgcggccggnnnnngccggcgcccgcgccgggcgcggggcncggnngcgcgcggcnnnngcggcggggccccggggggggncggcgggccgcccccccgcgccgggggccgggcncncgngccccgcggggggcgcggngcgccgggggggcgggggggggagaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgggtggcagaaccccccgttgcgtgtanagnacccccatcacttgagctcgggagttggaggctgcagtgagctacgatcacgccactgccctccagcctgggcaacagagcaaggccctttctctggaataaaaaaaaaagagaggctgggcgcagtggctcacacctgtaatcccagctacttgggaggctgaggcaggagaatcacttgaacctgggaggtggaagttgcagtgagccaagatcgcaccattgcactccagtctgggcaacaagagcaaaactctgtttcaaaaaaaaaaaaagagagagagagagagtagctgccattttcaatgttattgataaagcaggtgggtgtttctgaaaatgcaccagatgcagccttagactggaaggtgctgatgtgttactgagcctccagacaaagctggcgaacccaccggggcgagactttatgacttgagaagctgtcctatctatgagggtccatgttagggaatattaaagaataggattgggggcagtagctttcctgtagcaagtgctagctatgtgccagatactgggcaaaggagtctgcagacgtctctcatttcatcctcacaatccatgaggcaggtatgactattcttcccattatccagagagggaaaacaagtcacacggaagcaagtcacgcagcaaagctaggattggaacagaagtgcctgcatcctccaacgcctgcatcccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgaggggctaaacccngcgttggggtctagnagnaaccccccgtttccccatccatctccagcctttgtttagggttgcagaagacctgcgttgttatgtgaagtggccagctgtcttgactaggaaatagatattttttaaagttcccaaggatagcatgggtatttggcttgggtagaggggaacagaggggagatcttgaggttaaaagaaatccagcattcataaggaggtagggtagttatactcagattaagttgaatgaacgaagtcattcccagtggctgagttgagttaggggacaaagagaagcttcctgcctggcaggggtgcaagccccaggggagggtgacctatgggcagagcaactgaatcagccttttgctcctgtatcttggacctgactagctactgtcccagtaacacatgtcaacaccataacaaacatagtagataccaatgatgacacatcttaaaactatgtgaaccagttggcaagtcctggtggttactgagtgtggaggtaggaggcggttcctattggtgggaaggcccaggcctctaccataatctcagtcacctagactgttggcaatacaaattcatggtctctaattcttaccactactctggaattcctgttttncctgttggctctctcctcccattcaccatagcaactattttgaatcttctctacactcattccaccttccacctgcctgccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgggggncagacaaccaggcctggctggtanagnaaacactctattcaattgtaacaggtgccagccccgcgtgggggctcacgcctgtaatcccagcattttgggaggctgaggtgggcggatcacctgaggtcagttcaggaccagcctgaaaccccgtctctactaaaaaatacaaaaattggccgggcgtggtggcgggcacttgtaatcccagccactcaggagactgagacaggagaattgcttgaacccgggaggcagaggttgcagtgagccgagatcgtgccattgcactccagcccgggcgacaagagagaaattccgtctcaaaaaaataaaaaaattaaaaaagtaacaggtgccttcaagtacaatggcacattcagcgaggcctgagggcggtagggcatctctagcctaagggggcagcatggggaatgactgactaggctagggcaggtaccacaaaaagccccacaaccccagaaaacaaaggaagcaaactttaaacactcgctacagtctgacctcgctactaccacatagtgacaccgcatagtgatcaaaagaaatgaccaaaagccacccacccagaaggaaccaagcggaaattccaagcctttggttttgtcagcaaatcatccaggatggggaagtggagagcgaagattgagacgntcagggcgaagcccctacagcacaggggcactatggggggtcacgcaggaaagggtacaccctaccaggctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactgnggtgcaaaaaatccgcgcctggcggtagnagnaaacacccatcttgagttagagaccagcctggacaacatagcgagacctcgtctctgtcaaaatacaaaaaaaaaaaaaaaaaaaaaaagcgggcgttagtggcggctcgcctgtagtcccagggaggctgaggtgagaggatcgcttgagcccaggaggtagaggctgccgtgtgagctgtgatcgcgccactgcactccagtctgggagacgaagcgagaccctgcctcattaaaccagaaaccaaaaaaggcgagttggggagtaatgaccttctcaggagggccagagagaacaagaaaccctttcggggaaaatggggtccgcgaagagagagtgacctcccatttgggacagagttcaagtgaggggtaacgagcgacctcccttaggggtactgataggtgccagggatttccgtagaggaccccggggctgtgcggagtagccatcgctcacgagtgcgggctcctaaacttgggcagctgtggttgggggagctggggccgcgctgtccttaacctcttggggaacagcctaaatatcaggtgtcctgtgagccctgggtgagagccacacgccctgtaaaatacccctcctggatttgagcctggtcgcattctcactccaaatacttccttaattgcagcccaggggaaataattttgtgggcatcctcttcactgagaaaatgctatcaaaccttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgggtggcaaaaaccccgctcgggtctanagaaccctctgacccagnactcaggcacctgccacttgctctaagtcactgagctcagctgccctcctgaattgtctcattagagtaacgtccccacgcaatcatccgggtgttatgtgaagtgctcacagcacctcaggacgcctcccgctaagccagctttgactcggttgctccccgaggcagctgttggagacaagtgtgacttgggaaaggtgaacacctgcccaccgtctcctgcctgcaccgtatcaacagggggctctattttcaatgcatttttccaaagctcatggctcagagatacaacaagaacagatcatggaagattcaaatccagactatgccagaaaagtgatctgggctgaagaaaacctcctggccattcccagaagcatcccgtcggcatctgggcaaaggcaggaggagcctcagacatcaccacctgccagctcctccactgaaggcgtcctggacctgaagctatcaggagattggaatcattgctgtggtttgtacagcagggcctgagtcttggtgaggaaggacaggagcagggaggcgcccactcagagctggggcagccactgcctcttctcagccaggcctgagtccagactgctggggcagctgctgtgatcaagaggaggcactgagaccctggcagcttgccggcttcactccctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgggggcaaaaccccgtttgggctangagaacccctctgggaccacgtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacggtgaccctatagtcgagggacctaataacttcgtatagcatacattatacgaagttatattaagggttccggatcaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtangcataggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgaggtggcagaaatccccgcttgagtgtanagnaaaccccctcccttgctgatctcatgatccgcccgccttggcctcccaagtgctgaggttacaggcgtgaaccactgcacccggctgggatgttcttaagtcagggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccactacgtgaaccatcacccaaatcaagttttttggggtcgaggtgccgtaaagcactaaatcggaaccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgggggcaagaaccngcgcttgggtgtanagnaaaacccccgattttttttttttcagaagggtctcactctgtcgcccaggctgggagggcaggggcacaaacacagctcactgcagcctcaacctcccaggatcaagcaatcctcccacctcagccttcccagtagctgggactacaggcacgcagcaccatgcctggttaatttgtttttctgagatggagtttcgctctgtcgtccaggctggagtgcagcagagtgatctcagctcactgcaccctctgcctcccaggtttaagtgattctcctgcctcggcctgccaagtagctgggattacaggcacctgccaccacatctgggtaatttttgtattttttttttttttagtagagagagactttcaccatgttggccaggctggtcttgaatgaactcctgaacccaggggatctgcccacctgggcctcccaaatgctgggattacagatgtgagccaccgtgcccagccatctttttttttttttttttgagaagaagtctcactctgtcccccaggctgggagtgcaggggcataatcttggctcactgaggnctctgcctccgaggttctagagatttttttgcctcagtctcctgagaagctgggactacaggggcgtgcccagctaacttttgtatttttagtagagaacagggtttaacatgctggccaggctgggttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttgaanggaactgggtgctgaaaccnccctgggggtnanagaaaaaacgcttttcaattaaaaaaaaaaaaatctcagagggtggagcaggatggctggatagaaaccaacaccatttggccaggcgcggtggctcatgcctgtaatcccagcactttgggaggccgaggcgggcggatcatgaggtcaggagatcaaggccatcctggctaacatggtgaaaccccatctctactaaaaatacaaaaattagctgggtatggtggcaggcacctgtagtcccagctacttgggaggctgaggcaggagaatggtgtgaacccgggaggcagagcttgcagtgagccgagatcgtgccactgtactccagcctgggcgacagagcgagatctttcccaaaaaaaaaaaaaagaaacctacatcatttgacccctcacaggaccaccaaattttaacagctaactacacacaaaaagcaccatcgcaagaaccaaaaatcaggtgaacaatcacagtacccggttttaaccttatatcgctgaaagagatgctgaagagggcaggaaagacagtcttgagttgctgatgccacccatcccccaccccccagcagaagccccgtggcacggagaatcagtgtgctttggagagggagagcatagcaatttgtgagacttcgcatggaactcngtgctgcattgtcacagcagaaagcagaacggaggtgtacttcgctgacactggctcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgggtgcagaatccngcgctgcgtctangagnaaacccttcttatacttaaagacagacttctgctacggtaattgccagtattcatggcttcctttctgtgtcagaagagaagggatctgctttctcttggctgatttcacatagcattggtaatagacatgcatttctctttctaaaggggagtaactttttaaacccttcctgattttagcctggcaatgtaagtgtccttaatgtgactgttttgataattaaaaaaaggtatataatttatttaaatcttcatttcctttcttttcagaaggtccccaaatcacagttaactcattcattgacgcattcactcaacaactattcaatgaggcactctctagagaccaaggataaataaggtagccagtctcatagagatatgaggagatggaaattaatcaaataattcaagcaaatggcatcttgcaacttgtgctgagtataatggtgaaaaggcaaatgatggcatgagagcttatagtagggaaatttggcctatttggggagatcagcctacctgaggaaggaatgttttagctaaaatctgaaggatgagtattacttaactagtgaatgcgggaggaaagagcattctaggcagagaacagtatgtgcaaaggtcctggggcaggaaaagcagagcaggtttatagaacttaaaggagaactgtatgactgtgccataaaaagtacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgtgtgctaaatctncactggggctgngagaacccccccacactaaacgttttggaactagacagaggtgatgattgcacaacattatgaatgtactaaatgccacagaattgtccagtttaaaatggttaattttatgttatgtgaatttcatctcaatttctctaaaaaggtgagttgatcttaaagtattacatgtgaggtacacaggtgtgtgtgtgggtgttacggtacaggaaatgacaaaaacttgaacacccctgttgtaagccatccctcttgagggagtggggactttgaagacctgagagaagtccaggcacagtggcccatgcctgtaatcccagcactttgggagaccgaggtgggtggatcatctgaggtcaggagtttgagaccagcctgaccaacatggtgaaaccccatctctactaaaaatatgaaaaaattagccaggcgtggtggtgcacgcctgtaaccccagctactcgggaggctgaggcaggagaatcacttgaacccagaggttgcagtgagccgagattgcggcattgcactccagcctgagcaacaggagcaagactccatctcaaaaaaaaaaaaaacctgagagaagccccttggtcccagcctttctctgacagcagtggtgacaggctcagctctcctncgagtgcagccctgtcactggccttgctcctgtctcagggctgggaagactgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaccttgtngctaanccncgctcgagttnanagaaacccacttctgatctctggcaacatattcaaattgtgttgtttgaagccactaagctttgataacttgctacagcagccacaggaaaggaatacaccaagtagctctcactcataaggattgttttgggatttgacgaggtagcgtaggtaaagaccttagcgcagcgggtggatttactaaatgctcagtaaatgtgagccacattatgaagacccagtggcccggcctcttggctgtttgacatcctccatccctagacacacagccccacatcccagtgtacaaagcaccaccaacctgaattgccacatctgaaaaattatcgcctgtttctcggaagatgtctcctagtcggaaaatgggacactgtggattctgagtcttgtggaaggtacaagtgatgtttaaacctggcaggatgtttctcctgtccataattaaaagcaaacaaacaaacatctcgattgaaaacagatctgtctctttcccaggagtgagccagtgtggtggagaggttccatgaaagccccaaatgatccctgcctcctgggacccctgggcagtggcctctcacactggaccagggttgatctgtgtgaccaatggcatatggcagaagtgttggggtctccccccaaagactgtggcttccatcttggttatactcttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgggggcaaaaatcccccctcggaggtnanagaaaacaccctctcaggcccaaactcttgagtcctcgcactcagtggggatccgcaatgcggctgcagctgttcaatgcaggggcaggaatgtgccctccgcatttcctctcatcacagcgctcagccctgggcagcctgtcttaggccacatgaaggtctcatgaaaacacccctgggctgggctctagctcgagtgggcaaaggttccctcctcacactgttcagcctgttggaccttctcactgaacgaggcgtcttcccaggatctgacccaagtcagagggtggtgagggtgggctcctgcagaccctgggatgtccattttcctggggtctctctgctctgatgctgtttagacaaggttggtttcacttctctgtgtgcaagtgtaaccccctccccacggcttccctctaggccaaggcactgtcctcatggttgtatccccatatctcacacagtgcctggcccttgtgcaggtgctaaaaaaaatcctgtttccttgcagaggccctcagaagccacacatgaatgatgggatcagagcacccaaccccactgcaaggaaacacccagggagggagtcatgtccttttcatgtttgtatctctagagctgcagcatctagcgtgggaatcccagcctggaggtgctgtgtataactcattcattcattagtgcagttaatcacaataaaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttgctgggctaaaaccctccnctgggggtngnagnaaaacccaaacaaactaatgtgctgttttttaaaaaaaaattagaattccttttggagagcaaaataaaactgatttctcttctttcctgagattcatctccagttgataatgaaaatgtaactttccatgagccacaatgaatgatcacacattcattccttccatgactatcaagacctactatttgccaggcacttgggctgcaaagatatgaccttggctctgtattcaaagggttcataatctaatctggggagtcacaaggggaggagaccaacggcatgccatgtgacaaggcagcctgggaaataaagagatcatgagagagtttgaaaactacaagaaacattcattgagcatgtactatgtgctaaaccctttcttttcataactcacttaatcttcacaacaaccaggcaagacaatttgttggctgggcatgatggctcacgcctataatcccagcactttgggaggtcgaggcaggcagatcatgaggtcaggagttcaagaccagcctggccaagatggggaaacaccgtctctactaaaaatacaaaaattagccaggcatggntggtgcgtgcctgtaatcccagctactcaggaggctgangcaggagaattgcctgaactcaggagggtggagttacagtgagccaagatcacaccattgcactctagcctggtcgacagagcaagactctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactagggggncaaaaaacccggcttgacgggngnggnaaaaacaccagnaaaagaccagagacacgtacaaggcagaaggcctcatgacaggagaggcagagactggagtgatgcatccacaagccaaggaacaccgtgggctaccagaagccaggagagacaagtaaggactctctccagagccttcagagcgagcacagccctgctgatgcctggattttaggttgtggcctctagaactgtgagaactgtgagagaatcaagtcctgtagttgcaagccactgtttgtgggactcgcttacatctgccccaggacaccgagatgccagcatttgcagcagggaacccagcaaggcctttcaggggcctcagacctgtgtcccctgcactctggagattctggcacaggttcaacctttgagaaaccaattcctgggccaggccccagaggcctttggactggaggatcacaagatcatccgctccttgaggcagtgaatggaggtcatggctgaggcaggtgctggaaagcttaagcccccagcttctcctggctgctctaagaaccatctcaacatgtttcttgcggcaggaaagggcaaggaggggtctcgggggccgggatggccccggagcaggacaccactaagggcattttcccagcatggccttcccgccgncttggacgggggaccggcagcctgcccttggngtgctgcctgagtgctggtcttcagtgggcggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttggtngcaaaacccccattggggtanagaaacccagacttgtaaggagctcaaacaacttcaatagtaaaaaaacaaataatccagtgttaaaatgggcaaatgatctgaacagatatttctcaaaagcagacattaaaatggccaacgtggctgggtgtcggtggctcatgcctgtaatcccagcacattgggaggccaaggtggaagaattacttgaggccagtagttacgacaagcttgggcaacacgatgtaattctgtttctacaaaaaataaaaaattatctgggcatggtggcatgtgcctgtagtcccagctactcaggagggtgaagcaggagacttgctttatcccaggataaagaagatgtggcatataaacattcagccgtacaaaagaatgacatcttgtcatttgcagcaacatggatggacctggagactattatgttaagagaaacaagccaagcacagaaagacaaatatcacatgtccttactcatctgtggaagctaaataagcagatctcatgaagatggagagcagattgattgttaacagaagcagcaaagagaagagggaaagggagatacaagggggaaaaaaatacatatataactttatttattaccaccaattttcacttaaaaatggtaaagatggccaggcacagtggctcacacctatgatctcagcattctggggagccaaggtgggaggattgctagagcccangagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgcgtggcagacaccnccttttggggtanagnaaaccctcaaaactggctgggcacggtggctcacacctataactgcagcactttgggaggccgaggcagacggatgatcatgtgaggtcaggagctggagaccagcctggccaacatggtgaaacctcatctctactgaaaatataaaaaacttagctgggccttatggcaggtgcctgtaatcccagctactcgggaggctgaggcaggaagaattgcttgaacctgggaggcggaggttgcagtgagctgaaattgtgccactgcactccagcctgggtgacagactccatctcaaaacaaacaaacaaaccccaaaaaacaccaggcacgtggcttacacctttaatcccagcactttggcaggccaaggtgggtggatcacctgacattgggagttcgagaccagcctgaccaacaatggagaaaccccgtctctactaaaaatacaaaaattagctgggcgtggtggcgcatgcctgtaatctcagctactcaggaggctgaggcaggagaattgcttgaaccggggaggtggaggttgccatgagctgatcacgccattgcactccagcctgggcgacaagagtgaaactccatctcagaaaaaataaaaataaaaaataatggcagcaatcaaaacacatttccagccttcattcatacttaccctatagtaatgagttagtcccaacctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacacttggggcaaaaaaccccgtttggggtanagnaaaaccccactgccctgctgtgaggaagcccaagcagtcacgtggacagtgcctgaccagccccagctttcaagccatccaagcccagtcaccaaacatgagagagaagaagccttcaggtgattctggactccactaacatatgactgataccgcatgatacatcccaagtgagaactgccccataaatccagaaaaccacattgctatcttaagtccctaagtttggggcttatttgttccacagcaacaggtaactggaacagagggcaagcctgatgaatgggcacacagactcagcccataccttccctggttctaatgttctcagggagcccggaccaaccctgggagcctcaggaacttaggtttccactggacagttctagaagggctatagaccaaatcaggtaactcaccagaccagccttggaatctatcaaatctaactgctgagctacccagtgcattccgatcctcatcacaattctttgactgaaggccgggcgtggtggctcacgcctgtaatcccagcactttgggaggctgaggcgggtggatcacctgaggtcaggagttcgagaccagcctggccaacatggtgagaccctgtctctactaagaatacaaaaattaggtgggtgtnggcggtgggcgcctgtaatcccagctacttgggaggctgaggcaggagaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactacgtgcaagaatccngcactgggtgtgngnaaaacccaacttctatgacaaaagaaaggcttagggattaaatcagcacagtaggagatacctaacacaaaataagatggtaatggaggaatatcaaaagcaaaagacatcccacatatagaaaaatagcaaaatagaatatttcaatcatgttagtattttactaaatccccattggtaattaaatcaaatggagtttcattatacacttgagttaactggcagagagtggtagaacagataaaaaatgtgatctacctatatgctgtctacaacagtcaaactttaaattcaagacacaaagatgatcaaagtaatagaataggaagaaatgcagcaagcaagtattaaccaaaagagagccagaatggccttattaatattagatcaaatagacttaggacaaaattattcctagagatgaagaagaacattttataaggatcaaacggtccattatttgagggtataataattacaaaattgttataaaattataaatgtataaattataaaattgcatttggcacttaacaacagagcttcaaaatacatgaaggaaaactgacagaatagaaagttgaagtagacacttcaacaataatatttggaggaacagaaagaaaaaagattgccctctccctctcnctctncctctcttttcacgggctccctctccctctcttttcacggtctacccctgatgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgggtggcagaaaccccgctgggtgtgngagaaacccgncgaggtctcgctatgttgtccaggctggtctctaactcagaattcctctcacctcggcctccgcaagtgctgggatgacaggtgtgagccaccgcccccggcccctcgcccgccttttgaaggagcctttcgtcctcaagggcgaggccactccccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgagcgtggggccgcgcggggggcgcggcgggtgctgccctcgcgtccgcgccgtgcggcggctcatcctggcctcggtcacctgggcgagtccgggagcggcgagccgaggcggtgacaccttccctgggccccagccgccgcgccggggccccgggggcgggaggctgcttgctgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagactgaatagacaaaaccaccgctcgngctctatagatcccctcctcttagcacaaatagacttatgacaaaattattcctagagatgaagaagaacattttataaagatcaaacggtccattatttgagggtctaataattacaaaattgttataaaattataaatgtctaaattataaaattgcatttggcacttaacaacagagcttcaaaatacatgaaggaaaactgacagaatagaaagttgaagtagacacttcaacaataatatttggaggaacagaaagaaaaaagattgccctctccctctccctctccctctctttccacgggctccctctccctctctttccacggtctccccctgatgccgagccaaagctggactgtactgccgccatctcggctcactgaaacctccctgcctgattctcctgcctcagcctgccgagtgcctgcgattgcaagcgcgcgctgccacgactgactggttttcgtatttttttggtggagacagagtttcgctgtgttggccgggctggtctccagctcctaaccgcgagtgatccgccagcctctgcctcccgaggtgccgggatttgcagacagagtctggttcactcactgctcaatggtgcccatgctggagtgcactggcgtgatctcagctagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactgacttgacagaaaacacaccttgactctnatagcaaaccccctcagcaaaggtctcacacaaatgtcattggctctgattggcccactatggatgacctgcccactgctgaactaatcactgtgaccagggtcatgccctactcccagtggttagtgtcgaaccagccctaacctatcccaggggccagcagagaggccaacaccccagccccttcatcacacacacacacacacacacacacacactacatggactgaaaagaaaattggagtgttgccttctgaagatggaaggaaaagatgccagctctgcaaaaatcaacatatcccacgacatcctgtccaagagcatgttatctatgtaacacagtgataagcaggactagaagcactaagatatagctgagagaatgcaaagaccgctgggaataaaaaccacaaagctgggccgggcacggtggctcatgcctgtaatcccatctctttgggaggctgaggcacgtggatcacaaagtcaggagctcgagaccagcctggccaacatggtgaaaccctgtctctactaaaaatgcaaaaaattagctgggcgtggcggtgggtacttgtaatcccagctacttgggaggctgaagcaagagtatctcttgaacccacgaggcggagcttgcagtgagccgagattgcgccactgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgtagaaatgaaaaaaccacgcgctcngctctnatagcaaaccccctcgctcttaatatctccgtggtcaccggtttatttgtgaagtgttcaccccctggcctctggggactcactgtctttcggctttcctctcctccctactctgcctcatcttactctccttggtgttggtgtccttcatggatctgtcttcggtccccctccatgtcactctaccctctccctgggcagacccctggctccactcttgccccttccgccccttttccatggtgcagctagagtgctctgactgagctgcaaatgagaccatgcacacccgtttataaacccacctcttgttctcagggtaaattccagacagactctttaacaccagaacataaggctggacgagattcatgtccaagtagtttgtttgggaggcgacccacgaagaggagtggggaagtgagacaggaaagggaaggcactcaacacacgaagcattaaagagtatgtcatgaggccggacgcactggctcacacctctaatcccatccctttgggaggctgaggcgggcggatcacctgaggtcggcagttctagaccagctagggcaacatagtgaaactccaactctactaaaaatacaaaaattagccgggagtggtggcacgcgcctgtagtcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctatactatgcagacccgcncgcgtcngctcgtatagcaaacccctgcacagggacccctcacacatggtatgtccggcctatgtgtccattgttcatcctgcttctttaaaatctaaattccaacagggtaaggatttcctctgttttgttaactcacctctgcccaaagagtctctggtactcactaaatatttgttgactaaatgaattagatagggtgtggtgatggagagagtcccgccgccactccctgcccccatctctaattctaacgttctaacccggctcttgaccttggagccggttaacgatgatcctgtctgggctcattttccctccttttcctgaagagcagcatccacaggccctcactcagctcactcccttttaacccttgtctgctgagagtttgagataaagggggccacgagagaagacactgaatcccttacaatgtgtgatgagctgtctgctctgtggcttcccacagcaatttatcatgacctggaaccacagctgtgaggccgggtgtgcccccgccaggacctcactccccagctgcttcagaaaggaacatttacaggaacctgtccctacctatttaatgaacagctgctcggatgcagccctgtcccaggcactcagccaaatgacaaatgaactctataatcattcattcattcgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagactgaaactaaaaacaccaaccctgngctctatagcaaacccccctctgcgctcgctgccctgtgcctttttaagttaaaatgtgagataaagaaattctgcaggtataaaaactagcactgcacttatatctaattaaactcaaactcaaactcaaaataaaacactgcaaaaactgtttaaaaactaaaataaaataaaaaacaaaaaaaattctgcaggttaatatgggtattgctgccaggttccctgggggtaaaagttcatggtcctcaacctttgaggaaattcagggggaaagtttagaatactcagatgatgctctaggccatgtgaattttctaccgattagaatcctgaacctgctaagtttttaagagcttcttctctcactggaaaactggagtcatgtttacactcagcagctggtctgctggggacatagccgaagcatgggcacactcgcctctggcttggtgatggtggaagatggcacctgagagcagaggctgaagacctgacctgggcatcacatatgtcaccaagatgccagaccatccacccctatggtctcgggaaaagaaacagaaagtacctttgctctgcgggtccatccatccctttttacaacctcggtcagaggaacacagcgtcctgcgggtgggatactgcagatagaaagatgacagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgactagacagacaccaccgctggngctntnagnagcaaaccctcaaacaatgtacttaccctctcctcttctctcccaatggaagtcctgtgctgctgttactgtttccttttagttgggttttggtctctaatggtcactaattctttttttttttttttttttttttttttataaaaatggggtttcaccacattgcccaggctggtctcaaactcctgggctcaaggtatttgcccgccccagcctcccaaagtgctgggattacacacgtgagctactgtgcccggcctaaagtttttacactgtctgaaaagatttacctcgggtctttgggacaataatgcaaacccaaaatgtggaaaggggatatttccacttgaatttctctcaggatttaaaacatttgttttctcatctttcagggctttcaccctgccatgctttcaagctgaggaaccacagctgcctggatacactctgttagatcctaagctgaaaagagatctggctgcaccgttttcttggactaaaacaatcattctgggcattggtgatgtcaggactcaggccacgtcattccttaatcaagtgtgcaaagtcactaaaaagcaaggtgtcactgttagacanaagacacagtgggagacacacctgagctggtgtcacataatccgccacctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacctgacttgacagacaccacggctgcngctctnanagcaaacccctacagtcgcctgccaccacgcctggctatttttttgtatttttagtagagatggggttctctccaagttggtcaagctggtctcaaactcctgacctcatgtgatctgcctgcctcatcctcccaaagtgctgagattacaggcatgagccaccatgcctggccatttctgttgttttaagccacttactttgtggtaattcagccctatgaaattgaagatgcccagcaaccagaactgctggggagagtgcaaatgtgaacaaccatttttcagcaccgtttgttagtatctcctaaaaccgaacatatgtctgccttatgactcagcaattccactcttatgtaactgtccagtagagtgccatatgttgagcatagcagcgttattggcattagccccaaactggacactacccaaatgtccatcaacagtaggatggctgaataagttggatatttataaaacagaattatacaatgagaatgaactatacatggcatcatgaacaactctcacaaaaataatgttgagtaaaggaagccagacactcaaccgcgtatataccgcttacatactacgtgattcagtttttagaaaattctagccaaagtaaaattaatctttggaaacaggatgatgactactcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttctgtaccccgttggcctaagaccccggcgaaaattacctggctttttaaaggttctatctatctggggatcacaagggagagaccaacgctgcctgtgacaaggcagcctgggaataaatagacatgagagatttgaaaactacaaggaaacattcattgagcatgtactatgtgctaaaccctttcttttcataactcacttaatcttcacaacaaccaggcaagacaatttgttggctgggcatgatggctcacgcctataatcccatcactttgggaggtcnaggcaggcaatcatggaggtcangagttcaagaccagcctggccaagatggggaaacaccgtctctactaaaatacaaaaattagccccatggtggtgcgtgcctgtaatcccagctactcangaggctgaggcaggagaattgcctgaactcangaggtggaggttacagtgagccaagatcacaccattgcactctatcctggtcgacagagcaagactctgtctccgnnnnnnaaaaannnaaaaaaagacaaatctgtgcaccctgcttttacagatgaacagtgagctggccaaggtctctcanctagaaaatggtgcagctactgctgaaccagattaccggggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccctggcttgacagacaccacgcctcggctctnatagnaaaccctttctctgggtaaatcaagtaccctctctcctacaatctaaaaagcaaaggctggacagagccctggcttcacttccatccatctataaagtgttttcaatggagagttttaccaatgaggtctgtttagatccggcaaagagaagaatctgctgacagtcacatggaagagaattggcatctaaaataaaataaaagccaattcttggcccactgattattgggtacatcagagtatgttatccatgaattcagtatacccttactggaagattctgcttattgaaagagtgcatgggccaggcatggtggctcacgcctgtaatcccatcactttgggaggccaaggcatgtggatcaattgaggtcaggagttcgagaccagcctggccaacatggtgaaaccccatctctactaaaaatacaaaaattacccatgtgtggtggtgagcacctttaatcccanctactcgggaggctgtggcaggaaaatcacttgaacccaggaggcggaggctgcactgagcaaagatcatgccactgcactgcagcctgggtgacagaatgagactctgtctcaaaaataaatctaaaaaaaagagagtgcctggaattttgattcagaatgactaatgcaagttataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttgacttgcagacccacgcctgcngctctnanagcatcccccactaccaacatacagnaatgggggcctggnaacatgtctgaggagaaaaaagttgatctgctctctgaaattaattaatcatacttaaatgttctaagttaagatgttaattgtagtctccagggcaactactaaaactactaaaaaaattccaaaatatatatgacaaaagaaatggcctagggattaaatcagcacactaggaaatacctaacacaaaataagatggtaatggaggaatatcaaaagcaaaagacatcccacatatagaaaaatagcaaaatagaatatttcaatcatgttagtattttactaaatccccattggtaattaaatcaaatggagtttcattatacacttcacttaactggcagagagtggtagaacagataaaaaatgtgatctacctatatgctgtctacaacagtcaaactttaaattcaagacacaaagatgatcaaagtaatagaataggaagaaatgcagcaagcaagtcttaaccaaaagagagccagaatggccttattaatattagatcaaatagacttaggacaaaattattcctagagatgaagaagaacattttataaagatcaaacggtccattatttgagggtctaataattacaaaattgtgctaaaattataaatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacatgacttgcagacccgcgccgtcngctcgtatagnatcccccattgcagcatgtactatgtagctagaacccttctcttttcataactcacttaatcttcacaacaaccaggcaagacaatttgttggctgggcatgatggctcacgcctctaatcccatcactttgggaggtcgaggcaggcagatcatgaggtcaggagttcaagaccagcctggccaagatggggaaacaccgtctctactaaaaatacaaaaattagccagcatggtggtgcgtgcctgtaatcccanctactcatgaggctgaggcacgagaattgcctgaactcatgaggtggaggttacagtgagccaagatcacaccattgcactctatcctgggcgacagagcaagactctgtctccaaaaaaaaaaaaaaaaaaaaaagacaaatctgttcaccctgcttttacagatgaacagtgagctggccaaggtctctcagctagaaaatggggcagctactgctgaaccagatctacctgggtccaaaacctaggtccttgacctgaatcactgtggaagccacaaattgcacagatgacaaagagcagaggcccttttcacacctatgtcatgttctggcttccccaagactggccatgaagcctgctccctataaaacaggaagagaaatatgcctaaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgactatgcaaacacaccgctcggctcgtatagcatccccctgtcactaactccaataaatacaccatggaaccctgacctctcctgggaactctgatcagcagttgacactgactgtgaccatgccccacttccctcgcctccttcccttatcttgcaggagtccaccttgtgcctgactttcactggatcgccgtggctactcctcaaaatcttttggggacttctgcgctcccacgccttaaaggggagcactcctttggggcgtgttctaagcccttttgctttctcatctacatcttctcttgctgggcgggtgcaccttcttccaaggttctggttgccgtctctctgctggtgatatagaaacctacatctcagctgcagattcgtctatccaaccctccattcaacatctccatttgtacattccctagacacctcaaactcaatgcctttagtcctgacctcatcttccaccccaaattggctgtgtctcctgcatttcctctcccagcaagttcttccagtacccatcagttgcccaagccagaagcatggtgcactctttgactcatactctacttcttgtgcactcacccgttcagttgccaaatcctactgtgtcacttcctaatatgctcaaattcatctacttctctcctctgcctctatcacctacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgaaatacaaacccccggtggctctatagatcccccgctcggtgtgtttactgggcagatgaggaagggcacaagccccgcttttgtcccttggtggaaaggagcaccccacaactcatccttccgtggtggatctgggcgggggccgtgtgatttccccagggctttcctcatgagctttcacgacgtctgtgttctttgtagatggaacacactcatctatttgcagccccttggctcatctccagactgaaattacccttaatttgaagtagataagtgataggaaacaggccacatgtggtggttcatgcctgtaatctcaacacttttggaggccgaggcagaaagatcacttgagcccacgagtttgaggctgaagtgaactgtgatcacgccactgcactccagctagggcaacagagcaagaccccaactctaaaagagagagaaagaaggagagataggaaacgaaaagtagaccatactggattgttccaagtctaactcatgagagtcgtatgagcggccttctctaacaccaaatgcagagtgtgtttgtacattgaacacctgggaacgtgacacgtggcgggagataagctgcagctcatgccacatactcacgcctcctcctgtggacttctccttgtctaccaacataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacttgtcttgcataaaccacgctcttggctgctatagcaaaccccgcaactaggcanaaatagtggttacctaacactgtgaatgaactaaatgccactcaattgttcactaaaaaaaaaacagagatggagtcttgtcgtgttgcctaagttggtctctaactcctgggatcaagcactcctcccgcctcatcctcccaaagtgctgggatcacaggcctgagccaccgcgctggccaattgttcacttttaaatgattaatttcatgttatttgaatttcacctcactggaaaaactcagccccaaacatgccttatcttccctccctacctgatttttctcctaatgcacagggcccctcacacatggtatgtccggcctatgtgtccattgttcatcctgcttctttaaaatataaattccaacagggtaaagatttcatctgttttgttaactcacatatgcccaaagagtctctggtactcaataaatatttgttgaataaatgaattanatagggtgtggtgatggagagagtcccgccgccatccctgcccccatctctaattctaacgttctaacccggctcttgaccttggagccggttaacgatgatcctgtctgggctcattttccctccttttcctgaagagcagcatccacaggccctcactcagctcactcccttttaacccttgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagactgactatgacagacaacacacgctcngctctnatagcaaaccctcgcacttttgaccaanagtcttggctaatctagcatctttgtgtcccttcataacgtggcttctaactttgtctctgatgtggcaattcttcctgagcacaattaatgcgtcctccttggctacgaaaatttttttttctttttttctttctttttaaatggagtctctctctgttgtccaggctggaatgcagcggtgcgatctcagctcactgcaacctccacctgctggatgcaagtgattctcctgcctcatcctcccgagtagctgggactaaaggtgcatgccaccacgcccggctaatttttatatttttagtagagacagggtttcaccatgttggtcaggcaggtctcgaactcctgacctcaagtgatttgccctcctcagcctcccaaagtgctgggattacaggcatgagccaccgtgcccagccagctctgagatcttgaaaccagaattcctcctatgtgccagacacaactcaagtgtttggggaatgcttggtgaatgagtggctggatcgctgaatggatggactgctggctggaaataattaagataatacacgtccctccagaacatcaagcctccaattgcagcctatgcttctccaggcctttctcagaatacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagctgacttgacagacaacacggctgcagctcgtatagcatcacccctctcttgggtagaaaggggcagtccttgcaaatgtcacaagactgggagctgcccttatgcctcaaaaaaggactgagatctttcccttgcctgaagccccactcatgagattgatgtcattcactttctacaaccctttattcatcccctgatgtataggagctctgggtaaatgaagatctccccctcttcttccaccgccccttataatactctggtctgcagttggtgggggaaatcacatttgcacgggtaggggtggtgggggctggaggggctctatttttctgccanatctttcatgcttgaccctctgagttactctccaccctcctctgcaccccggcaggtcgatctctgtcctataccactcagccaaagatcaccanggacacagtggcggtccaacaaagttatgtttgttgtcctcttcactgagggacaccacccaccataagagctacgcacatctccaaacaaaggataacaccactttcttctatgattccgacgaaagtggagttgagataaaatctaattgaantcctgttttgctggactcaaagcacaacacgtttgtacaaagcagtcaactccactctggcttgcaaaaatgacccacggccctgtttactaagaaacaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagactagaaatgaaaaacaccacacttgcngctctnanagaaaaccccgccacacaagcaaaacatactaatgatctagagaaccanaaagatgtggattctgctggctcttttgtttctttataataaaaggtgcccctgatgggagcggaacaggtgtctgctctcacttattataaatggactactaacatggcgctctcaaaggggcacaagtccctcaaggggtacacagcctgcccaggatgtgcaaagccatgaaatcagcatggcacatcttcctggagtgccaggatgattaatcactttccaagggagaattaattaaatagtgagcaatgttaaaataacttttatactaactcaaatacacatacagtatggagtagaatgcagtaatgggcatatgcctttttgtgtgtgtttgcattataaccactgatttttttttttttactatttgcagtatttttaaaattgccctgtgccttttttttttttttttaaaagggtctcgctctgtcacccatgctggagtgcagtggcatgatcttggctcactgcaacctctgccttccaagttcaagtgattctcacgtctcancctcccaagtagctgggattataaacgtgtgccaccatgtctggctgatttttgtatttttattaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcctgactatgcagaaacacacgctgngctctatagcaaaccccttcgctcccaaggaagtcctgtgctgctgtctctgtttccttcttgtttgggtctttggctctctaatggtactctaattcttttttttttttttcttttttttttttttataaaaatggggtttcaccacattgcccaggctggtctcaaactcctgggctcaaggtatctgcccgccccaacctcccaaagtgctgggattacacacgtgagctactgtgcccggcctaaagtttttacactgtctgaaaaaatttacctcgtgtctttgggacactaatgcaaacccaaaatgtggaaaggggatatttccacttgaatttctctcaggatttaaaacatttgttttctcatctttcaaggctttcagcctgccctgctttcaagctgaggaaccacagctgcctggatacactctgttagatcctaagctgaaaaaagatctggctgcaccgttttcttggactaaaacaatcattctgggccttggtgatgtcaggactcaggccacgtcaatcattaatcaagtgtgcaaagtcagtaaaaagcaaggtgtcagtgttagacagaagacacagggggagacacacctgagctggtgtcacataatccgccacatcccagatccggaatccaagtttagaagtgttggtcacagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttgacttgcagacccanccgctcngctcgtanagcaaacccacccctatgaagttggtgaaattattattctgcttttacaggtgaggacactgaaactcatagaggaataagcccttttcccaaggacacacagcaaaatggtgttagagttaggaattgaatccaggtctttctaactattctctgctgaaatacatcagcccttgtggcttctgagatttaacattgtgactttgtgtcttgaagcgaagcatcaatacaagggaccaccaaatctgtctgtcattgtaagcatttaatctgagaaaacttccttcccccccccttttaccctcaccccttttgctttttcctccccttccccttctcttccctcgcttcgtccttcccttccatctccctccttccttcctatccttgatcactcagtatggacactgacaagtcagaaaggatcctgctgtggcactacaggagggggtctgggggtaccctggaagatctgggggaaggaaggggccagggacacccaaagatgctcanggtagtagctctttaccagttggtacaggagtgtgacaacagtttaccaaccaccatggccctcccagagatactagtttgtgccaagcagtgcatccagagcgcatgggtccccaagccggtaagacccangactctgcaggactgtgctgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgtcttgcagaaacancctcctggctctnatagcaaaccctcttactaataacctgccttagtccttctgaatcaaaattccatgcactctcttttttttaaatttatttttgagacagagtctcattctgtcacccaggctgcagtgcactggcatgatctttgctcattgcagcctccgcctcctgggttcaagtgattttcctgcctcatcctcccgagtagctgggattaaaggtgctcaccaccacacatgggtaatttttgtatttttagtagagatggggtttcaccatgttggccaggctggtctcgaactcctgacctcaattgatccacatgccttggcctcccaaagtgatgggattacaggcgtgagccaccatgcctggcccatgcactctttcaataagcagaatcttccactaagggtctactgaattcatggataacatactctgatgtacccaataatcactgggccaagaattggcttttattttattttagttgccaattctcttccctgtgactgtcagcagattcttctctttgccggatctaaacagacctcattggtaaaactctcccttgaaaacactttatagatggatggaagtgaagccagggctctgtcaagcctttgctttttatattgtaagaagaaggacttgatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgcttgctacacccggctcggctctatagcatacccttcctctgatagaaatctgaattccttctctgtgtcatcttgaattgctgtgagtttcctcaatacagctctttcaaattgtctgcctgaaaggttgcctatttttgtttctccgtgattggtccctggtgccttattcactttggtgaggtcatgttttcctgcgtggtgttgttgcttatggatattcatcactgtctgagcagtgaagagttaggcatttattgtagtcttcacagtctgggcttatttgtgcctgtgattcttgggaaggcttttcaggtcttcaaagggacttgaaccccgaacccaataaaactgtagttctgcggactcgtaaaggtaccaccttagtggtcttggagaagatccagaagaattctctgcattaccaggcagagattcttgttcttttcccttgctttcttccaaacaaatggagtctctctctctctctctccaagctaggcctcttggaactgggggtgggaggacacaagaacccctgtggccctcaccactgggactgcactggttcagacctgaagcagcccagcactgggtctcacctaaagtctgctggaactgctgcctggccctcaccctgattcactcaagggcctgggactctacaatataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacatactatgcagacacacacgctcngctctnatagcaaacccctcctcaccccaaaagaaaaccccgtacccatttggccattcctcctcctgcagcccctggtaacaaaagcttttctttctctgtgtgggtttgtctgtttttggatctttcacataaatggcatcatacactatgtggccttttgtgactagctcctttcacaagaatctcaccttgttttcaaggttcattcatgtggtagcatgtgcctttcattcttttttatggctgagtaaaattgaatcacatggatagaccacattttgttaatccattcgtctgtttagggacatctgggttgtctccatctttggctactgtgaatagtgctgttgtgaacatttaagttacaagtctctgtttgaggccaggcatggtggctcacgccagcagtcctatcactttgggaggccgaggcgggtggatcactcgagatcaggagttcgagaccagcctggccaacacggtgaaaccccatctctactaaaaataaaaaataaaaataaaaatggtctctgcttgagtccccattttcaattctttggggtaaaaacctaaaagtggaactgctgggtatatgggaattctatgtttaactcttttaggaatggccagtttcccacagcagcagcaccattttacactcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatactttgtcgtggngcagaaaaacccggcgtcctttgctgctnannaganaaacaccctctgcccttnccactgnagtaacacactaaagctctggaccattctttaccctttattctgcctcttgagcggatctggtacttcctcctgtggccctgtctancatggcatggcctggtgtggcctggtctggtgtggtgtggccccctctcttgggaaaatatgtaataaattcttcttggccaggcgcactggctcacgcctgtaatcccatcactttgggaggccaaggtaggcagatcacctcatgtcatgagtttgagaccagcctggccaacatgatgaaaccccatctctactaaaaatacaaaaattagctggatgtggtggcagacgcctgtaatcccagctactcaggaagctgaggcaggagaatcacttgaacccacgaggcacaggttgcagtgagccgagatcacaccactgcactccggcctgagtgagagagtaagactgcctctcaaacaaacaaacaaacaaacaaacaaacaaaatcttctttgagtggcattgacctctctctgtcatcactcagtactaactttaaaaattaagcgccaggcacaaatcatcacagtcacccgtgatatgcaaccctcaccactgctgcagtcatgaaaagtggtgtgttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgtgtgggaaaagacccgtctgtggtcgtanagaaaaccccctcctcccanctactcgggaggtctgagcaggaaatcacttgaacccagaggcggaggctgcactgagcaaagatcatgccactgcactgcagcctgggtgacagaatgagactctgtctcaaaaataaatttaaaaaaaagagagtgcctggaattttgattcagaatgactaatgcaggttattagtaatattctagtacaataccgggctttaaaaaataaaaatttctgggcttctatacaaaaaagcgcaagtgacatactaagggaaagaaattagaatctacctttttgagagcaatactttgtacctgaggaaaatggagtacatatttaagaaaagaaactgtaaaccgcgaatgttctatccagcaaaactcacatttgggtagagaagaccctgacgtgccatgctgtgacagaagacctcaggtgctattattcccatgatctcttccagagaaataacaaacttcagacaacaaaatgcctataaagacattgacacagggcagatcttgagtcctaaatttgctacttgtgtaaataaaactaaatgagggtgatatgagagggtgtggggcccctcccaagatcatgttcacagggtgctaagacctgtgtgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacttggtgnggagacaccccgtcctgagtctgatagaaaacccgctcgtcgcacgattaatgtcgtctgtgctgctgatgtgctgattgttcccacgcctgctgagtagtttgactacacctccgcactgcagtcttttcgatactgcttcgtgatctgctcaagaacgttgatcttaagggttcgagcctgatgtacgtattttgcttaccaaatacagcactagtaatggctctcactccccgtgggtggaggagcaaattcgggatgcctggggaagcatgggtctaaaaaatgtggtacgtgaaacggatgaagttggtaaaggtcagatccggatgagaactgtgtttgaacaggccattgatcaacgctcttcaactggtgcctggagaaatgctctttctatttgggaacctgtctgcaatgaaattttcgatcgtctgattaaaccacgctgggagattagataatgaagcgtgcgcctgtgcttccaaaacatacgctcaatactcaaccgggtgaagatacttcgttatcgacaccagctgccccgatggtggattcgttaattgcgcgcgtatgagtaatggctcgcgggaatgccattactttgcctgtctgtggtcgggatgtgaagtttactcttgaagtgctccggggtgatagtgttgagaanannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacttggctggaaagacacaacgagctgggtctctatagaaaaccctctcatgacgggctcagaatatctacactgctgaataatgaagctcaggcagggaatttacttggctcccaaggatggagatccctgaacacctgagactgaggcaggagatcaacaggactcacctttctgagcaactatcacagccctgctgatgaaaacaagatgtagcaaagaaaccagcccaaaccagctaggactaggaattctattgtatactcttgagtcacccccaccagggccatgacagtttacaaatgccctggcaatgacccggaagttaccatatgggtccgggactcctgggtcttttccagaaaatcgtgaatagcccaccccttaattggcatataattaagagtaggtctaaataaagctagccatcatgccactggtgctacacgcctctgggacagccctgctctgtctgtggaacagcccttttggcagacactgtggtgcacacaaacttgccggctttcaccattggctggctcttgtgtcctgagcaaatccaaggaccgccctggcctaaagtgcaattttggagttcgcctgcgtcaagaccattagatcatgccctggacgctgaaccgaggaacctccttactcctttcccaaatactaccacacccaca

SEQ ID NO: 699 - DNA, 74516 bp, Homo sapiens
  misc_feature (1)...(74516): n = A,T,C or G
gcacactgtgcataacccccangttatctggtanagnatccaccacagctgcagtaagccatgatcgcgccacagcactccagcctgggtgacaaagtgagaacatagctcaaaaaataaaaaaataaatttgcacctgaggcaagtgtcacactcatcccaactcagtctcaccttgcatgttttctgccttgctggctgtatgaccctggacaagttacttaaccgctcagagcctcgatttcctcctctataaaatggggataatctctgtaactgctcacagttggtagcagaatgcaatgaagtgaattcgccctcacagagccagcactgttcttggcacatggtaatcttaacatattttttcctacagggaggcctggtgtcaggccgggagtggggtggaagggtcccaaaatggatggaagggccccaaaatggccgtgagcatcctctgcccttgagaagagctagcccagctgtctagagctccctgctgctgccgctctcgtaagcagcaagcatttttggctctcctgtctcagcatgatgcccctacaaggttctttcgggggtgggacccaacgctgctctcctgatggcctccctggctcccagcaccttccatcccagctgctcagggcccctcacctgcgcctcccccaccctcccctctgcccactcccatcgcaggccatagctccctgtccctctccgctgccatgaggcctgcactntgcagggctgagtncaaagntcagtcccttcgctagcacacngataatatgaaccttgnagaattcccagctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacaaactgggcntaaaaccccggctaaccggtggnagnaaacaacgcgtcacctatgactcatctcaggcaacgctgggaagactattgtcattctaccctagtgctaggcctctgggacaggatctgagcagagacgctcatgaaaatcgggacttgtgatcactggcacaacctccacccccatcccccagcaggggccttggtgaaatttgagattcatttccaactcctcctgtgggaaggaggtgtggaccttgatgtcagcatttcttagggaatggctggacctcagaggcagcatctgagacactggcttaaggggacagccacggggcagtgattcctcccaaatactcaccagccatttgtttgtttgtttggagaccgagtctcactttgtcgcccaggctggagtacagtggtgtaatcatagctcactgaagtcttcacctcctgggctcaagtgatccttctacctcagccttcccatagatgggactgcagcgtgtgccactatgcctggctaattaaaaaaaaaaaatacttatcatggcaccggctaatatttttattttttgtagagacagcgtctggctctgttgcccaggctggaatgcagtggcatgattatagctcactccagccttgaattcctaggttcaagtgatcgtcctgtctcagtcttcaaagtagctgggactacatgagaactacaggtgtgcgccccatatctggnnttgtttngnnttgntctgtnttttgtagagacaggtcttgttatggtgccanactcgtctcacctnctgggctcagcgatctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactaacgtggcatagcaccccagcacacacgctagnagnaaaaaacccttttctgagatggagtctcgctctatcgcccaggctggagtgcagtggcgcgatctcggctcactgcaagctccacctcccgggttcacgccattctcctgcctcagcctcctgagtagctgggactacaggcgcccgccaccacgcccagctaattttttgcatttttagtagagacggggtttcaccgtgttagccaggatggtctcgatctcctgacctcgtgatccgcccgcctcggcctcccaaagtgctgggattacaggcgtgagccaccgcgcccagttgaaatgagggtattctctaagaggcagatgacagaacctactgcaatgaatttgtcaagctcaaggctaaggacacagtccctccacaaggcagccttcacttcaaatgccaggtgcaactggggattcctgggccaccctcacttctgaccgcttggctgcattgagggttcccactaccccctgtggttcaataattcactagaatgactcatggaactcaggaaagtgccccgcctcataacgacagtttttatgatagcaaacagacacagatcagaaccagccacaagaaaggacatannagggtgaggtgcggaagggggttcaagtgcaaagctcctagttaccttctctccagacagtcacctccccccagctatgatgcgtgatgacactcagagaatactgctaaccagagaaagctctgaggctnntgtgtnncancgttnttgggggggtntgnttntggtgnntgntgntgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccactgngggttgcntgacncctgcacgcctgggggtagnagaaaaaaactactaacagtacataatagtcaggaaactgtaggaaagtaatagcatctttattatcaaaggacgtcatgtgatcaggtttactccaagcaataaaaagtttccttttgcccccctgttttgcctagttttctggtgggctactctcctaccatagcatagaaaatgcacactgcaattggttatcaacagcctctggtcaatttagcaatcataatctgtgtatctcccacctctgtttgccttcagggacagaaaaagtgcctcctttccaggaggtagacaggctgttccagtccccatctttgtgtccttcataatgcccagcacagcccacattgtaggtggtgggaaaattcttgtttaaaataaaaaaaagaatgaaaaatgcaatgtcttagtccatctgggctgctaaaacaaaataccatacactggatggctcatgaacataaccatttatttcttacagctctggaggctgggaagtccaagtcaagacactggcagatttggtgtctggtgaggacctcttcctgattcacagatggcagcttctcactaagtcttcacatggtagaagaggcaaaggtgtctctaggatcgcctctttttttttnttttttttttgagatggatctcgctctgtcacccagctaaagtgctntggatgatctcagctcctgcaccctctgctccgaggtgaagcgattctcctgcctagacttccgagtagctggacctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactctggtgcatacccccagtcacggggtgnagatcacctacccgggcgagtggcacgtttatttaacttttataaatcaagagaatgcggtggaaacttcttgcttgtccacaaatcattcagatggggtttgggcaggtagcgggaggctggggcaggccagaggcctgcgaagaggagacaggctccagcacccacgctctcacaccccacatctctgcttttcttgctctgctgagactctaatgacaaagccagatttcatcttaacctcaagcttctactttttaaaaaaattttgttttggagacagggtctcactgtcacccaggctggactgcagtggcattatacagctcactgcagccttgaactcctggactaaagggatcctcccacctcagcctcacaagcagcctcacaggcgctcactaccatgcccaactaatttttgtattcttttttttatagagacgaggtttcaccatgttgcctaggctggtctggaacttggctcaagtgatccacctgcctcggcctcccaaagtgctgggattacaggtgtgagccaccatccctggccatgagcttctacttcttttctttttcttttttttttttttttttgagatagggtcttgctccattgcttatgctagagtgcagtggcgcaatctcggctcactgcaacctgcacctcctgggttcaagcgattctcccacctcagcctcctgagtagctgggattacgggcgtgtgtcaacatgctcagctaatttttgttttttatagagatgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacatagcgttgcnaaaaccctcagcttctcgctngnagnaaaaacctgtgctggtcaaaactggtggaaataggtattctagggngtcgtttccaccgtctggcaaatagagatggttgagagagcaagaggaaaggtaaaatgcatttttttcttatacagacaaatagtctccatttgaaacacatccccgtagaggcgggaataggaacttcacgttgtgagtgtttgagatcatatgaatggtgcgcctcccatcaagacagtgcctttcaatcagtagaagaactttattatgacatatgttaaagtacttgaacaccctcgaacccattcttaagagaatacgcattctatttctggttctgatcgggattccccttttctttgtgtttttgttttggatctggaaagcaaagatgctgccagagctctgcagcagagggaccttagggcacatgcagatgtgtggacgagccagaagccagaagggcaaagttgtatctttttaagcaaccatggaagctcgaatttctgttttgaagctcagggtttgctagtaacactcctgattatttgccttcgactccgtatttaaagattctttttttgagacactgtcacccaggctacagtgcagcggcatgaccacagctcactgcagcctcgacctcctggcctcaagtgatccttccacctcagcctctcgagtagctgggaccacaggtggatgcgtaccatacctggctaattttttgtgctntttgtagagacaagttntcgtgatgttgcccangctggtcttgagctcctgngccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgactagcgtgcnaaaatccccgctcctcgggtanagataaaccccctacatgttgggtatttgatgagggaaaacagacaccgttgcagtgattatgtaagataaaggatgtatagcacctgtcacctaggggggccccaattaatggtgggtcctcctctcttccttcccagctctgaggcccctccattgttctcattgtccacggaaacctacagatctgacatgtgctggaggctgagtgaacgcttctggccgcagaggaaccccaaaggactgctccaggtgctagtcatcttggggtgtgccacttaggaaaggtttccatggggaggagtcctgaagaaaaatttgccagatgggaggatgagagcaagcttcgagggtgttggctgagtcctcttctatccaccaacctgctcatccagcgtctagaaataggggcgttaaaaagtttgacttaagctaaggggtgggtgggctcaccccttggaatactcagcacttttgggaaggtttaagcttggncggatccacctttgaaggtcagggagtttaaagaacaagcccttggccacatatggggaaaaccccccctttttttataataaataannacaacaaaaaaatacttttggaaatgtggggaaaagttccccctttttttcccccccttttataaaaagaggttttagacgaaaaaaaaaaaaaaataggggggggggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactaacgcgtgcatgacannccggctacaacactgtagnagnaaacaccccccactttgggaggccgaggcgggtggatcccgaggtcaggagatcaagaccatcctggctaacacagtgaaaccccgtctctactaaaaatacaaataaattagccgggcgtggtgtcgggcgcctgtagtcccagctactcgggaggctgaggcaggaaaatggtgtgaaccccgggaggcaaagcttgcaatgagccaagattgcaccactgcactccagcctgggtgacagagcaagactctgtcccaaagaaaaaaaaaagaagagaaaagaaaaagaaaaagaaaaaaaggaagctggcacagtggcatgcacttatagtcccagctactcaggaggctgaggcaggaagattgctcaagcctaagagttcaaagttgtaggatgctatgatcgcacctgtgaatagcaactgcactccagcctgggaaacataccgaaaccctatctcttaaaaaaaataccataagctgcataaggaatatgtacagtgtttcacgtgaatgcagcctaattcatttagtcagtttcctattcctgcaggttgtttctgtttttttccccactgtcataagcaatcattccatgaatatccttgtagctaaagatatatgcataatcctctcattgtttttttgggaaaaatacttaacaaaggaatctctgggggaaagagggttgacacttttttttttatgcttaaaaatcacataacaaaaaaaaacacagcctttttttgtccttggtggtgcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaacctggtctgaagctgcgcgatagggtgnaggaccatctaggcctgctggccctccctcggcctgtgacagagcccctcacccccacatgccccgggctcaggaggctgctctgctcccccaggtcttcacctcagacactgaggcctccagtgagtccgggcttcacacgccggcatctcaggccaccaccctccacgtccccagccaggaccctgccggcatccagcacctgcagccggcccaccggctcagcgccagccccacaggtgagaggccctggctccaccccctcccttactgtccctgcccccttccatgttggtcccaccccttctgttgctgtccntcnctgtggggctgtgcttgcngcgggcctntggctgctgtgngggggcnctcttntgcnngnttgggtgggggggnggtgttttgttctcttctcttttttggctnttttntttttcctttgtttttgttctngcttnnggtttnntttttttttttttcttcctcttctcttgctttttctnntcctttttcttttttgtccttttnntttggtntngtgggtcttttttgttggnntggggggtgccttngtgnngtctttttctttntctcgnncnttgttttttccttttctttttntcttttttttttgggtttttttttttttttntncccctctttttttcgtctttttttcttgnttgttttgtttgcgccnctcngnnncttccggctcctgtgtggggagggaggggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatactggttgcaaacatcccagctcacttgtggnagnatcccaacggcagatctgggttccaatgccaggtctgctgtgtgaccttgggcaattgacagtctgtctgacctcagtctctccattcataaagtgagcaaaagagccataggattgtagagagaatcgaattgggtgagcatccatggaaggggttgcttggtgtccagggtgcaggggggctgcgaggaatgggcttaggttcaagtattctcaattttctgggccaggctaagccaatatcaggagttctcggcaactggacagccttttacaggacctagagtcaccttccccttccctggccttgccgcagcccagaccaaaccagcactgtttcccgcccgccgttgtacctattgcactcctccactagcgtctctcgctcctccttgctagggttcttctgcctctcataggcctggaacaggatctgctgggatgctgggccccacttgaaacggttcctccgccccttcttggttggtagctcatcacctgtgggctcttcaatcagccctccctgccctgcatgggtgaactctgcaggcacagaaagccgtgaatggggtactggccactctcaccttcccacgtccattcccctgaccttgcccttgattctttctcattgccatggtgctgaaccagaggagcttacagctagaacttagaaatcatctaatctactgatgacaaacacacagcacacatgccatcactttcttaacctgtgttcaaggcaacatactaataatcctgaatgcttgctacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggttggggcaaaaaacgncgcgtctactgtnanagnaaaaacccacgatctctgctcactgcaacttctgcctccagggttcaagtgattctcctgcctcagcctcccgagtagctggtattacaggtgctcaccaccacgcccagctaattttgtattttgagtagagacagggtttcaccgtgttggccaggctgatctcaaactcctgacctcaagtgatccgtccacttcagcttcccaaagtgctgggtttacaggtgtgagccaccctgcctggccctctttcttctttcttttcttttctttccttctttttgagacagaatctcactctgtcacccgggttggagtgcagtggcgcaatcttggctcactgcaacctctacctcctgggttcaggtgattctcccatctgggcctcccacgggactacagacgcgcaccaccacacctggctaatatttttttttctgagacggagtttcactataatttcccagcctcaggtattcctttggcaacatctatggcctaagagaggtagggtgagggtggaatggtggatagnggtggtctcttctccaggcctcctttaaatggacaccttgccctctagtgtacctcaccctctntcccaccagcataaacatcttttttttaatntaagagatgacgtattgctatgctgtttgggctggtctttgacttctggcctaagcaatcctctacctacctcccatgtgctggattacaggatgagaacaagccagccattacatgcccagtaataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactctgtgcaaaaccccangttttttggtanagnatccacaccatctgtgtatctcccacctctgtttgccttcaggacagaaaagtgcctcctttccaggaggtagacaggctgttccagtccccatctttgtgtccttcataatgcccagcacagcccacattgtaggtggtgggaaaattcttgtttaaaataaaaaaaagaatgaaaaatgcaatgtcttagtccatctgggctgctaaaacaaaataccatacactggatggctcatgaacaataaccatttatttcttacagctctggaggctgggaagtccaagtcaagacactggcagatttggtgtctggtgaggacctcttcctgattcacagatggcagcttctcactaagtcttcacatggtagaagaggcaaaggtgtctctaggatcgctnctttttttttttttttttttttttgaaatggagtctcgctctgtcacccaggctagagtgcattggcatgatctcagctccctgcaacctctgcctccgaggttcaagcgattctcctgcctcagcctcccgagtagctgggactacaggcacctaccactgtgcccagctaattttttttttatttttaatagagacggggtttcaccatcttggccaggctagtctcgaatcctgaccttgtgatccacctgtcttggctccccagtgctgggattacagttgtgagccacctgcctggctctggggtctctttttgaagcattgatccantcatgagggctccgacccattatgtattgaaagattctcgtggggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatcttgggcaaaaccctccgtttctttgtanagnatccactcgttttcagagtatcttgtcttctctggtaattctagcagttttgtgtaagtttgtttcatggatttgcttcctgacaacatagggtgagttctctgagagtgagggtggtgtcttttttttttctttttttttttttttttttgaggcaaagtttccctcttgctgtccaggctggagtgcaatggcacgatctcagctcactgcagcccccagctcccgggttcaagcgattcacctgcctctgcctccggagtagcagggattataggcacctgccaccacgcccgcctaattttgtatttttttagtagagatgggttttttcctgtggcgggggcttggtcttgaactcctgacctcaagtgatccacctgtcttggcctcccaaagtgctgggattacaggcgtgaaccaccgcacctggccgagcgtcgtggtcatgtcttatttctgtgcctgtgttgtcccccagcccacatcccctaccccatccctgagaacagcactggcacanaatggctgattgagctgacttggctggaccccactcacgccaagaatgatcaggaacacagaactgattctccagttaattttgggaaaaagaaagggaaagaggacaagaatttggagggtagaaacccaaggctcntgagagccaaagaatttgtccaaattcaccgagcccatggggtggtgcagctggcccttaacggtgactctaaagtctgttctcatcacacagactgatgagaaatctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacacttgtngcataaactctcagcttttttggtgnagnaaacactccctaattaagtagctactaaaataattaatttcaaaaatttggagcaaacctagaaagatgcagatgtctttgtggcttttcacgcaatcaagtttacctatctttgcttttaatatgtatttcctcttgatgaaatgtttatttagtttagtaaacttgggatatgtcatttatatccataaatcaactttttaaaaaagagataataagaatgtgtattgtctatgtgttcgtgtgtaaaacaagatccacttttattttttattatttattttatgatttgagtttattttataaatgagtttatgcagaatcatagaggtatcaactacagtcaatcacccaacatacttacctttccaaaggtaaatatactcaagtacaatcatttttttctcatccaaagagtagcccatattgaataaagatagggacatgaaatgaatcggtagacactattaaccaagaatatacagatttattcacaccaagaaacaagtaagtcatatggatatatatataaagataaatttaaaaataataaggtgataattgtacaagtttgcatatagagctgcagctctgaaaaactgtttatattggttttgatatattgtgtggacttgttcccctaacccatcacccggagttgatgctaagatactgttggttccatgactcggaagcatactaaagttagaggcacttacatttgttaggaataaataagcgagatgatattcttcaccacttttagcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatctggtgnaaaccgcggtttggttanaggaaccccggtggaggagacgtgtatcaggctagtgcgtgtagaccaaaggccagaggcgcccactcaagcatttccacctacatgagaatcccatagtctttttagaagaatagaaatagtaagccctgagtcacgactgcatttgaatgccaccttacctgaagtctgaatcagggataatttgatttcagaagaataaaatgaggctcctaacacctgtcccaaattgcaaggaaatgagggtattctcttttttttttttttttctgagatggagtctcgctctatcgcccaggctggagtgcagtggcgcgatctcggctcactgcaagctccacctcccgggttcacgccattctcctgcctcagcctcctgagtagctgggactacaggcgcccgccaccacgcccagctaattttttgcatttttagtagagacggggtttcaccgtgttagccaggatggtctcgatctcctgacctcgtgatccgcccgcctcggcctcccaaagtgctgggattacaggcgtgagccaccgcgcccagttgaaatgagggtattctctaagaggcagatgacagaacctactgcaatgaatttgtcaagctcaaggctaaggacacagtccctccacaaggcagccttcacttcaaatgccaggtgcaactgggngattcctgggccaccctcacttctgaccgcttggctgcattggagggtnntccactaccccctgtggntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccacttgtgcataaccccggtttttgtagagaccaccctcattttctgcccatttatccttccagtccattcactcctggaacataaggacattttgggttgcaagtgacagacaccccattcaaaatagtttatgcaaaaataagtagaatgggctggctgcggtggctcatacctacaatcccagcactttgggaggccaaggcaggaaaatcacttgaggccaggagtttgagaccagcctgggcaacacagagatctcatatctacaaaaaatataaaagttaggtaggtgtggtaagcgcacatctatagtcctagccactcgggaggctgaggtaggaggatcacataagcccaggtatttgaggttacagtgagctatgattgtgccactacaccccagcctgggtgaaagagtgagaccctgactctaaaaatacaaatacaaattcaaaataaatagcatataatggcccataagagtccaggggaagctaacattaggtacaactggaccgtgttagtcagggttctccatggaaacagaaccagtagggtatatgtgtagataaagaagaggggatttattaggggaattgactgcanttagtctggtctcacactgctataaagaaacacctgagactgggtaatttacgaagaaaagaggtttaattggctcacacttctgcagcctgtacaggaagcattgcaacttccgcttctggggaagcctcangaaactnacatcatggctggagcangagcagaagaagaaggggggaggtccttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaacttgttgcnatgacctcgcagtttttttgtagnagnatccccgccactagatatccctttcttggttctttttctgtttttgtttttgtttttaagagatgaggtctcggccgggcatgtaatcccagcactttgggaggccaaaggggatggaccacttgaggtcaggagtttgagaccaccctggccaatatggcaaaactccttctctactaaaaatacaaaaattagctgagcatggtggatcatccctccagctactcgggaggctgaggcaggaaaatggtgtgaaccccgggaggcaaagcttgcaatgagccaagattgcaccactgcactccagcctgggtgacagagcaagactctgtcccaaagaaaaaaaaaagaagagaaaagaaaaagaaaaagaaaaaaaggaagctggcacagtggcatgcacttatagtcccagctactcaggaggctgggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacatntaattgcgttgcgctcactgcccgctttccagtcgggaacnctgtcgtgccagctgcattaatgaatcggccacgcgcgggagaggcgttttgcgtttggcgccagggtggttttcttttcacagtgagacggcacagctgttgccttaccgctgcctgagaagtgcacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctacttgttgcatgacactcccagttccctctanaggaccccccgagagaagtgacttgcccggcatcacacagcttggtggcagagccaggactcaactgaactgtctccctctgtaatactgtttctgttccctgacggtacctcaccttcatcacactgtagtcatgatggaagagatgctcttcttccaagtgattatgtgctgaagacgaaagaccaggtctttaaagactgtccatccaggcccccacattacccacctccaggagcatggggcgtgtttagcattctgtgttgtgctctggagtacagtgacacagaccacaaggtactaggacacagatgcaatgtgtatgggtgatgacataacaccagcagtgcccccatggagctgtttcttacaccatggccctccactgggcccggagctaccaagtgtccactttgttcagttggccccttaaatatacaagcacgttttgtcttgttagttaagtcagaaacctcagagctaactttcactcatttctcacgccctgtagtcagtccatcagtgaatcctattgactccatctttttttttttttagacggagtcttgctctgtcaccaggctggagtgccagtggcgtgatcttggctcactgcaacctccgcctcctgggttcgagcgattctcctgcctcagcttctcaagtagctgggactccaggcgtgcaccacccacccactaattntttattttntgtagagatgggtttcacctgttaccangatgtctcgactctgacctctgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccactggtgcataaccccangttctctctagnaggatcccctgcagtaaatatttttaaattgtatttacattttttctttatttctttaacagatgcggctgtttatttattttttcatttttttctctattttattactgaaatatgttgtcctgcccatcccaccccacaataaaaatctcacccagccccccatttatttccctcatcccctcttccccacaccatcccagaacaagtcttccaggattccctgtccactggccattttggagtgtgtccattgggttgcaatatggaaaccaccagggcttttgtggagaaaatggagggggttgagggagtcccaggaggggcttatttgagggcattggccccttgctcataggcgagctggatctcttcatcatctgggcaggtggagacgggttcttcccatgcataagcattgctcaagtgctgacgcgttcccgggaaggcctcagggatgttaaatccccggtacttcttacacaccacctgtactatgtgtagctttggcaacaggttgcagtcagccagggtgagctcattgccattcagaaacttcctctgcgagatgccctcatcttcagcactggtttcatctacttcttttgggagggggggatgntaagtaattgtctaaaaccttcanggcttccaggagtcccttctgcagattatcattgagtngctggtttgaattcttgatgtangcagaanaattgggcaatatgtccagcccnagctgtgttnggactcaggggtcanagctgncagcttngnggtatctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatctggggcagaacccccggttctctgtggnaggatccccaccgcgctctgttaattttttgtatttttagtagagacagggtttcaccatttggccaggctgaactcgaactcctgacctctcaggtgatctgcccatctcagcctcccaaagtgctgggattacaggcatgagccaccacacccagcctgtgagccattttcttctataatctctctccatgaataggaaacttggccctgctttctatcaaggcattctccgccacctcataagacacatctgtgggtgcctactcacccattaggatgcatgagcaaacctgcaagttcaagggagttaacaccccatggagcaacccataaccaaggggaaggccagaaccagtggcccctcttctacctctcagatggacaattttttctttttttaaacagggtctcactcccttgcccaggctggagtacagtggagtgatcagggctcactgcagccttgacttcccacattcaggagatcctcctatctcagccctgtctgaggtagcaagaccccatctctacaaacaattttctgaaaataaccaggcatggtgcctgtagctctacctactcaggaggctgaggtggggaggatncacttgagtnctagggagttcgacaccagcttgggcaacatagtgagaccctgtctcacaacacaacaaaanacatttaaatagccagtgtgggggctgtgcctgtagtccagctctcagaggctgaggtgggagatcactagccanaggtcgaggtacatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctctgtgctagacccggttccttgtgnggatcccccggtctcgatctcctgacctcatgatccacccgcctcggcctcccaagtgctgggattacaggcgtgagccaccgcgcccggcccagagattctttttttatttttttgagacagagtctgacgcccaggctgaagtgcagtggcacgatcttggctcaccgcaacctctgcctccccagttcaagcgattctcctgcctcagcctcccgagcagcttggattacaggcgcccaccaccacgcctgactaattcttttgtatttttagtagagatggggtttcaccatattggccaggctggtctcaaactcctgacctcaagtgatccacccgtctcaacctcccaaagtgctgggattacagacatgagccatcgtgtccggccccatagcagagattcttaacttggggtccaggaagcccctgaaattgcatgcaaaatattagcattaacatgttttttagagggagggccccttgcattcatcattttctctggtgctcacaagacttcaaaatgttaagaaacactggggtaaatgaagaagcaagcacctccaggaaggaggtcccgcaccaccatgcacagagtgtctgcaatgcanaaccagagaggacctttgggatggtccactgtggttgagccccatactcaaagatggggacccttgatagatgccttgacgaagcaagcaganaggtcaccaggaagttctctgtccttcccatctatccgtttatggactaaaaatagtcacagattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcattggngcaaaaaccccgctcctcggtagnaggaaaactctcctntagtgagtcgtattagcggccgcaaatttattagagcaatataggcctacaatgtcaagacacgaccgatgcccttgagagccttcaacccagtcagctccttccggtgggcgcggggcatgactattggcgcgccggatcgatccttaattaagtctactagataacttcgtataatgtatactatacgaagttattatctatgtcgggtgcggagaaagaggtaatgaaatgtgccccgcttacgcagggcatccatttattactcaaccgtaaccgattttgccaggttacgcggctgcaggcatgcaagctttggcgcgccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacggnggcgaagaaagtgtccatattggccacgtttaaatcanaactggtgaaactcacccagggattggctgagacgaaaacatattctcaataaacctttanggaaatagccangtntttaccggtacacgccacatctgcgatatatgtgtagaactgcggaaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccttgggggngtaaaaccgcaggctctagggtttttgnaaaacctaaagcttcagccttcacaggctctctaacataaaaataaaccacatttctctagaggcacaaggccaggaagcatgtgtctggtgagtgcagatggagatgccactgtgcacagcagagaacaaggctctcagcaatgccctcgaggcagacgcagcaatgccctgggtgctttccctaacctcccttcctgtatgccaaaggtgccccccaagccctgttcaggaaaagcaacccggggagagggagtagagatgatgccacccaggcacctgttcttgaccccacacagtggttcaatggtggccatcaggggcatttggcaatgtctggagacatttttggatgtcacaactggtggggtgagtgctactatcatctagtaggtagaggccagggacgttggtaaacatcctataatgggaagaaggatagacccccacgacaaatgctagtcaaagatgtcagtagcgccaaggttgagagacactgacctaacactagggaccaaatgcagtatcatttacatttccttttttttttttgagatgggatctcactctgtcacccaggctggagtgcagtggcacgatctcagctcactgcaacctctgcatcctgggttcaaacgattctcctacctcagcctcccaagtagctgggataacaggtgcacgccaccatgcccagctaaattttgtcattttagtagagagtgggtctcacatgtgcgagggctggtgtctcaactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcacactttgtgtgcatgaccccccaggcttcttctgtanagnatccccgcatgtagtggagttaagattggtctggctgcttccatggtgaggacgaaccgcagagggcaagggcagatgcagggaaatgcattaggacacttcgcaggggtgcaggtgataagcagtgaggcccaagacaaggctggaagcagtgcaggtggagaagaggggttggattctaggtctattttggaagaagggtgggcagggcttcttgttgactataggtgaggggcaaggagaagacagggatgactcccagctctctggcttgtgtccttgagtaactgttggagccaccattcccaaggagagaaggaggagtgggtatggctgtggggagttcgaggggtgcattttggataatgatttggtagtacccaaggatgagaagcgagtgacctgctccatgtaaagacatatttgatttccctcagtatacacgtggtcactggtaccttggggaagaatgaatcacaccaaaatgaactaatgtagagacagagtctcgttccatctcccaggctggagagcagtggtgcaatcatagctcactgcagcctcgaaccccggctcaagcaatcctcccacctcagcatcccaaagtgctgagattgcaggcatgaactgctatgcctggccaagccccaaatttaagtgatgagcanaggaagagaaattangcgggtcctgctgggggtggcaaagaggtgggataaccagagtaaaaaaagtcaccacattgctgaatgctctgaaagttaagaatacgacctgaaagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacattggtgcnaaaaccccaggtcttgtgtggnaggataactctcgctctgttgcccaggctggagtgcagtggcacagtctctgctcattgcaaccttcatctcccaggttcaagtgattcttctgcctcagcctcccgagtagctgggactacaggcatgcgccaccacgcccggctaatttttgtatttttagtagagacgaagtttcaccacgttggtcaggttggtctcaaactcctgacatcaggtgatctgcccacctcggcctcccagagtgctgggattacaagtgtgagccactgcgcccggcctccagcattttttaagagaaaaaaatggaaataaccttcattgtctaaggataccgtacaatgttagggatagccattttgtttgtttgttgttgccatactgtgctatactattctcttttttgttttttggagaacaggatctccctctgtcccccangctggagtggtgcagtggtgccatcacagctcattgcagccttgacctgggctcagataagcctcctgcctcacctttctgtgtggctggaaccacaggcatgtgccaccacatcaagctaatttttttatggtttgtagagatgggatgcanggggtatcactctgttgctcaagcaatcctaccaactcggtctcccaaagtgctgggattacaggcgtgagccccacacacagcccacctcgtacattctgaaaggtggtgtgctgcttaaacctcctggtccaagccaccttctcaagaaaaaaaagggtctgtgagtcaacaagatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatcttgtgcatgaaccccaggttttttggtanagnatccacaccgacgggggtggggcccccttttggatggagcaatcagggagctgaaggagaaggaatcggccatgggaagatctggaaagaggttctgagcagcaggaagagcacgtgcaaaggccctggggtgggaattggcttggggtactgaggaacagcaaagccaaaatgactgcagcaaaggccgagaggaagagaaagacctgggaagagatccaggaatttggtggggtggagggaggggaacgaaaccaaggcagggagtttggactttattccttggccagggagggaaactgaggcagaaggagaggaacagactttcccaaggtcactcagggagctaagggggagatctgaagaaagagctcaggttcctgctgtggccaccaacatggggcaccccagggaggcctgggacccaggacccaccccggcttcttcccagacactgacttctcccgggagacagcttctactagacattctgcctctgtaccgtcttcccagcctcaacctccccaatggcccaggccttcaataggggtcccccgcccctctctccctggctcctttcctgaccctgacgctggaggccccacttttttcactcanggcgttntccgatcccttttgttacctgaacataagtacccangtagttagttataactctgangacaaggagctggttgatattatagcaacatctcaatttatggaagtaatagctgctgtagcattagaaacccatcgggcagcgggagcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaccttggtgtgcnagaccccgcaggtttttgtgtnagnagnatcccccgggcaacctttctgtcagcatcctcaacgtaatcaccccttgcaccttcctgagagaagagaaagaaaagggagagaaagagagaaagagagagactcatcatggaaacagacatatagaaacctatgccagatgcctatagcattgcaaagtgccaagagaggaagaaccaaaggtactgcatttaaaacaaagaattactaaatattgaaggaaaatgaatgatattgaaaaagaagaacctaccttgtagcctagtggttaggaaaaataaaaataaaaaaagaaaaagaaaagaagaaccaagatgaataaacacaataactgatcaacaatgaaacaaaacttttcatttcagataaaatgctaattgcttaaaaaaattaagtggatattaaatcaataaagctaaggtagagttccatgaagaaaagccaatcactaaagaagaaagacttatgattttaaaagatgattataagaagaaagcaattaatagaagggctgagtaactgaaagtatgtggacgcagaataaattagtgatttagaaattaaggtgttttttttttttgtaatgtgaaggcagaaagaaatagaaatatgggactgacttaaaagaatggaggatatgcccaggggacnatactcacttaagagaagtaaagagaatatacgatgggaaagacaggtcgaagaatatannagagtttcctgtagcagattcctncgactntannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaactggttgcagaactccagctcctcttctanagnatccccccacctaattaagtagctactaaaataattaatttcaaaatttggagcaaacctagaaagatgcagatgtctttgtggcttttcacgcaatcaagtttacctatctttgcttttaatatgtatttcctcttgatgaaatgtttatttagtttagtaaacttgggatatgtcatttatatccataaatcaactttttaaaaaagagataataagaatgtgtattgtctatgtgttcgtgtgtaaaacaagatccacttttattttttattatttattttatgatttgagtttattttataaatgagtttatgcagaatcatagaggtatcaactacagtcaatcacccaacatacttacctttccaaaggtaaatatactcaagtacaatcatttttttctcatccaaagagtagcccatattgaataaagatagggacatgaaatgaatcggtagacactattaaccaagaatatacagatttattcacaccaagaaacaagtaagtcatatggatatatatataaagataaatttaaaaataataaggtgataattgtacaagtttgcatatagagctgcagctctgaaaaactgtttatattgttttgatatattgtgtgacttgttcccctaacccatcacccgagttgatgctaagatactgttggttccatgacnntcgaagcatctaaggttagaggcacttacatttgttaggaataaataaggcagatgatanttttcaccacttttagcacagcagacttngtcagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacatctggttgctgaactcccagtcctttctagnagatccccccctaacatggtgaaccccatctctactaaacatacaaaaattagccaggtgtggtggcgggcgcctgtagtcccagctactcgggcggctgaggctggagaatggcgtgaacccgggaggcggagcttgcagtgagccgagatcgcaccactgcactccagcctgggtgacagagtgagactccgtctcaaaaaaaaaaaaaaaaaaaaaattagccgggcatggtggcgtgtgcctgtaatcccagctactcaggaggctgcggcacaagaattgcttgaacccgggaggcagaggttgcagtgagtcgagatcatgccactgcactccagcctgggagagagagcaagactccatctcaaaataaaaggaaagtaaaaagaaagaaagaaatctctggaaacacaaggtgngggggtacctagaaaaagggatggtctagaattaatgtggtctcctatgtcccacagtggcagcagctgtttctggcaaaatccttagcgctggttgcagccattcagctccccttggtttctgccaatttcctgatcctatttctcttgccaattctctaagcttccagatatccttctaacaaatttctttctggctaagttacccagaattagattccatttttggcaactgaagccctaatgagtnagaccttcaagtggtcctgtgatagaatgatnagccacacgtctttctttaatgtgtatgccttttgggtgngcatgtctgtgaatctctgcttcaccttcttcccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctactgtgttgcatgaacctccagttcttttctagnaggatccccacgcatgagacaccacacctggcctaggtcttctaagttatttcagaattcccctctcccagcctctgtccttgcaacggatccatcccccatgctgggtccctctttagtaaacgggaagcattttaaatctagcccaaagcctcaaagaacttcttaggagtggttcagatgttcccagccccaggctctaccccttcttgcctattagaggccacaccttcagtgacactgtgagggcaactttgaataccagaatgggatattacaatcacaaagccagacttagatagttgaaagtgcccaccacctctgttcctgagagttgggcctgagacagaggattctaagtggaaaccacgcttaactaagaggacccaagaaaggcaagctctttttaaaaaatttttttttcattttttgtctcactctgtcacccaggctggagtgcaatggcacaatcatggctcactgcagccttaacctcctgggctcaagccatcttcccacctcagcctcccaagtagctgggactacaggcacatgccaccatgcctggctaatttttatatttgttgtagagaagttttcaccatgttgcccaggctaagtcaaagtcttcttttttttattntttattatttatttattattattattttttgagatgcagtctcgctctgtcgcccagctgaagtccatctctgctactgcnactcacttnccgggttctcacctcctacagctggactgccgtgccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatcttgtgcatgaccccacgttctttgtggnagnatcccctcgcaatacaggcgtgagccactgctcccagcataattaatttaaatttaaatagccacatgtggttcttggataccatgttgggtgatacaggtcttgctgtacatttatggagcgatatgcaagaagcttgtaactgtggttgtctctggaaaaggagtttcgggctttaagaggagtggagttttacattttacttacatcctttgaagtgtttaccgggtatttaatttttttgaatcaatgaaaaaagtaataatactcagcaaagaccatgatgtatgatggagaccaagggctcctttgggacctgggtgaacagcctaacctgggtgcctctggcttcattcctaaccccaaagcatcagatctcagcagaggtgacactcacccatgtcatcctccacagagcgtctccacagggaaggggacgatgctgaactacagctctgacctggacctgattctcttcctgagctgcttctccagcgtccaagaccaggcacagctgcgagacagtatcatcagcttcattgaagagaattggttcactgtagcaagagcctggcctacaatatcactgtggtccggcacaggaggggacagggcccctgctccctgccctccagtccagccagaagacagcggagcatttggatggtagctcccgcttcgatgctctggtaaagacgcgacgggtcggtcagagaactgtcaggccgcttgccacctgcctcggaggctgagaagtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcacatcttgtgtgcatgaaccctccggttctcttgtgtanagnatcccctcctgtatttttaatagaagcggggtttcactatgttggccaggctggtcttgaactcctggtctcaagtgatccgcctgcctcagcctcccaaagcactgggattacaggcatgagccactgtgctcggcctcctgtttttttttgtttttgttttttgaaggcagtatcacccaaataaaaataactttatatttttttccagatataactaataaatgttcatgttacaaggttcagggctcatcctaacactttagaaggcctaggtggtaggatgacctgagtccaggagcttgagaccagcctgggcaacgtggtgagaccccatctctaaaattagaaaaattggaaaacaaaaaaaaagaaagaaagaaaaaaaaatcttcgagtgtagactcagaaatctgtgtttctaacccctgctccagggcattctgatgccgtagctctgctccagtgagtagggaaggccagccagtgaaggctcacattgctgtgggtggcagaagaggacagcaggagattctgaccaggtagatcttgaagacagcagcagcttgacaatgggaggtttccaggtagagggagcagcttgccaaaggacagaggtgagaaagttaggggtatgttctggagagganatagagtgggtgaggtctgggtatggaggggctgtgcangatgagggctggaagatcanatcgaggaggctntgagtgctggctaaacatcaaatgtactcttgcctctgcattatttgcaaatagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcacttgtgnntaaaccgcgngtttttgtgtanaggacacccctccactgtcctagctcagaactaagaggccaaggctgggcgtggtggctcatgcctgtaatccccacactttgggaggccgaggcgggtggatcacatgaggtcaggagttagagaccaccctggccaacacagtgaaaccctgtctctactaaaaatacaaaaattagctgggtgtggtgtcgtatgcctgtggtcccagctactcaggaggctgaggcaggaggatcacttgaacccgggaggcggaggttgcaatgagccaagactgcgccactgcactccacccccagcaacagagtgagactccatctcaaaaaaaaaaaaagaaagaaagaaaaaggaaagaactaagaggacaagtctccaggcatctcctgctttgactctaatgggtttgagagtcaaaccaatgtgggttcaaatcccaccactgtgacctagccacgcgtgctcttgcatgacccacatctgccctgtaacgtggggtaaatccacccctacctcacactgctactgggaaaattaaatgagcttcaaatagggaggatgaacttagggcaatgcctggtgcacagtaagtgctgaatttgtggaataatattgtcatcatcatcatcttaacaatgcagccctggagacccttggcccacacagcagagcccaggagaagtgaagacccgcccacatcttccttctctctctnctaccctttncagggtcaanntcgatgtncaaggctntgagcctcttgcctctggcnctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgactacttgttgcnaagaccccccaggcttttttgtggnagnatcccctccaacatgatcaacttatagacagtctggtttcaattctacccccatccctagattccctactgagatatttggaagtgaatctggacatcatgtcattccgctggatatattttgactccaaggctgacaggtcttgctaatgggtagagtatgatgagagagaaagatcagagtcaaggtctaagtccggggcttttggccttagcaacagaaaggttgaactgcccttaactgaggtgggataggctgggcatggagatgaggaaggaactcagttttggaactgaagtttggggtgtctgtcagagacccaggtggagatatgtgngtggggagttggatatgcgagtctgtattacagggaggaggtctggacttgagataaaatgtgggggtcaccggcatagggatgtttaaagccatgacactgaatgagatcaccaagggagtgatgacacagcaggaagagaaaaagacccaggactgagccccagagcacttaatatntattcggagtttagggagttgcacgagtccagcaaagaagaaggaaaagaagtagctagtgaggtggaagagaaatcangagtgatggtttgaaggccaagtgaagatattgttttaagaaagaagaaatgggatgggcatggtggctcacacctgaaatcccacactttgaaagtcaagatgggaggatcgcttgagcccangaattcaagatcagcctgngcancatggcaaaaacccatctctacaaaaaatacaaaaatagccggtatgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaacttcgttgcatgacccccggctctactgctggnggnatcaactcttagtagagacgggttttcaccatgttggccaggctggtctcgaactcctgacctcaagtgatccacccacttcggtctcccaaagtgctgggatgacaggcatgagccactgcgcccagccactgttcgctttttttctcagtggttctctagtccattgccttaaccactcaccatgactacagctcttatttgcagtgactctcaagaatgcaaatgcaaatgccattcctgacctcgagttaattcagctttgtcccctgagcatgggggaaaggcaggctgggggctggaactttctgcttgtgtacctatctctttagactctggaggctcctccccaatctctgtcattccctctccaaccaaatccacctgccgtcccagactcaaatgctcagccacctaactgcctgaggacccagcagttaatgagtttacatgctgggggcaggagtcagggccaaccctccttggttcctctggctccctggaaagggaaagtcaccaagaggcagctgcaggccgcaaagagaataagcaggagaacctcaaagccacaaagggacagcacacagcatcttccctgtttagcctggacttgagaatgctgtccccagcagtaagctgctcaacctcaaagcaacttgcacgggggtttacaaaaaaatgcacttgggcgggcacgggggctcacgcctattattacaacaaattgggaggccggagtgggtgggtctttttttggcggagtttgagaccagcctgcaaacaatgtgaaacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgactgggtgcnaaacccncaggtcttctgtagagcacccccctgggccgggcgcggtggctcacgctgtaatcctagcactgtgggaggccaaggtgggcggatcatttgaggtcaggagtttgagaccagcctgaccaaaatggtgagacccccgtctctactaaaaatacaaaaaaaaaattagccgggcgtggtggcacatgtctgtagtcccagctactagggaggctgaggcaggagaatcgcttgaacccgtgaggcagaggttgtagtgagctgagattgcaccactgcactccagcctgggcaacagagcaagacccggccnnnnnaaaaaaaaaaaaaaaaaaaaaaaaaaaaccaaaaaaccccactctatgaatagtgagggtcaaagaggttagagtctggcacaggtagactaaaattcccagtctgttctcttgggctccagattctcactccaccacctgaacactagtgagtcccttccgttcccaagcctcaatttccttagacagatgtaagcagttgaattgactaacaactatccaaccccaacctactgggcaggttgcctcctttggggtcaaacctatccaccttcagttcccaacgtataaaggagactcttaaagtggagatcgaaactgatgacagattgactagacggccagctgttaaaggtgccccagatattcagcctcacccaaagtcctcctgtgccctactgancnagggttgtctcagaaggggaccctgagtcaccgtccaactgtttctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatttggngnaaaaccgcacgtcttggtgtanaggaaaaccccccctccctccccacactgtccacctctggaccattttgcactttatatttgctgagaaaggaggcagaggggaagaaggggttcaaaggtgtcagcctggctcctggtgaccagctctgtttagcaggaagttagctggaacaactgattgagccctgggataatctatgctgtcactgtggacacagcggagcagagggcacacacagtggagggcacacacagcggaggacagacacagtggagggcacacacagtggagggcacacacagcggagggcacacacagtggagggcacacacagcggaaggcacacacagtggagttacctctgatccccatgccctacggggctgccaccttcctgccagggtttggatcatcacagtcatttgcatcttcactccacagcgtgagtgcacatacacatctgttttattgcatttggcccttataggaatgagtgggatatggggaaatgaaaaggctgagactgcgataaaaaatgtagctcttatgccaggtgcggtggcacatgcctgtaatcctagcactttgggaggccgaggtggacagatcacctgagttcaggagtttgagaccagcctggcgaacatggtgaaaccncatctctactcaaaatacaaaaattagccaggcgtnggtggtggggtgcctgtagtcccagctactcangaggctgaggcaagagaatcccttgactctggggtcagaggttgcagatggattgcccgctgcctccagctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactcttgtgcataacctccggttcttttctaggagatcccctcccattttctcaggttcacggatttcttcatcaaccacgtgcagtccactgacgggtccatcaaaggccttctccgtttctgttacggcattttttatttctagcattcccttttgattcttagagttttcacttctctacttacatcccattggttcttgaatctcatccactttttccattagagcctttagcatattaatcatagttatcagtctgataatcatcaaatctctgtatattgcagtctggctctgatgcatgctctgtctcttcatactgtggtttttgccctttaatatgctttgaacattttaggatgaagatgagagagttgttatgtttcaaagaaaataggtactggttgggcgcggtggctgacgcctataatcccagcactttgggaggccgaggtaggtggatcacctgaggtcaggagtttgagaccagcctggccgacacagtgaaaccccttctctactaaatatacaaaaaattagcgtgggcgtggtggcatgcacctgtaatctgagctacttaggaggctgaggcaggagaatggcttgaacccangagatggaggttgcagtgagccgaagtggtgccattgcactccagcctgggcaacaagagccaaactccgtttggaaaaaagagtcttctcgttatttatcagtttgggacangtgctgaggagcgccaacactgaaagatttactgctgtccaagtgtgtcccgactctaaatctagagctgtcgaagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaacttgttgncataacctccaggtcttttctagnagnatccccccaatagagatgcaaactgtggcccaaatagctttccctgggggatttttaacttttaaggagaaattggagaatttgagatgcagagtcaatatatgactgtagtattaggactctttcagtaacaggggacagaaccccaactcaaatggatttaaacagaaaagggaatgaattgactgaagcaatgtgaggagtccagggctgcttcaggcatggctagatcaaggggctcaaatgaggttcacacagcatttcttgactcttttcttttttgttggcttcattctcagacaggctctcctcatataggcaaagatgggttctggaagccctgggctgccatcctaccagcttagcaaccttggaaggaaaagagctcttcttttcagctactttcagttgaatgactctttttatacttgataatgtaaacttttatttattttattttttgagatgaggcttgccttgttgtgcccaaggctagttttgaacttccgggctcaagtgatccctgcctcagcctcttaagtagctggaatggcaggcacacatcacntgtgtctgctataacagaaacttttaaatgaagtctacataaaaagtgcccaaatccaaagcatacagttcaatgaattntcacanagtgaacacaccaatacagataaaaaatagaatattaccagctccagcctggtggtggttgtaccccacctgtatccagcacatttgggaggcaaagtgnngaggataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccacttggtgcatgacctccggttctttctctanaggatccccctgttttttctttagacggagtttcactcttattgcccaggctggagtgtagtggcatgatctcagctcatagcaacctccagctccttggttcaagtgattctcctgcctcagcctcccgagtagctgggagtacaggcgcccgccaccacatccggctaattttttgtgtttttagtagagacggggttccaccatgttggccaggctggtctcaaactcctgacctcaggtgatccacccacctcagcctcccaaagtgctgagattacaagcatgagccaccacgcccagccttcccagctgatattgaaccaactgccagacacgtgggtggagctggtgtagatctcctgtggcaggtgagccagatcagaccaggaaaactgctcagccaagtcacagaatcattgaacagaaaaatggatgttgtggagtgattcactatgcccagaaccaagccgggtccggctgcattttctcgaggcccaataacgagaagcagagaaactagaaaagaagggaatttattgctgtaacaagatacagggagataattccaccagaccaactcanagtgttaccattttcttagtgctatataggtngaggttatgtgcctatgtgccgtatggcattcgcctaagtctattggtaaactaattttgntcaactagaaggtcagaggccaaaaaaaaaaaaaaagacttgctaagttcattaagctgtgagaccccggtaccttttgtttttgagatagagtctgctctttgccaggctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcacaactggtgtgcatgaacccccaggtaccacttctanagnatccccctcatttttgcattttttggtagagataggttttgccatgttggccaggctggtctcaaactcctgacctcaagtgatctgcccgccttggcctcccaaagtgctgggaatacaggcgtgagccactgcacccagccaaggcttatatttcttctggaaagaatcagctagaggcctgaccctcgccagcattttccaggtgctctccagccacctggggctctcaggccctggagtgtagcctctggaggtggtgagaacacagactctggagtctgaccaacctcacttcacatatctgccctgctccttactacctatgtgattggtgttcagtaaattacctaaccctgctcagtttcctcatcaataacatgggggtaacagtagaaccaaccaactaatagagatgctctgagaataaaatgcattaagggtatggaaggtgctcagcatacagcctggaaagtgcttaccactccctaaacatttgctgctgccgctgctgctgctactattgtaaagataaggacagatgaagggaacatttgcacatcagacaaanaagtgtggacttaacacctctccttctccctctcccttccagagggcacgagaacatccacttgacagtggagcagnaggggttacccagatttcaacctcatcgtgaacccttatgagcccataggaaggttaaagagaaaatnncgagaccangngctactctggctngcagcgtctgtctcttcangntnctngcagtgagaagcagcttctagncagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcaacttgtggcatgaccctccagttctttgctgnaggatcccctccttgagggatcagttcttctataatgagctgattctggaccaggaagtcagggtgctgaagatggcaaaggtgagcactcaggaacccccggggttcaaatcccagctctgccctgtgggactgtggggctgtgggataggtaagggatgagttattttgtctctctgagcatcggtctcttcctctctaaaaccggtttctaatgaacaataaatgggataaagcatagaaaagtgctcttaagcagtaaactattctacaaatctggatgatgatgatgatgatgatgatgatgatgatgatgatgatgatttgggatccagctctctaagtgccagggaatcaagtggactatgggtagcaggtttgtataaaatttatgccttttggccaggcacagtggctcacacctgtaatcccagcactttgggacgctgagtggggaggatcacttgaacccaggagttcaaggccagcctgggcaacattgcaagacctcatctcaattatttaaaattttaaacttttttatatattatttaaaaaaaatttttaaagaaattaaaataaaatttatgccttttgtttcctctttaaccagccccacttaacccctaaagtcatcaagatcatctatattttccttctaaaatggcactgactggccgggcgcggtggctcacgcctgtaatctcggtactttgggaggccaaggcangcgnngacacgagtcaggagatcgagacatnctggctaacatggtgaaacccgtctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgggtgcataacctccagtctttttgtngnagnatccccccatctgatgctttggggttaggaatgaagccagaggcacccaggttaggctgttcacccaggtcccaaaggagcccttggtctccatcatacatcatggtctttgctgagtattattacttttttcattgattcaaaaaaattaaatacccggtaaacacttcaaaggatgtaagtaaaatgtaaaactccactcctcttaaagcccgaaactccttttccagagacaaccacagttacaagcttcttgcatatcgctccataaatgtacagcaagacctgtatcacccaacatggtatccaagaaccacatgtggctatttaaatttaaattaattatgctgggagcagtggctcacgcctgtattgccagcactttgggaggctgaggtgggaggattgcttgaggccaggagtttgaggctgcagtgagccatgatcaccccactggtactgcagcctgggtgacagagacactgtctccaatagataaataaataaatttaaatgaattaaaatgaaatgaaataaaacattcagtactttggtcctactgacctcatttgacgtgctcaagggctgcccagaaatagtggctattgtattggacggtgaatgtatagaaccttcccacaggggtgcggtggcgtcacacctgtatcccacacttcnggaggccaagcgggaagggtgctntgagccaagagttcgagatcagctggcacaggcaaaacctgtgtaacaaaaatagncggggtgcgctgctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaactggtgcataaccccagctcttctggtgnggatcaacgncatatatctgattaggaaatcattgttgattttgttaggtgtaacagtagttttgtggttataaaaaggttgtcttttgtttggacacgaacactgaagtattttagggacaaagttccttggtgcctataatttactttaacgtggcttagattaagcacatgtagccaggaatttagacttgttgaatcaactagttgggtatatgagtgttagttgtatcatctatttttctatgtgttttaactttttgataataaaatgactttttttttttttagagacagggtctcgctctgtcacccaggctggagtgcagtggcacaatcaccactcactgtagcctcaatctccctgagctcaggtgatcctcagcctcctaaatagcttgggattacaggcatgcaccaccatgctcagctaatttttgtattttttgtagagatagggtttcaccaatgttgcccatgctggtctcgaactcctgggatcaagaatatgcccaccttggcctcccaaagtgctgggattacaggtgtgagccaccatgtctggccggccaaaaaatgatttttgtttttgttttttttttttgagacagagtcttgctctgtaccaggctggagtgcagtggcacgatctcagctcactgcaacctctgcctcccaggttcaagcaattcccctgcctcagcctcccaagtagctgggacgacagcgcccaccacacgcccggctattttntgatttagtagagaagggttcaccgtgttgctaggatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgtggggtgcaaaaaaccgccggctcttagggtagnagnaaaaccccccactttaagacctagtctaaaggtcatattctaaaggtcatatttgcaatgtgaggcttcctgatacctctgccttcctgaggaagaacaggttactccccagtcgacagtcagctcagcaccctgaaatgctttgtgtaatactctgcactggaccaggcaccccaaaaatgcatgataaatagtggccattattgttgttgttgtggctgctgttgtcccattctaatacatgactcgctggatcataatgagcttttctcccactttcccacttaaccatgggctctgagaaagcagggacccaggccgggtatggtggctcacgcctgtaatcccagcactttgggaggctgaggcgggtggatcacctgaggtcaggagttcgagaccagcctggccaacatggtgaaacccccgtctctactaaaactacaaaaaattagccaggcatggtggtgggcacctgtgatcccagctattccggaggctgaggcaggagaattgcttgaacctgggaggaggaggtcacagtgagctgaggtcgcaccactgaactccagcctgggcaataagagcaaaactctatctaaaaaaagaaaaagaaagcagggacccatttcattcatctnttggatgttcangaccaagtctactccccgtccacagagtgcctggcgcagaatangtaataaatgcangttgaatccnactgacttcttncatctacctgtctgtgtatggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacatcttgtgggcatgaacccccaggctttctctgtggnagnatccacacctcagttcggcccagctggaggtattcacatcatggnaaacagaccatcagatgtggtgtgtgtgagttttattttgctttttcagagagccagctgttaaacactagccaacaccccattgatgctgttccttctacctgaaacacctcgcattgccggtgagctctaaagacaaaaggacctgggtctgcatttcccaaaggcaagactctggtatcacctgcatattattttcccatatttgagcaccactgccttttgcattatttacttagcagttttgctcctgtcaactcacttttttaaaactaaacttattttaaaaagaaaagttttggccgggagcggtggctcatgcctgtaatcccagcactttgggaggccgaggtgggcagatcacctgaggtcgggagttcgagaccagcctgaccaacatggagaaactccgtctctactaaaaatacaaaattagctgggcgtggtggcgcatgcctgtaatcctagctactcgggaggctgtggcaggagaattgcttgaacccaggaggcgggggttgcagtgagtcgagatcgccccattgtactccagcctggggaacaagaacgaaactccgtctcanaaaanaaaaaaaaaaaaaggaaaaagaaaagaaaggctttatataatntttaatactcaaaaaaacagtatccccgccaggcacagtggctcacacctgtaatcccanncatntgggaggccagcaggaagatcacttgaggctagggggtcaagaccactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcaacttgttgcagaacccccagctcctttgctanaggatcccttccccttctctacttacatcccattggttcttgaatctcatccactttttccatgagagcctttagcatattaatcatagttatcagtctgataatcatcaaatctctgtatattgcagtctggctctgatgcatgctctgtctcttcatactgtggtttttgccctttaatatgctttgaacattttaggatgaagatgagagagttgttatgtttcaaagaaaataggtactggttgggcgcggtggctgacgcctataatcccagcactttgggaggccgaggtaggtggatcacctgaggtcaggagtttgagaccagcctggccgacacagtgaaaccccttctctactaaatatacaaaaaattagctgggcgtggtggcatgcacctgtaatctgagctacttaggaggctgaggcaggagaatggcttgaacccaggagatggaggttgcagtgagccgaagtggtgccattgcactccagcctgggcaacaagagccaaactccgtttggaaaaaagagtcttctcgttatttatcagtttgggacaggtgctgaggagcggccaagcactgaaagaattttactggctgtcccaagtggtgtccccgagctctcaaaatctacgagctgtccgaaagcatttgggctntctaagtgggtttcacataatgactatgataaaccctgtggtatttatgcactaatacctgtgctgggctatgtgcccctgacccagctatattgtggatagtgtgtaggactctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgactgggtggtgcaaaacccgcagctcttgctgctanagnatacaccctggncaccgtgagctcccagccaatgtgagccattgctgttcatattaacaagggcaagagaggagaaactccacctttgtttacctgtccagcagggctcccagcttcttggctacgtgggctcggaattcaggggtggtctgaagctcgttgccatcttgttcatgctcattcaccttatgcctacgacacacacaaagagacctcacttcctgcccgctcagaagctgtccccatgagcacagggaccatgtgtgtcttgttcacctggaaatgccaggcgtgaagcctagcatctggcacacgcaggggatcagtatttgttgaataagtgaaacttgaacccaaagtgcatagtacctgaagctcggttgggaggttgacaactggctatttgcagcacctgtggaaaaatgaaaattagggcatttatagaggaaacaatgacagcaacacanaatgcgtgccaggcactattttcagcagcttaaaatacatataactcatatatatacatacacatgtaactcatatatattatatttatatataacttaaaatagttatatacccataacttcaaatagttacatataaatttagttatatatgtatataatatagntacatattttatgtaagtacattatatatatatatatncttaggtatataacttaaaaatatatataacttagtttatatatataacttaaatagtttatatataactagtttatatacataaactaaaaagtgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatactttgtgtgnataaccccgcaggcttttctgctagnagnaaacacctatacatatattatataatatatattatatattatacatatattatataatatatattatatattatacatattatataatatatattatatattatacatattatataatatatattatatattatacatatattatataatatatattatatattatacatatattatacataaattatataatatatattatatataatatatatatatatttttttgaaacagagtctcactgtcgcccaggctggagtgcaatgccatgatctcggctcactgcaacctctgcctcccaggttcaagtgattctcctgcctcaacctccttagtagctggaattacaggcgtgtgccaccacacctggctaatttttgtatttttagtagagatggggtttcaccatgttggccaggctggtcttgaattcctggcctcaagtgatctgcctgccttggcctcccgaagtgctgggattgcaggcatgagccagtaaactgggtccctttatattcacagctcatccataccagttctgcacctgctctgtgccaagctctgtgccaagctccatgccaggtgggcagcgaggagcaacagggtagagcttccagggtagcaagggagataacagtcaagtaaccagatgagtcaaggtaaactgagcagtgatacgggaatgncncgangtgctggagctgagagccanggaagactcngtttattgagtaccatggatgagctcgagcagaaggtcacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccactggttgcnaaaacgncggtcttctggtgnaggaaaacccaggcagcagccagccctgcctggaggacctgagcctgccgagcagccgggggccttcctggacaactgtgcctcgctccccactctgctctgatgcatcagaaagggagggctctgaggcgccccaacccgtggaggctgctcgggttgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctagatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccnaggaggccgaagctacagggaaggcaggcagggctctcctggcttcccatccccagcgattccctctcccaggccccatgacctccagctttcctgtatntgttcccaaggcatcatgcctctgaggccagcctggcctcctgcctctactgggaaggctacttcggggctgggaagtcgtccttactcctgtgggagcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatcatcttggntgcaaaacctccgcaggtttttcgtgtagnagnatcaccacacagcacatgtttcagagagccagggttgggggaaaggtcacagatcaacaggataagaatttttcttagtacagagcaaaacgaaaagtctcccatgtctacccctttctacacagacacagcaaccatccaatttctcaatcctctccccacctttccccgctttctattccacaaaactgccattgtcatcatggcccgttctcaatgagttgttgggtacacctcccagacggggtggtggccgggcagaggggctcctcacttcccagtaggggcggccgggcagaggtgcccctcacctcccggacggggcggctggccgggcgggaggctgaccccccccacctccctcccagacggggcggctggccgggcggggggctgacccccccacctccctcccagacggggcggctggccgggcggggggctgacccccccacctccttcccggacggggcggctggctgggcagaggggctcctcacttcccagtaggggcggccgggcagaggcgcccctcacctcccggatggggtggctggccgggcgggggggctgaccccccacctccctcccggacggggtggctgccngggtggggngggcctgacccccccacctncccctcacggagggggngtggctggccgggcagaagggggctcctcacttttccagtagggngccggcccgggcagaaggtgccccctcacctccccgacngggcggctggncgggcgggggggctgaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacatcgggtgcataacctccggctctttttctagnagataccctcttgtgatattaggcattgagacaatttttgtgcaagtttctgtcctttgggtaggttgaaaactggatgcagctttattccgtggtgctccagatatcacaaggagaaagtccctaagacccagaagtccaactgagctgttttgccagaatgcaaggagatgaattatggtaatgatcagggacggggctccacagttttcctacttttaaacagggaggcggtcacaattctgtggaattctaggggcctatagaaaacaggctgatatgagttagcaagagcccagtatcactggggagaccaggaggctaccagtgaatttcattcagctccaagaagagattcagagaaggaagtcttaaggtttcaaggaggaaggaccttgggctactgacccatttcttctacaccctggtttacttgcctttctatccagcccagaccccatggtcaagcctgccagtcactccctagtggatgccttcaattttctgcccatttatccttccagtccattcactcctggaactaaggacattttgggttgcaagtgacagacaccccattcaaaatagtttatgcaaaaataagtagaatgggctggctgcggtgngctcatacctacatcccagcactttggggaggccaaggcaggaaaatcacttgaggccaggagtntgagaaccagcctggcacacagagatctcatatctacanaaatataanagtanggtaggtgtggtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaactggcaaacccggttcttttagagatcccccacaggtttgagacagccccctgtgatcaaagcactgctatttctgcagccaaagataggatttccacaaggcagtttaaacactcataacctcataccaggttcaggctgggtttcgccaccaaatgagctctagtgccaatcttaaggaaatcttttggtttcagacctttttggaatttgggactgggttaagagatttggggcctgtgtatgtctgtgtgtacctggttgagagtgtatgcgtgtgtgtgtgttacatttttatctgagtcactgtgagaatatgtggtttatgtgcgttttcctagtgtctgtgtgtctcttgtagggtctatgtgtctcctgaggggtgnggtggaggtgctgtaggcaaaacatggggttatatttggaaaggtggcctggagatggaagtactgctgtcctctgccttgctctttgacaggggccacctgaacttactacacagcacctgagtttagtacagtagcacctgtgcttagtacatagcacctgtgtttagtatagtagcacctgtgcttagtacatagcgcctgcatttagtacagtagcacctgcgcttagtacgtagcacccgtgcttagtacagtagccctgcacctgcacctcccgttccctttcatacctgctgtctccaggtgacaagaggagctggagttggtttctggcctcctncanngctccctgcatcaagcgcagctgagcagttcccctgtatggggagagggtctgtccccttatctgacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatcgggcaaaacctccgtttttgtgnaggaccaccctgcccccgacccacccagcctaatttggcttcaggtccctcctgtcgactgaaaactgtgcccaccttgatcaccagtcgtttgtccttgagtacttttcaggtctgtatttcttaacttttcacaagcattcagcatatgtgggtgacttttttttaactctggttatgcccacctctttggccaccccagcaggtaccgcctaaatttctcttcctctgctcatcacttaaatttggggcttggccaggcatagcagttcatgcctgcaatctcagcactttgggatgctgaggtgggaggatagttccagccatccttctatggtgcacctaaatgtgaacggccagggggccgccaggcctacccactaacgagtctgtgaggatacaatcggccattcggataagactgactttcccaaggggacctgaacatgaacttcaaatagatggaaaaacaagccacagttatgacttttacgactgcacttctggcaggaggagcgcctcaagccttcgcgaaagaaaaacccaaaaagctccaaagaaacgtacggcgtctctcatttacacgctctgttatgctgcagatccctaaacagcggcaaaacgaaaaataccacgtgcctctattcgatcaatcaacgattataaatatggagtctgcaaaaggacttgatgtgtgggacagctgtcccttgaaacctttgacggaacactagctgaaaccacggctatcacgttggtgttgctttgggagaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatctgtgttgcagnacccccaggtttctttgtggnggnatccccccaactgttaaagtgagctgatacgaacgttccacttttaaacaattcctaggggagttgggcaaaaaatccacaacaaaaaagtgaattttaaatgccagttaggagtcagagaaccaagagggcatgtctttcccttttctgggagaagccacctgtgccacttttttctagaacctactgaatcgatgtctctctctccctaccccccactcccttgctatcactctctctcttctgtctctctgtgtgtctcttacacaaacacacacacacacacacacacacacacagagtcttcaagggcctgactatttttgagggcagattctccaactgtcctagctcagaactaagaggccaaggctgggcgtggtggctcatgcctgtaatccccacactttgggaggccgaggcgggtggatcacatgaggtcaggagttagagaccaccctggccaacacagtgaaaccctgtctctactaaaaatacaaaaattagctgggtgtggtgtcgtatgcctgtggtcccagctactcaggaggctgaggcaggaggatcacttgaacccgggaggcggaggttgcaatgagccaagactgcgccactgcactccacccccagcaacagagtgagactccatctcaaaaaaaaaaaaagaaagaaagaaaaaggagagaactaagaggacangtctcccggcatctcctgctttgactctaatgggtttgagagtcaaacaaatgtgggttcaaatccaccactgtgacctagccacgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcactttggtgnnnaaaaccctcgcctttttcggtnannagnanacacccattcgtcccttttccccaaaatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacgtcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttaatcattgctttgcgtttttttattaaatcttgcaatttactgcaaagcaacaacaaaatcgcanagtcatcaanaaaccgcaaagttgtttaaaataagaagcacactacannaggagantagaagacacatacctcagtcacttattatcactagcgctcgccgcagccgtgtaaccgagcatagcgagcgaactggcgagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaactggtgcataacctccgctctgnggtgnaggacacacccagtcactatcaggcctggaccttgaggatggttaacaaagcttttaatgcagaggcagaagttcttcagtgggagcacaaactagaattccctagagggcttgggaaacaaatccagctcactgggccccaccccgagtttctgattcagcaggtttgaggtgaggcttgaggatgtgccgttctaacaagttcccaggtgaggccaatgctgctggccctgggaccacactttgagatccaatgagcttagtcagtgctgctaattccatccccatttgccagtgattgactgggcctaagccagtggaccaacgagatgcaaggcggggcttactctgggctgatgagggtgagcagctcctccttctccccanaggagacaaaggtgcctgagtgagtggtggcagccactttgtgaccatgaggggaatcagccttcacanaanctgatgctgtagactgggaaaacctagactcctctttactttttccatcaatcccccccaacccaccccatttttttttttttttttttttttttttttnctccgggtttttttttttcttctctcccccccctctctccctctncttacacaaaaaaattttgggtgantccggttctctctcctcttctccctcccttcctattccnntttttttttctttcttgctttctttnttntctcctctccccctctttctttttttttttttgttcttnttnnttttttttttcncccccctctcgctctgggagagggagaggaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctagcgggcnaaacaccnccgctcttctgtggnagnanacactcctatgccccggggcacagcagactattttagagaatttgcgaaggaacacagtgacatctgttggacaccttgcaaactaccagctcaggatagttaaatttgaatgttagatggagggaacttcctttccacaatgacatgattttgtaaagctgagtgtatggcagttgtcatgattaaaagcaagtgccatgcagaagttattgtgtaacaggaaatgagattagatagcgtccaatctaatctcaaggtttgagtagctgtggacagcccaacaggcacaggcctcccgttagtacatccatacgagaagttaagaatgagtgaaaatagtttttttttttttaatttatgtgcattatttttttcaagcagctaccttgttaggacatacttaatagttatcttggcctacctactgcacttactaaacaactgttcactttttaatttttaattttcagatttttttgagacggattgttactctatcgcccaggctggangtgcagtggcgtgatctctgctcactgcaacctccgcctcccgggttcaagctattctcctgcctcagcctcctgagtatctgggactaccaggtgtgcgccaccacatccagctaatttttgtatttttagtagagatgggggttttaccatgttggccaggctgatctgaactcctgcctccagtgatcacctgcctncgtctccaagcgctggattacaggttgagctacatgtncggctgtncttttttttttttctttctttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatcttttngcataaccctccagttctttcgtanagatcccccctggtggctattactagacgcactcaagaatgtaatctaggctgggtgtggtggcttatgcctgtaatctcagcactttgggaggccaaggtgggcggatcacctgaggtcataagttcgagaccagcctggccaacacggtgaaaccctgtctctaataaaaatataaaaaaaaattagctgggcctggtggtgggcacctgtaatcccagctacttaggaggctgaggcaggagaattgcttgagcttgggaggcggaggttgcagggagccaagatcgcgccattgcactccagccttggtaacagagcgagactgcgtctcaaaaagaaaaaaagagaccaggcgcggtggctcacacctgtaatcccagcactttggaaggccgaggcaggtggattgcctgaggtctggagtttgagaccagcctggccaacatggtgaaaccctgtctgtactaaaaatacaaaaaatntagctgggcgtggtggcaggcgcctgtaatcccagctactagggaggctgaggcaggagaatcacttgaacccaggaggcagaggttgcagtgagctgagatcgtgccattgcactgcagcctgngcaacaagagtgaaactccatctcaaaaaaaaaaaaatgcaaaaaaaaaaaaaaccccanaaaacanacanacaancanaaaaaactagaagccgagcacagtggctcacaccctgtaatctcncacttttgaagggtgagagagggaggatcacttgagccccagagttcgagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacactgggctgaccccagtcctcttagaggaccccccgacgtaaaggttggaaaatgatctaaaataaaacacacatcataagaaagctatattaatatcagataaagtagacttcaaaactaagaacataagacaggtatttcataatgataaaaggggcacttcattaagaagatataacaattttaagtatcaacctaatcatagttccaaatacataaaggaaaaattgatataattaaatgaagaagtaaattcataattagaaatttacttatctctaaataattgagctgctagacaaaaaaatcagtaaggacatagaatatctgaacaacattatcagccaccttgaattagttgactattatagaacaccgcaccccgaaataatagaattccgcggatcctctccctatagtgagtcgtattagcggccgcaaatttattagagcaatatagtcctacaatgtcaagctcgaccgatgcccttgagagccttcaacccagtcagctccttccggtgggcgcggggcatgactattggcgcgccggatcgatccttaattaagtctactagataacttcgtataatgtatactatacgaagttattatctatngtcgggtgcggagaaagaggtaantgaaatgtgccccgcttacgcanggcatccatttattacncaaccgtaaaccgatttgccaggttacgcggctgcangcatgcaagctnntgcgcgccgtcgaccaattctcatgttgacagcttatcatcgaatntctgccattcatncgcgnattatcacttatntcangannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacaactggtgtgcatgaacccccaggttcctcttgtanagatccccccgagcagtctggaggatctcgagactgggatggagaatggggcagcctggaaaaagatcttgacacttccctgtttcttagctaggtaaatgttctgactcctaagaccttcatctctaaaatgaaagcaatggcagaatatgagtcactgggctactgggaggatcagatgaaataatgtatgccaagggtttggtggggtgcctggcacacaggaagtcagcaacacatttgtctttctcctcattagtcatttgtctcaggtctcgcagtttgcagccctcagagcccagactcttttttttttttttacacagggtttcactcccgttgcccaggctgggctgcagtggcatgatcttggctcaagcaatcctcccacctcagtctcccaagtagctaggactacaggcctgcgccaccatgcctggctaatttttgtattttttgtagtgactgggttttggcatgtcgcccaggnctggtctcgaactcctggactcaagcgatttgcccccttggcctccccaaatgcccagcttcttatctactacactgcattgcttctgagacccagtcttcttacccacagagtaaggcctactccagaggaatggtagcatctactccatagnggttgtttgaggattctgggggtggtgggggggggctgaataatttcatgacattataaagcaaggagcaagtttgcctggtggatttaagaccataggctgtgaantggagcagcctgaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcctcccgttgcatgacccccgcgcncctcngtggnagnatccaaaccacagccagtaggcagcagagccaggactagaacttggatttctcagcttctggtccaacgccatccttacacagaatcttagggtctctctctctctgtcttcccatctctttcaacagtatgtgaaagccaggtcccccagagccaatctgccccctctctatgctcttgaacttctaaccatctatgcctgggaaatgggtactgaagaagacgagaatttcatgttggacgaaggcttcaccactgtgatggacctgctcctggagtatgaagtcatctgtatctactggaccaagtactacacactccacaatgcaatcattgaggattgtgtcagaaaacagctcaaaaaagagaggtactggaccactgtttgcccaccaaatcttacagaaaaaaagagagacgggctagtgtaacgtggcatagagttttatggattggctgtattaagcagtaaggctgccaccatagttgagcatcgacctcccacaccaacacanctggcatntnaagttggtggcttatcaaagtcactgaggggccatggggcgggtagaagcctgttacttgtttcctaatccaccctccaccccaccttcttacttcttgctctttgatgaccaaacaacaccttttttgtgcancatcggggaaggaaaaaaaaaaggggatcacgcctaaatctccacacacccctcttttcttctttgttggaaccacctctctttccaaaaaagagaaactgcgcccccctatatgggggggggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccactgggtggcnaaaacctcgcccctagggtanagaaaaaacctcctctgtcacccaggctggagcacagtggtgcgatctcagctcactgcaacctctgcctcccaggctcaagcaatctttccatctcagcctcttgtgtagctgggactacaggcaagcgccacctcgcccggctaacttttgtatttttttgtaaagacggggttttgccatgttgcccaggctggtctggaactcctgagctcaagtgatccacccacctttgcctcccaataatttaatatttaagaaatttaatatacattttaatgtatattaaaataattgctggaaagactacataaaaaatgcagactacttagcatagatcatgaacagaattaacagtcagtaaatggtggttttattattattattgatgttattgtttttattaatatctgaagcccctgagctctgaagcttgttgaaaatcatgtttgtactcatcaggaaccattttattgtccttgagtaaggtggcattggaaccaggaggttctaagcaggacaccacacttcagaatgtaacaggtgggctgtgtgtggtggctcacgcctgtaatcccagcactttgggagaccgagtttgtaggattgcttgacaacagagtgataccncctgcatccatctctacaaccataaaaaaatagcttgatgtggtgcacatgcctgtggttccgcccacagaaggtgaggaggaggttatctgacccagtcaagctgaatgagcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatctgggcagaacccccggttctttgtggnagnatcccctcggttatcaacagcctctggtcaatttagcaatcataatctgtgtatctcccacctctgtttgccttcagggacagaaaaagtgcctcctttccaggaggtagacaggctgttccagtccccatctttgtgtccttcataatgcccagcacagcccacattgtaggtggtgggaaaattcttgtttaaaataaaaaaaagaatgaaaaatgcaatgtcttagtccatctgggctgctaaaacaaaataccatacactggatggctcatgaacaataaccatttatttcttacagctctggaggctgggaagtccaagtcaagacactggcagatttggtgtctggtgaggacctcttcctgattcacagatggcagcttctcactaagtcttcacatggtagaagaggcaaaggtgtctctaggatcgcttctttttttttttttttttttttttgagatggagtctcgctctgtcacccaggctagagtgcattggcatgatctcagctccctgcaacctctgcctccgaggttcaagcgattctcctgcctcagcctcccgagtagctgggactacaggcacctaccactgtgcccagctaattttttttttatttttagtagagacggggtttcaccatcttggccaggctagtctcgactcctgaccttgtgatccacctgtcttgcctccacagtgctggattacagttgtgagccccatgcctggcctctgggtctctttatgaagcatagatccanttcatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaactgcgttgcataaaacccccgctcttgctgtagnagnatccaccctaaaanatcctccatgatgtttggaagggttctgggcctataagacagctgtttttgagttttgaactgtgtttagaccctcaagatacccctgtttctggggagagaaggttgaaagcagaagattcacaagacatgcacaaccaaaaggcataacacatttaaggaaagacgtgtggctctatcattctatcacaggaccacttgaaggtctgaactcattaggggcttcagttgccaaaaatggaatctaattctgggtaacttagccagaaagaaatttgttagaaggatatctggaagcttagagaattggcaagagaaataggatcaggaaattggcagaaaccaaggggagctgaatggctgcaaccagcgctaaggattttgccagaaacagctgctgccactgtgggacataggagaccacattaattctagaccatccctttttctaggtaccccccaccttgtgtttccagagatttctttctttctttttactttccttttattttgagatggagtcttgctctctctcccangctggagtgcagtggcatgatctcgactcactgcaacctctgcctnccgggttcaagcaattcttgtgccgcagcctcctgagtagctgggattacaggcacacgccaccatgcccggctaattttttttttttttttttttttgaaacggagtctcactctgtcaccaagctgagtgcagtggggcgatctggctactgcagctcgcctccgggtgacgccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctacttggtgnnaaaaccgcncgttttcgtgtagaggataccccctccttaanattggcactagagctcatttggtggcgaaacccagcctgaacctggtatgaggttatgagtgtttaaactgccttgtggaaatcctatctttggctgcagaaatagcagtgctttgatcacagggggctgtctcaaaccctgctgggagtgttatgtgatagctggcatatccaccaaattacttttctttttctttttttttttttggcagagtactcactctgttgcccaggctggagtgcagtgcagtggcacaatctcagctcactgcaacctccgcctcccaggttcaagcgattctgcctcagcctcccaagtagctgggactacaggcacgtgcctccacgcctggctaatttttgtacttttagtagagacggggtttcaccgtgttggccaggctggtcttgaactcctgacctcaagtgatctgcccacctcggccttccaaagtgctgggattacaggcatgagccaccacgcctggccccagattacctttctaaaatctgaatagattttagaaattcatatggccctaagagtttcagagaaacacaggcatgcacacaaatgcatgcacaaccgatacacacccagacacgcacttagggatctgctcacacaagccagtcgtgcaccacacaggatacgtgcattcacatgggaacacactggcctgcagacacctcatcacngaaaacacttgtccagagaccatgcagactgcatgcctgccagcaccctttncctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgcgtgngcnaaaacccgnccgtcttgcgtgtanagnataaaccccggttggaactgatacaggatgttccaaagccttcattacagatcacatggggagactatctggagaccaaaggccccaggcaaacacagacacttccatcagacaggacgttaaggggcctagagatcacctcccagcaactgaaggcaaagataatcctcctactgtacatcctttttttttctttttttttttttaagagacagggtttcattctgtcgcccaggctggagtacagtgacacactcatggcttgctgcagcctcgacctcctgggctcaagcaatcctcctgtagctgggactacaggtgtgcaccaccacaccccgccaactatacatccaccaccaccctgtcctctcagcccccaaagtcatgaggctttgactaggtatcaggatgtcttcaaatgaaaattaatgaaaacagcgggcccggtggctcacacctgtaagcccancactttgggaggccgagacaggtggatcacctgagatcgggagttcaagaacagcctgatcaacatggagaaaccctgtctctgctaaaaaacaaaaaaagtagctgggcatgatggcacattgcctgtaatcccagctacttgggaggctgaggcaggagaattgcttgacccnncgaggtggagggtttgtggtgagcacgagatcatagccattgtactccagcctcggcaacaagagtgaaacttcgtcnnaaaaaaaaaaggataaagagaagaaattnttataactagatccaaagttggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacactttggttgcaaaactcgcaggtttttgtgctanagatacccctatctgtaaaaggggatatcatgaagctgttagatgttaaatgagaaaatgaatgagaaaattgcatgtactgtccataaagttgaaaagataataggggtgggaaggagaacagtccgagtttgaatgcaggtgggccctggggcattgtctggactgaaggacaagggtcagttgaattgccaaagagctctgagactggctgaagggacactcgtcttgtgctagctgctaagaccaaggggaagcctgtgcctcgcccgaattttagtcttgcaaacagctgctcacccagtaggagagaattgtgataaaactcatagccaccatttcttgaatatctactatgccccgggacacagcagactattttagagaatttgcgaaggaaacacagtgacatctgttggacaccttgcaaactaccagctcaggatagttaaatttgaatgttagatggagggaacttcctttccacaatgacatgattttgtaaagctgagtgtatggcagttgtcatgattaaaagcaagtgccatgcagaagttattgtgtaacaggaaatgagattagatagcgtccaatctaatctcaaggtttgagtagctgtggacagcccaacaggcacaggcnctcncgttagtacatccattacgagaagttaagaatgagtganaatagttnttttttttttaattnatgtgcattatttttttcaagcactaccttgttaggactactntataagtatcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaactggtttggaaacccgccgccctagggtngnagaaaaaccctgtgtagcgtttataggaagtagtgttctgtcatgatgcctgcaagcggggacgaaaacgattagaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagttgagcgacagggcgaagccctcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagatatccctgcttattgactcttttttatttagtgtgacaatctaaaaacttgtcacacttcacatggatctgtcatggcggaaacagcggttattaatcacaagaaacgtaaaaatagcccgcgaatcgtgcagtcaaacgaactcactgaggggggatatagtctctctccggatcaaaaaatatgctgttctgtttgttgacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacaactggtgtgcatgaccccccaggttccacttctanaggatcccccccctgacctcaggtgatccacccgcctcagcctcccaagtgctgggattacaggcgtgagccaccatacccggcctgggtccctgctttctcagagcccatggttaagtgggaaagtgggagaaaagctcattatgatccagcgagtcatgtattagaatgggacaacagcagccacaacaacaacaataatggccactatttatcatgcatttttggggtgcctggtccagtgcagagtattacacaaagcatttcagggtgctgagctgactgtcgactggggagtaacctgttcttcctcaggaaggcagaggtatcaggaagcctcacattgcaaatatgacctttagaatatgacctttagactaggtcttaaagtgggagttgaattttgacccatggagacgcagggaagggtgtttcaggcagaaggaacagcatcagtaaaggctcagaggcaaggtctacggtcaggaaatcctccactgcaaactcaggaagctctgggagccctattactcaaggaataggtgggttttcttctccaggcctcataccccaccaaatcccaagggcactgtcaccttccaacctccatctatgtgtgacattttttgacatttcttttattaattatccaggttaatttttttttattatttttttatttttttgagacagagtctcactctgttgccccagctgagtgcagtggcgtgatctcngctcactgcaagctcgctttccggntcatgccattctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcacaactgtgttgcatgaacccccaggcttcctcttgtanagnatccacacccgagggcactggctctgtttctctggaattctctcagcttctcattcctctatatgtcagcttggacctttggcttgtttccctcttggtggcaaaatggccacaactattcctgccctcatattcacacatgggaggacttctcttctttcaaccactgaacaaaagaactaggctttactctagttgagccaacttagatcgcatgccttctcttgaagcaatcacttgcaagggggaaaggtttatgctgataggactgtgccagtcagggcccatcctggagctgcgggtgggggtcaaccccttccaaacatcatggctactatgcaatggggaaggaaagaatgtctgctagagaggcaaccccaatcttcactacagaatctcacctattaccattttttccctctatctaaggaaacctttcctttcttttaagaaacatttctcagcagctcaatacattaaaatagatttaaatgggactgcttaggctagaatgtttgtgaccgagcgcaatctgctcatacctgttcataagttcattccaggagttacatctgttgagcatatattgaagcccaatggactaactcagccctttaattctaaaatggtgaaacctatgtctagagatgngaatgtgacatggccaaggtcacacagccagtaggcagcagagccaggactagaacttggattctcagcttctggtccacgccatncttacacagatcttanggtctctctctctctgtcttccatctctntaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccattgttgcagaccctccgctcctcggtggnggnataaacccagtaaaaagaaaaagagttcccttgccataaatagcaagcagtcattcaggacatggaaatgaggcattcacacttgttcttgtttcacactaaggccctaagcctaaggagggtttctctatgttgaaaggaaattaggcagtgttcagaggggtgttaaagatagactagcaactaattgaaactttctcctcaatgtaagcactttagaagggactgaaaagagaatgttctccctacatgtaccatatcacctacaattacctcgtgtaccactattttgcaaataaatgccagaggcaagagtacattttgatgctttagcctagcactcaaagccctcctcgatttgaatctttccagcctcatcttgcacagcccctccatacccagacctcacccactctatttgccatctccagaacatacccctaactttctcacctctgtgcctttgtgcaagctgctccctctacctggaaacctccatttgtcaagctgctgctgtcttcaagatctacctggtcagaatctcctgctgtcctcttctgccacccacagcaatgtgagccttcactggctggccttccctactcactggagcagagctacggcatcagaatgccctggagcaggggttagaaacacagatttctgagtctcactcgaagattnttttttctttctttctttntttttggtttccaattttctattagagaagaggggggcttacccacgttgccaggctggtctcaagctctggactcagtcatcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatacttgttggcaaaaaccccccgcttccttggtagnagnaaaaacccgtcctcctgtgtcctcccttcctccctccttcccttctctctcccacaaagagaatagggtcagtcttcctctcacctcttgagagcctctcctgggctcaaaccaaagattttctatgtgcccctgtccatctgattccatgtctgtctgtttctttctctctctctctctctcattctcattctcattctctcatgccaggtcaaatttaagctgaacttgaaaataaaacaaaggccagccaccctgcacaaatacatgtgcaacccttagaaaccgaagacaggcttttgaatgtgaaaatggaaagcaaactgttaaagtgagctgatacgaacgttccacttttaaacaattcctagtagagttgggcaaaaaatccacaacaaaaaagtgaattttaaatgccagttaggagtcagagaaccaagagggcatgtctttcccttttctgggagaagccacctgtgccacttttttctagaacctactgaatcgatgtctctctctccctaccccccactcccttgctatcactctctctcttctgtctctctgtgtgtctcttacacaaacacacacacacacacacacacacacacagagtnttcaagggcctgactatttttgagggcagattctccaactgtcctagctcagaactaaaaggccaaggctgggcgtggtggctcatgcctgtaatcccacactntgggaggccgaggcgggtggatcacatgaggtcagggagtagagaccacccctggccacacangtgaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttcctgggttgcaaacccccggctcttctggtgaggatccctgcaggatgtcggacgccgaccagctgcctcccggcaccgccgccactcctcgtcactgtcctcactgctgcaacgagagggtaccctgggttagctggagtcaggacacagccccagagctgcctctcgctgtcctcccttggtccaggtcaccagaaggtggccgcagagagaggcaggtagtgagttcaggcttgggagtgaggccaacctggcttccaatactggcttctgggcgtagcagccttgtgacctccttaagtgacttaacctctctgactgtatcatctctaaaacggggatcttaacagagtccaggcctcccagggatgtcccaggaggcaactatgatcaagtgaggtgtctggcccaagacaggtgctcaaaagcagtaaacatccaaagctgccgccaagagggctttccctcccgctgagctcacgatttctccagctgcctgacagggccactgccttggcctggtcctgactggagtctgcttggctattccagggaacccaccaagacagaagaggagaaaaaaggaggggacgtgaggagaaggtgtgagttctcacctggagctggagggctgtcgcttcggcggggttgggggagactcttncttctcacggcctncanggacagatgtgaagaaaggcggaacctaagattcatggggcagagtcaaccanaaccaacanaccaaagaacttannaatanaataagaacanaagaaaaatttaaaaganacgaagaagaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaattgtgcataacccccggttttttggtanagataaacccacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacggtgaccctatagtcgagggacctaataacttcgtatagcatacattatacgaagttatattaagggttccggatcaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcacttatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccancaccccgtctgtggatctacccactagtcaattaccatcttgttgagaaataaaagaaatgccaatgaagtatcgggcatttctttttgctgttattagttgactgtcagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacacttggttgcaaaacccccacgttcttgtgtanaggatcaacacacatttataattttataacaattttgtaattattataccctcaataatggaccgtttgatccttataaaatgttcttcttcatctctaggaataattttgtcctaagtctatttgatctaatattaataaggccattctggctctcttttggttaatacttgcttgctgcatttcttcctattctattactttgatcatctttgtgtcttgaatttaaagtttgactgttgtagacagcatataggtagatcacattttttatctgttctaccactctctgccagttaactgaagtgtataatgaaactccatttgatttaattaccaatggggatttagtaaaatactaacatgattgaaatattctattttgctatttttctatatgtgggatgtcttttgcttttgatattcctccattaccatcttattttgtgttaggtatttcctattgtgctgatttaatccctatgccatttcttttgtcatatatattttttgaatttttttagtagttttagtaagttgccctggagactacaattaacattcttaacttataacatnttaggtatgatttaattaattttcaatagcatattaactttttntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatacttgtgtgcataaacccgcaggtttttctctagnagatccccctgagcatttatcgtgcatgaatcattcagcctgcattgcaccactggcttggtgagggagagatgatgatgatgccccaatcacagatgaaaagaatgtgggtttgagaaagaagagtgggaaggtcaaaaccacacagctggtaaaggaagaagcgaagagtctgtctaatatcaaaatttgtggtttctcacttataaattgtatggcctcaggcttcatatgctggggataggtgcaaagaacggataggggcccagggcttctagatccctctgtgagttggttgcccctagagagagaacttgagcactgggctgggagtcaggggtcctaattctagtcttgcctttgccaccaactcgctgtgtgaccttggggtatctctcaccctctctgtgcctcggtttacttaattttttaagtgagtcattggtgagactgtctgattctccaaagtctttctagctccgaccctcttgaattttgatcttagctagcacaggcggtggcatgaaacagctggaggaagggcttgggggaaaatctcagtgaggggggcnttgggtcccttgagtcaagttcaaatcccagcttcaacacttgtgtgaccttgggcaagtcacctcacctctctgagcctccattaaaaaatcattntaggccgagtgcagtggctcacttgtatccagcacttttggaggccgagagggcagatcatgaggtcangagatcgagaccttctagcaacacggtgaaccctgtctctactaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaactggttgctacacccccggttccactctagnagnatcccccctgagcccagccttataaatacattttaattcaaaattgaatttctaaggtcaaggataaagtttttttgttagtaagtcagtgacctataggaaaggcccaaggtttcatttatttgggagatgagaattatacaagatgattctgtgtttgtttcaaggccaaagtgttatagcttttttttttctcctctgactttgggatgggagctaatattcatatatgatggccataggaaaatatgtcagttttacttccacaaatcaaactactgaatatttgaccaaaatttttcactttctggctaaatatcaatgtatcagtgaaattctttttttttttttttttttttctgagacaagttctcactcttgcccaggctggagtgcagtggcatgatcttggttcactgcaacctcctcctcctgggttcaagcgattctcccgcctcagcctcccaagtagctgggattacaggcacctgccaccacacctggctaatttttgtatttttagtagagacggggtttcaccatgttggccaagctggtctcgaactcctggcctcaagtgatccacccgcctcggcctcccaaggtgctgggattacgggcgggaggcactgcgcccggcctcagtgagattcttacacaggaagtgaccactgtcagttaagatgctttctttttgcaagtaagaagaaaacacannaaccanctcanactggcttnaaacataaagggaatttatcagcttatgtaggaaaacccctaacagtaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccatacctggttgcataaacctcccagtaccccttctanagnatcccctccttatttatcagtttgggacaggtgctgaggagcggccaagcactgaaagattttactggctgtcccaagtggtgtccccgagctctcaaaatctacgagctgtccgaaagcatttgggctttctaagtgggtttcacataatgactatgataaacctgtggtatttatgcactaatacctgtgctgggctatgtgcccactgacaccagcatatattgtggatagtgtgtaggaactctataggctcagataattccagacgtgtcaatacatacagatgatggaactcttttgcacagtgactggtggtcccacagctgagtgatgatggtgcatccgttgctcagagcctcggcgctggagccacatgcttgggttcccatcttggctcttttacttaggagctcataaacttgatcacattcatctctgtctctttttctccaaccggtgaaaggtgagagtaagccatgccatacgtatgtggtgacttctgaattgttcaatgtgtataatgttatcagtgcaaatgctcatgaagcttaattatcagtgaaatgccttgctttagattgcacgacttaacaagctcaaagattcatgcaagcccgggattccgaactcccaagccattgttctttctatgacatcnnttctgcttggtctacaaccaaccactttatccaaaattcatactcattttgaaatactcagataaagctttcaaaatgctgttctgtgtctgggctgagtgcacactcaatggccactcacataaagggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaactttgcataacccccggttcctttgtanagnatcccccccatagatgaacttttaagatggagtcaaggccgggcgccgtggctcacgcctgtaatcccagcactttgggaggctgaggcaggcggatcacgaggtcaagagatcgagaccatcctggtcaacatggtgaaaccccatctctactaaaaaatacaaaaattagctgggtgtggtggtgcacgcctgtagtcccagctacttgagaagctgaggcaggagaatcgctcgaacccaggaggcggaggttgcagtgagccaagatcacgccactgcactccagcctggtgacagagcaagactccgtctaaaaaaaaaaaaagatggagtcaataggattcactgatggactgactacagggcgtgagaaatgagtgaaagttagctctgaggtttctgacttaactaacaagacaaaacgtgcttgtatatttaaggggccaactgaacaaagtggacacttggtagctccgggcccagtggaggngccatggtgtaagaaacagctccatgggggcactgcgttgtgttttatgtcatcacccatacacattgcantctgtgtcctagtacccttgtgggtctgtgtcactgtactccagagcacaacacagaatgctaaacacgccccatgctcctggagngtgggtaatggtgggggcctggatggacagtctttaagacctggtctttcgtctcagcacatatcacttggagaagacactcttctctgactacgtggataaggtgaggtacgcaggaacaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacactggtggcaacacccccggtccatggtggnggnaaaccccccataaaagttcaacaaggaagtagaagacttgaacaatactagctaaggaacctaatgggcatctatagattgctccatctggcaatagcaagacacacatttttctcaagcacacatcaaacactccccaaaatagaccatatgataggcaagaaaacaaatctcaataaatttaaagtgattaaaatcatacaagttatgcttttgggccacagtgtaataaaatcaataataggcagaaatttaggaaattcacaaatataggttaatcaaacaataccacttctatatagcttatgggtcaaaggcaccataataggaattcataaaatactttagatggatggatacaataacgcaaaatatcaaaacttaaggaatacgacaaaagctgtgcattgagagaaatttatatcctatattaaatgtctatattaaatgcatttaatataggaaatgcctatattagaaaacttgaaataactcaaatcggtaacttaatcttccacctaagaaactgaaaaaagaagcacaagctaaaccaaagaaagcagaacgaaggaataaatagagattataatgaaaataaataaaatgggagaaaataaacataatnagagaaaatcaatgacccaaaatttgctttgaaaatatcaaaaaaattaacaaacttttagctagactgacctagaannaaagaagactcanattaataccaaccctacgannacataaaagatataataccatgaaccattgatgggcacaaatgattaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaactgtgcagaacccccggttccttggtgnaggaccaccctttaattttaaatatgttgagagaaaaccagctacagcctggcatggaaactcctgttgttccagccaatgccttggagaaccagagaccacgcccccttcctccctgctgaggagtcaacgaacgagaccaaagtcccctgttcttctctgcagtcagcagaaatcagagaagaacatctttagacagtcagcagactcaggaactgtgtactctaggactttttaaaaatttttttacttttatttttttgagacggagtctcgctctgtcgccctggctggagtgcagtggcgtgatctcagctcactgcaacgtccacctcccaggttcaagctattctcctgcctcagcctcccgagtagttaggattacaggcgcctgccaccacacccggctaatttttgtatttttaataaagacaaggttttgccatgttggctaagctgttctccaactcctgacctcaggtgatccacctgtcccagcctcccaaagtgctgggattacaggcatgagccaccgcacccagcctgggacttttttatttttacagagatgggtgatgattcatgggacgttggagatgccccaagactggagatatgatttgggggatcctgaggattggtgacctangcaaaacttggggaggctggatcctgggtatggagtagccaatctgaataagaccctgcgccaaaggtggcacgaaaatagtgggtctggccagcctcaggggaggccacaccagtcctgactgcctgctctgg

SEQ ID NO: 700 - DNA, 193697 bp, Homo sapiens
  misc_feature (1)...(193697): n = A,T,C or G
tgtattagtccattttcacactgctgataaagacatacctgagactggacaacttacaaaagaaagaggttttattggactcacagttccacatggctggggaagcctcacaatcatggcagaaggcaaggaggagcaagtcatgtcttacatggatggcagcaggcaaaaagaggagcttgtgcaaggaaactcccatttttaaaacaatcagatctggtgagactcattctctatcacaagaacagcacaggaaagacccactcctgtaattcaatcacctcccactgggttcctcccatgacacttgggaattgtgggagttacaattcaagatgagactcagctggggacacagccaaactatattatcccccaagatctgtgcgcatccagaacacataatcttgggtacacaagacacttcattctgagcaggaatgtctgactccaaggcaggtgccactgctgttccttgaaagtgatagaatgctttgttggttggtactacagttgggattaatacccagggctatgaggccgtatcactgtgccagtcaaagtgtggtccacacactcaagacagcccatgcactgcttgtcacacattggagagaaattggtacagaaggccagaggaggcaccagagcaatttgatggtgttggtaattgacactggctttagtcatgaacttgtattttgcatatctttgtgttttctcatttcacttttttccctagaaatttatctttgttgtattttataaaagtagcagtttgtagcatatgggaagtaaataacaacaaagttggtatttccactgacagtgtgggaagcactgctttagagcagcatcatctgtccagaaacttgagcatcctacagtcatccttgagacagtgtcaagagaagaaaatcacctgtgaatcctaggacggtaaaagaggattgtgtggattgttctatcacaaggacagcatggaaagacccacccccataattcatcacctcccactgggttcctcccccgacatgtgggaattatgctagtatagcagtggaaaaatatatgtttgttacttttatttggagttgcaccaaagtttttggttcctaagatcaacagatgactctaatcctttaaaagttgagaaacccatgttgttaggcatgggggcatgagttagcagttcttccatgctttctcggtagataagaagttgcaggcttctattattagatccacaatctaatgttttggttacactatatagctacagcatgcaaacctcataattgtgagtcaggcacttcccatatgagggaatcacttgtggtacccagcgttggcagcaacaaatggagactgagaaagttgaatcaatagcacagatgctcagatctggaaagaagcaaagctagaatcaagtgtggtgctcagagccctgatactttccaccctctgacctaagcatggtgagataacgttctagtctgggtataatgagctcacgggtgccctactatttttctttaatcaggcactgtctcaaattttaagtaagaagcacgagaaactaaaccattccaacattccacaaccagggcaccaaagttatggtagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcctagtgtgaacaccagcctgcggtcatgggcgggcctggctctggatcagacgcggagagccagcctggtgttgtaggaagagctgtgaactaggagcccggagacttggctctgtcaccagcggagggcgatcttggtaagaaggttcatttcccagggccacgtggattcatctctgaagcagagacaagtaggaaattctacacgcgccatccaaggtccaaagtgctacatcccttcctctttccttttaataggtgctcaataaatcttcatttaaatgaacagaaaaatgaatgaatgaatgaatgaatgaatgaatgagtccattgtcatcaactttttaaaaataattgcaacttttacttaaaattcaggggtccatgtgcatgtttgttacatgggtctattgcgtgatcctgaggtttggggtacagttgatcccttcaccgaggcagtgagcacagctcccaacaggtagttttttcaaccctcgccccctcccctccccggtagtctccagcacctactgattccatctttatgtccccgagtgcccaatgtttagctcccactgataggtgagaacatatggcatttagttttctgctcctgcattaattatcttaggataatggccgccagctgcatccatgttgccgcaaaagacatgatcttgctcttttataggacagtgtagtattccttaaggtgtcttcttaaaagaagatttcaataaccagaaaaaaaagtgtcttcttcctaaagctaaattgaaaaatacctaattaagtcaataacatgacttaaaattcattatcatactgaaaacactttatcacacaggaagtgcctttttcatttttgtaaggccatctttcagaatatagcctttcacctcaatgatttacgggtatgcagtattagagtctcatcaaaatcacgggtaacatgaggattagaaatgtcagatgttaggaataacagaatcagaatcaaaatattctgagagtccataaaacttaacagagaattgcagtcagttctgctttaacacgacatgtgcgcacctgagaatgtcggtgctatgcaaaatcatgcaacgcaaatcacagggctggtaagaaaagcgggattggggcacagcgctcaaaagcacgtcagtgccacattgagaaaaagacggaaagctaatactaatgccagcgtggttttaggggatcctactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttcccacgagcttcagctcatattacggtcacttactacacaattgattttcttctaggttgggtcacttgtgtttattttcctgtggggtgtcctcagcaggaaaaggaggctctttttttggcactgtggtaaaatttcttcatgttatatttatagaaacataataaattcttttaaaataaatggtaatgtcacactggtctttgtttctttacccttttaaatatatcctagtatcctagctttttttttttttttttacctctcagcaatgacataaagtattttttgtttataaacatcaaaaactttttttaaacaggaaaattgcttgaatgtgggaggcggaggttgcagtgagctgaaatggcaccactgcactccatccagcctgggcaacaaagtgagactctgtctcaaaaaaaaaaaaaggctcttttaaaaaaaattttatgccatttgcatattgaaaatcttttttaatacttctgttttacaattagtcaatcagtataatatgatctataacaccacatcatataataacgatctctggggctctgtaaaatatttgtcaccatagctagcaatttatcaaaagaatataaattaaaaataaaaactctgcatgctttgtaagtgcatgactcatttatgagtggagagaaatctctaggataggatattttttcttcgaggctggaatatttaaagctgcatttcacaacgaagtttggtttacacgggtatttactatttgaaaatatctgtgggtggttttaggctaaaataatcatctatttccaaaaccttgatatcaggttttatatggcagtagtttcctgcttgcatgaacggcacgcgtgtctcccttcggggagacctgactttgatacttttgagtcccttgtgtctgaagcaggcgctgatgggttcttcccatttgggtttatgtctgtgaccattttgcagtttatcttaaagaggagctttcagtgagagaacgtgtgctttgcactcccttccctgagtcatgctatcctaagtagtccctgtgctaatcatcacagaagggatgctcatatcatttacggcacaaattgggacctcttgagaatgaaagagaattgcttttcataagtcgcaggacagcaggtgtcagccaggactgtttgagcaaaccaggatgcattgtcacaccggtcctgggggaaccccccggtccgagactcatctccacattgaggccacctgacctgtgccgagcattaagctaacactttgtgtgtggtgcgtttcctgacctcccaaaacaacttgatgaagtgggtgccatgacatctctacatagaatgaggaagccatatgtaacatacatgcctgcaggattccgtccattgatcatgtcctctttagatactccacactgattcctctcctattccccccctctgtctctctctgtctctctctctctgtctctctctctctctctctctctctctcctgtctctctcctctgtctcctttgcaagctcatccttctcttcagggccattcaaagagggttcttaaggaatggtcctagaccacctcgttctcctctctcccatctcactcacccacatgacttcactcaacacccatatgtggataacttacaaatgtacatctctagtgcagttagttaatatctgctttgggatgactcaaaggtatctccaatccagcatgtcaccttttcactctcatcccgatagccaagtcttacctatgaaccttctacatatctttcaaatcctaccactgtgctccatttctaaccccaccctggagcacgctcctcgcatctttcactcggactattgtaatcacacacatattcctccactctgccctccacagaactccctcctgcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactggggatcatcgaaactgggaagacaaaagtgaacaaaacactcaaaaatcctggccctcatgggctcagcatctaacgggagacgcacatcccacgtgaaaggagaaaattgggatttcacggagtctttgctttgttctttgtgagtgcggcagtgaattctctgacagtgctccgtgtactcggtgtggctcaaacatcaacctagtctctgtcgccgcatgcaacaggtttgtctgatgaaaaccacagcagaggcataaccaagacgatgttaaggagacccctttcaactagcatttgccaaaagtccctggcaaatcacctgggacttgtttaatagactgttcacctggcctctcccctgagagtcccgattcctaggtacagtttggaacccagtctgtgttatcacaaacccaaccaggtgatgtctaacagattagtaaatttgggaagtgttacctaggatgatgacaaaaccaagcaatacccttttttggcttaaaataacttcagccagttttctgtccctttcaactaagtctttcttgatatagtggggtctctggacacctgcaacttttccacaattatcacatttaccaatttttcacggttctaaagacattaaattcaactttcactttgaggcagagctgagacctgctaagaatgagcttttcatgacttaactaactgactagccaccaaaatccataaataaattaatattttccagtcgtatgattagacttccttatattccttaatgctaggacaaccttaagcaacttctaccattgaaatgtttgtctctggcctccttttgaaggtcacactgttctgtgtttcttgtcttctcatgcttagaaatcgaacaggttaaggaacctgggctgcttgcccagaacaatgttaacaacaattattagctctaagaactaaaaggaaaataaaatggttttcattcataatatgttaatgaggctaaattcagaatgagaccgtgtgccacaaaggtaagacaaatgacttgagtgatctgcgttagtttaaattacagttccagggacttgtgtattgtcattaaagcttacactcatcacatttgtaagcaatgtttaaaggtgttcccgggatttacaataattcattaattttaagccttctctttgcaaacgttcctgagaattcctataaatatgtagatataaaaaactacaattaccaacttcacaacaccacagacttcttagtctgtgcttccttataagctgtggatacccgttcttatactacaaatattggaggtggcagcatttccttaaaaaattttactctgacattagagttcgtaagagacactaattgagcttttttttttttttttttttttttttttttttttttttttgggaaacggggtttaacttttttccccaggctggagggcaggggggggatttttgttaattgaaacccccccctttaaggttaaagggattttcctgcctaaacctcctggccccacattgggttaattttgttttttaagtaaaaaagggggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaaaaatttaatttctaaattttcattgctcacatatgggaaatagaactgatttttgtatattgaccttgtatccattgatgttgctacactccatttgttagttctaggaacttttttatcctttgagattccttgagattttctaagtagatttccatgtcatctgtgaacagaaaaagttgtattccttcatttccagtctgtacaccaggtgtgacttcccctcaccatgtcgccctggttatgacctccagtatgatgtggaaaaggagtggtgagggccgacatccttgtctgtgcctggtattaggaggatcacattcagcctttcaccattaaggatgatagtttctggcaatgcggcagggggcacatagatatatcaggctaggttcccttggccatcgacatttagaaaaatagcataaaaaattttaatctaactgataaatcaagttaccgttccttaacagaaattcttgtatactttctgggtctgtggtgtacagggcctgtgctctctttgaaagagtcttagtcaacttcgggaaaggagatcttaacaaaagtgagtagaggggataaagggctcaaagatcttcgatctcatggatttaatgtgggcgatatattcacactaaacttcgactattagatgtggattctgtcttgaaacaatgcgtttattaatgccaaaaaaggttgaaatgttttgattttgtgattatccttaaaattatgtatattctttgaagcacagaattttgtctttgaagtctgatttagaagctaatcaagttttgaagtattaacccttaaatatgaatgatataaaactgatatctctctacagctttttagaaaaagcagaggctttttttgagactacagaggctttttttaatgaggacattgttattgcacgtggaaaaaaatttaaaactcataaatgtaatgttgcttaaaaaatcactgaaaatagttttgctgcattctcactggtgcttgcagactggcttaagataaatgaaggagtttcatgtctacccaaactaaagagaaaagagcttgtgcctcttggataagcaaaggtcacctaaagaatgaaaggcatagcggccccccaaccacccactgaaatttattgtagacaggctgatgttcaaaccgtattaccagaaagcagctaatcatgtgttttctagatgcgataaattgtttgcaagcaagacggtacttcatcgcccattagatcatctgtgtcttcacacttaggtgtatctgtgtccctaaagcacacaggagactactggcagtcctggttcgtagggtggcttttgcccaagaaaaatcactggtcaacatttacatgactttggcatatttaaatgatgcaatttggggtctcctcatcaccgcctgcctctctgagcggcaggtgttttgtgggataaaatgcacagggaaggtcgaataggggtttgcgcttacctattttctccacaggtgtattcagagggagaaagccctgtctaagaagctgatccatcatctcctcatcatctgcttgtatctcagagaccatgttacaaggaataaggccaagccgggcacaggtttccccacggtagaatccatcagcgtctttatcaccataaacctagagccaagggggaaaataaatcaagcactgtaattgattggttcagaaatacaatagtcccactgacggtaagtgagtgtagtcgaaaatatattttaaatatagtttaaaaataccataaatcacctgcataggtcacccacgtgtgtgctggggatgtgtacatgtaaccctcgctctatgactctgacttaagagccagtttttcatctagtgtttggacaacctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaaaaaaaaccatgcggtggctgtttaatgtctcgtgtttcctcatgcttctgtaacaaggtagcacaacatgcagtgacttaaaacaacagaaatttgtttctcatatttatggagaccagaagtccaagattgaggtgccactggagttggtttctctggagactctgagagacagtctgtcccacacctctctctagtgcctggaatttccagcaatcctcactgctccttggtcggtagacacctcacttccatctgtctccctcttcacatgatgctggcctctgtgtctctttgtgtccaaattcttttcttcttctaaggaccccgatcactggattagggcccaccgctcatctttacgaatcacatctggaaagaccctctttccaaacaaggtccattctgtgtttcctggtgagcatgaattttcaacccagcacaattattatacctccaattatccccatttcatagatcaggagaattagaggagctggacttttacaaagttgctttgcccaactgacatatggactgaagccaaggctttctaacccatggtctggtcttctgctgcttgtcttaaaaacagcgacagtccaaggggttcgcattctgcaagagcatgctgggcagagatggattttactcaccagaaactgaagtgacttacttgcagccatgatccggaagagaagcttcatgatgtggttttatgaggatcttgtatctccctcttacccagaagtaaacaccttcacttgaccttctgcggctccatccactgtcacacacgtaaacaccccgtccagtaatacactccaacccaaatgcagacaggaagatgttcctaaataatggtattcctcgggatactctcatttcacaagaaagtcgtcagatggcctaattcccaatttcacataataattccacaggggtgatttctggcatatctcttatctctacagaagaaagcaagcagggtccctctatcagggcccacagatgtgtgctttgaggagctggaaaaaatgtaagctggagtccctcggctttcccagcggcctttaagtcctttcaggaggagcctgccgctccctggcagggatttgcggtctttgcctttgtgaacaactttactgctcacttcaggatggcattgcaacatcttctttcttcgtgctcagaatccctcaagattgaattttgttttaagatcccatcagtgttgagaaatgttggtaaatacaacaacattcatagcaaactttgatggaatatctgctgtttatcacaaactcatctgggaactttacacatattgtttaagttaattttcaggcagcccctatgagtcaattactattattattcccaatctacaaataagtaaaataaagttcagagaatataaggaacatgaaaaggtcatacagctaaaaggtacaagagtcatgaaggtaaggttttttgcaatgcatggtcacatgtaaaagaaactgtcatatgaagttaaagtataaaaatttaattccactagtaaaataccatgacaggatgacttagtgatctccaaaatcatcacagttgaaaaacgtcttgctctgtattcactacctggataactgtgaagactttttctgtgcattttttaaaaataaaaacctattgcctggatttaacttttctgcatcattcttttgtcctaaatgtctgccaactgcattgctaccacaatgttattaagatgcttagattcaaattgagatagttccaaggactttattaattagcccatctaggaatttggatgaatgttctatgcaggttcttcctgcacagaatccctctagatttaattttgttttaagattaccctacatgtacatgtaaaggtgatttgccaaatcaccattcaacaatattaccgtcataattgtttccgacaataatcatcaagggatgctgaaactagtgggtgaaagttcgatgagaaacaggatacttgcagagtctcaaagtgtttccctgcaagatactcataactcacaaagggaaaaatagtcactttgcattagagaaatctcatggtccccacctggggacaagggcgatatttttcatgtaaccaacatttaccacccgccaaagaggacacaaagcagaattaaatattatcctcgaccccagatcatttagaataaccatcaatcatcgttacatttctcctggtgtaaaggatgtttgaggttaagccaacttttttcacttcttgaaagattaaaagggtaggtatgaagggtgggggctgatgggtgcaagacgaggttgcataatgaaggtgtacagctttactcccaggaggcacaagttgaaacctggagagaaacccagtgaggtcatgttaatgccaagcccttttcctgtgaagagctgggcaaacaagactcccccatcaagccgagaacttccccataagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttttaaacttacttcatccttgatatcccttttgtaaacagcatgtagctgagtttctatttgtacccaagttgaaggtgtctttccttttataggggaattgggtgaatagtgtttattatctcatgatgtccttacatgcttgtatttctgtttattttatgttgtttcttttccacgttttgttttttaaaagttgagctaagcaagtctcatttattccatttaactttttataaacaactgctttagtagttatacatactagttatatttttctagaggtaatttaaatttttaaccatcatattcaattttaaatttttattaatgtctaatattaatcaatagcttcaccccaccaaacaagagtctgggcacacattcagttccgtctctaccacctgtgggctctctggggtgcggtctccttcaccatcttcatagccagtagctcctggtggagcactggacaccagcccagactttgatctgattcacccaatcccaactgctcattttcaggtgtttctggaagttttctcttctactgatggcattgttattgttttctacagatatttagatatttttaaatatatattatattttcctgtagtttctggggatttggagcaagaaagggaggcacgtgttaacatgtttttttgatcaaacatcctttttgagagcactttgttggttttaaaatatttagataattaatctctctactgtttccttatcgatggccttgaaaaataggtattagaatctcaattttagagacaagaaaattaaggagcagggacattaactaatttgtgtaaagatatccctcttggtaaggagaaaaacgagggctggaaaacagatttttctgatatttaagctcatgttaattctgctctgaaaggtgtggcagttttctttccccctcctcctcctccttctttttctcttgttcctccccctccacttccttctgccattatcattaccatcatcaccatcactaccaccatcattattaccatcatcaccatcaccatcatcatcaccaccatcaccatcatcaccatcatcaccaccatcaccatcatcactatcatcatcaccatcaccatcatcacatcatcaccaccatcaccatcatcatcacatcactatcatcaccaccgtcaccatcaccaccatcaccaccatcaccatcatcaccatcatcatcacatcaccatcaccatcatcatcaccaccgtcaccatcaccaccatcaccatcatcaccaccatcatcacatcaccatcaccatcatcatcaccatcttcaccatcatcaccatcatgctcaccatcatcaccatcatcatcaccatcatcactaccatcatcactactagtttctttacccctaaggaacccgtgagtctcttggagggcagggaccactttttaccaccttggcatttcctgtacctactgcctggcctaatgcccacatttgtaaatctttcttcaatgtttgtttctgccttttgaattttagctttctgtgagcagatttgtcttgtttactaacatttcccatagtgtccaatagatgccagggacagagtgagtattcagtaaatatttattcaataaatgaatcagtgtttcatagatgctacaacctactacgatataaaaatgagaatgtaatttgaagacagaaggtaagaaaaaaagctcaattagaaattgggttgttatgtaaacctaaaatataaaaatttagtttcactagtataacaccatgacaggatgatttagttagtgatctctaaaatcatcacagctgaaaaacatcttgctctatattcactacgtggtatactatgaagcctccttctgtgcatttaaaaaaaataaagacctatcacttggacttaatttttccactgcatttcatcatgttaaatgtctggccactgcattactaccacaatgggaattgttactaggaagcttagattcaaattaaggtagttccaaggaatttattaattagcacgttcaaaaagcatccgttgagtttctccaggataccaaatattatgggcagtgcaagaccgataaataaataagatatagttcctgttattaaacatctttacatgtcatcggtgaggaaaatgtggcacccttcatgactgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcactgcacacacacacaaacacagatccatggcagcccattccagtttgtcctccgtagccttgcctacaatctaatccaaacactctctaagagtcaaaactataatttttattttgttctggacagcaggagggagaatgggtgataatggctttatatgttactgtggcttacgtgaacatctgtgttctctaatagggatcttccaggaataacatctcagcacatatgagtaacattctggggtggatacctccagtacttggtggaaagttcaggtgatgagtcagtctggccccagtctctactctaattattctggggagacaggcaggcgtgtggggccagagtgctctggcaaattctaatcaccaaccagttataccagtcctacaaatttatatcttgcttatgcaaaaagtttatcactgggggaatattctttcagctttttcaaaatacaaattttagactgtcttgttgcaaaaaattgccacaccttagcagcactgataatcagaaattcttaaatctgaatattttaggttatagttttctcgataataccagtaattaatagagaatattgtaatatttgataatactagtaatcacaaataatctttaatgttaccatgaaattcttaaagcacatagtcagattttagccagaacattatatatattcatatatgtgtgtgcatatataaacatatactataggtaatctatattatatagaccacgtaaattgtgtctataattaacaaatgtttaaaatgaaaacgaaatgttaactatatttcacttgtataaaaaattaactgatccacaaaagtacaagcaagcaaaggccacgcagactgaaatacgctagctctcctctgtgccttccttgagggctcaagactcctgtgaccgatcataaacaagaggtattttcatacaaaaacttaatttgaatgctattcaatacactagcctcgcgaacgtttaaaagaatggtcgtatttatgggcacaaaatccaatttcactaatttctcttaatatccaccctagaggattcatacccaactgttatttccagggagagagacaaaggcgagaaaaggtcgggggaaattgcacttaatgtttgatttgatttctttggatagagatgcaggtactgctgtacaaatttcgcacacacacacacacacacacacacacacacgacacacgaatcaacatccgtgccttacgttgctttctgtttaccttcacagcaaccttcgagatgtgtgagtttaagcagatgcaacaccctttgacaacaaagacgcagcacactgggttaaagtggattgaaatcagacatgtcacattttaggagagaatgcatgcaagtagggcattagtccaattcttttgtactgagcatttcaaagttgagacccagtgggtggggcgaaaataaatcaagccctcctatggcgagaatgtacacggactccagcatctccaatctgaccctatcttttgctctccggattgtcagctgcttcgggggttgtctgatatatgcctccttttctcacttctaagactttttagctgggagtgtgtttgaaaacacttcagaaaaaggatggaaaacacagtgtctactttgaaatgcgttcctttgttaaatccctctcccaggaggaccaggctcccaacacctgagggcagccgatgactggctctgctctccccggtgacctcacatgctcccggcagctccagcacagagctctcgttctcactcagctattataacaaagttgtacaagaaaagaaaaaagtccttcgtcccatccttaattgggcactctttagaaaggagatgctggggaatgtttctagacatctgacgcttataaggaattctacatattatccgagggtagatacgaaaagtcttttcttgacaaatcatcccaacatttaaaaacatttacctccagaaaagcatctgagtattttctcttagacgacattcctcaacgataacctcattgtgaacaaggatgtaacgcgtggtgatggttacaaatggtaacagagcttccagtaaaatgtgttctattagtaagccctcatggtgttttagctcagcagaaacagaaaagaaggctgatttccctccctacattatattataaaaactttcaaccatacagaaaaatggaaagaactgtagagagaacttgtaatgcccacactgagactgtgcacctggcattccgcttggcctgcttcctcccagcctctcatctccccatccgtccagtcatccatcaatccttcttggtcttttgctgccaggagcctaattggagctgtcggcggctctgtctctgggaggggacatgatgatacatctccattgggcttgtctgaagagcatatggaggacacacaccctggctgccggaagagggcactgtactctcccagcagcagaagagcagacccttcaaggattggatgctcctccctgtcttgacagtggccttttcctcattaggctcctccaccaagattcgtacccagcttacaatactgcaatatagatcttatcatccagccagaaagaaaccaggtatgccctgggtcctaagcagacatcgctttaaaacctctatgctctgtaaaaaggggcctcttttatatacatggaacatacatcaagtgtacaaatcttttttttttttagatgtaaaaaaataaagaggctggagtgcagtggtgcgatcttggctcactgcaacctcctcctcccgggttcaagcaattctcctgcctcagcctcctgagtagctgggattacaggtgcccaccaccacacctggctaattttttttggtatttttagtagagacggggtttcaccatgctggccaggctggtctcgaactcctgacctcaagtgatccacctgccttggcctcccaaagtgccgggattacaggcatgagccactgcacctggccaactgtacaaatcgtaagtgttcagctgaacgaatccctgcgtctgtatgcattcacagaagtaccacccagttccagagagagcaggggtttccaacccctgggcatggactggtactggtccgtggcctgttaggaaccaggctgcacagcaggaggtgagtggtgggcaaacaagcattactgcctgagctccacctgctgtcagatcggcagtggcactagattctcacaggagtgcgaaccctattgtgaactgcacgctccataattctttgctgtggggcagtcctgtgtactgtggcatgctatcagcaaccctggtctctacctactagatgccagtggaaccctcccaagttgtaacaaccagtaatatctccaggcattgccaattgtccccaagagaaattgtccccaagataaatggaccccagttgagaaccactgacatcagcaatatgaaaaaccagaaaagtcaaagaggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcagggtctttctatttattctcagctatctctgtgttttatcgaatgcctccacagatgtatcaagaggatcattggtttccttctttagccaattcatgtgaatggtattagtaagtttctaaataatgagctatccttgcatcacccgaaataaaaccgctcatttgctatggtgcgttatcttttcagcatagtactgaatttgatttcctagtagcctgtttaggatttagagatctttaattgtgaaagagaataatctctattttctttcttgaattgttaggttttggaatgaggattaggctggctctgtaaaacactgggaaggattccatctttctgtgtataagcaaatgtgtcttcaagtcttggcgatcagagctctacaatctttcccatccacgctgccccccagtccctctcctgcccttgtttctggcctcatccttgcagattcctagctggtatccctgcctgcagtctctgcccctggaaaacacatggcaggttcatggctcccccctgcagtctggccccagaccccatgccctggatcactgtcctaggcatataagctttctgtgcctgtttcctgatctgtaagagaacaatgataatgacccctttgtattagtttctgggggctgctgtaacaaagtgtcacactgagcagcttaaacaacaggaatgtgttgtctcacagttctggaggccaggtctgagattgagatgtgggttaggttggtttcttctgctccaggcctctctcctcgcttcccatggctgctggccatctttggcaatcccgagagtgtgaggcttcaccctgatctctgcctccatcctcacattcttcctgtatgcaagcctgtgcccaagtttcccccttcttagaaggaccctcatcacaacggaggagggacccgccctaatgacctcaccttaaccagttacagttgcacagaccctattttcaaagaaggtcacatttggagtttctggggttgggacttccacagataaatttggagaggtcaaatccaatccctagtgccccttaatagggctgtgaggatgaatgagctcatatgtaccaattacttagaatagtgcctggcaactagtaagtgctcagaagtgccagctgttgttgttttgtggttattcaaggactatattgaatgtctcttccttcagaaagcatctctcctggctccggccagacagaacctctcctgctgttctcgagtagcttttacttttgactctggtagagaaatgaacacatttggccttttgttatagtttttgtgttacttgctcatcacaaggcataactaaaatacaatcccttaatactcactcccccacagcccccccgccccccccccccacatctctcattaaacccggcacgcttgccattctccacaggcgcctttagcactttccatcccctgcatgccttggaagccattgcttcttcaggtctgtgggaggtgagggcttccccatcactggggaaccatcctggagtgccctgttgtcccttgaaggtgtccttaccctgcccatttgtctgttaggggtcccctcactgaattctcccgatgcccagtgatctctgagcctgcatcacattcccaagagtaggggatgactgctcacccatggtccttgcctctggaccaacgcgggggtagagacacaaactagcatttatttgtgtgaatacagcgtaggcacagatgtggatgctttgcacatcatcacttctaatatccacacaaagcaagcattgtcggctccatttcacaggggaggaaattttgacctcgagggtcttaattattgcccaagtttacggacattttacccactgtttgccctgcctactgaggtagcacgtgggacttgactctataggtggggcttggatactggaacaaattgaggactagctaaaacagggccaaggcataagcagctttccataagacacgcccaccagtgtgccatgtcagtttaccattgccatggcaaaacctggaagttaccacccttttcctagaaatttttgcaaaacctgcccctttattttcatgtaattaaaagtgggcataaatacgactgcagccctgcctctgagctgctgctctgggcacactgcctgtggggagccctgctctgagaggagcagcacctctgccgctgtgcacagccacttccataacagttgctgtccagcaccaccgtctcccccttgagttctttcctgggcaaagtcaagaacccttccaggctaagccccagttttggggctcccccatcttgcgtcactagggtatctttttccaactctcagctccatccactgacccccttcccccagcatccatccagtggatgtctaaccattttgaaaacctttctcaaggccaggtgtggtggctcatgcctgtattcccagcacttcaggaggccaaggtgggtggatcacctgaggtcaggagttcgagaccagcctggccatcatggcaaaaccccatttccactaaaaatacaagaattagctgggtgtggtggtgagcacctgtaatcccagctactcgggaggctgaggcaggagaatcacttgatcctgggaggcagaggttgcagtcgcaccattgcactccagcctgggcaacaagagcaaaactctgtcaaaaaaaaaaaaaggaaagaaaagaaagaaaaaagaaaagaaaagaaaaagaaagagagagagagaaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaataatgccatcgtggcaaaaagcgttcactgaaattaccaagtaagtaaagccaacatttcagctagttccatggggatgggggaggtggagatttaggtttcaggacctgtttctctgttcaaagagaaaggggcctcggcatctcaagcccccgagctccatgaccatctctcacacactgtcttcacctcctgtgttctcaggcagctccatcgactcagtgaccagctcctccgctgccagggctctgaggtcttggctgctcaccccctgggtttgccccactgtttctgatcggcctcctttgcatgtctgcacagccctgcccttcctccttcctggatggcccctccttgtggctcttcctgctgtttcccatcacccggccctgctgctgtgaggagttcagtccacctgggattgcagtgctggcctggcagaggcttcccttcctctgtggccctggctgtgccagcctcctgtctgctgccccacagcctgtggcctgtccactctacacacggtgccttttgtccctgcgcccatcccaattcctgtccttctcactcttccttcaaaacagcattttccaaacattttggagtgcagcttatggtcagaaaagcatttttatcacaactgtgcgtgtgtgtgtgtgtatgtgtatgtgtatatgtgcatgtgtgtatgtgtgtgtttgtgtatatgtacatgtatgtgcgtatgtgttttgtgtttgtgcatgtgtgtttgcatgtctgtgtctgtgtgtatgcatgtgtgtatgtgtgtgcgcattatgtgtgtatatgtgggtatgtgtatgtgtgtgcatgtatgcatgtatatatgtgtatgtgtgtatttgtacgtgtgtatgtgtgtctctgtgtgtgtgtatgtacctgtgtgtgagtttatgtgggtatgtgtgtacatatgtgtgtatatgtgtatatgtgtatgtgtttatgagcatgtatgggtgtgtatgtatgtgtgtgtgcatgtgcatgtatgtatgtgttaatgtgtttatgtgtatgtgtgtgtgcatgtgtatatgtgcgtatgtgcgtgtgtatatatgtgcatgtgtgcgtgcatgtattgtgtgtatatgtgtatgtgtgtgtatgtgtgtgcatttgtatatatgtgtatgtgtgtgtctgtgtgtgtttatgtgtgtgtgcgtgtgtgtgtgtgtgtatgtgtgtgtatgtataactgaaacaaaagtttcacaaaatagcatgtagtctgcgccatgcaatctgtttattttccattctgttctattaatacttcatttttataaaacgtgttggttgcaacccacgaaattcatgccctgacccctgtgtgtcactagcggcagcccagagccactgcagcccacagcccagtcagcgcctcccccgaagcctgcccacatccacagacgtggtttggcttctgccgtgtgacattctcgctctccctggaggttccctttgtgtccctcgtcacaggctctgcttacatgcgtgtggttgcttcccggatgtctgtgctgcactctagacggtaggctctgtcaagacaggagcagtgtctgctgtttgtccatgattcctcaggagagactcccaggagactttctcctgtgcccccttcttgtgctgactttcctatcataggaggtggggcatcaacagacggagcctttgctctctttttcagaaggaccctggaccctttctgcatctccctttgcagatgtcagctgccattctagatggggggggggcggtgcagctgtgacatccccacagcacatacagctgtgaactcccagctcctcactgagcacacacccgcctccaccgtcctccggcaccgcccacgagtcctgcctccctggggtccaggatgtcgggctgtgggagagcctccttggcagctcatgaggaagaactggagaccttggtgccctgcaattcccaggtcatgactacccaaagagtccacagttgagcctgagctccctgcccaacacaggccaaccctgacctgtcattcagccccagcgtctaccagcatgccagcatccaagagtcgcataaccgcctgtgtgctaaacacatgccaggagcaacaaacaagtggcgagcagtgagaccagacttcagggctgggaagacagctgtggagggagtcaggcaagagagggctcatgaaggcaatggacacgggtccaagccacctggattcccgcctggatgaggcagccgcctccccacgggcctccccactacggttcttgtccccacccctgctctctccaacactgcagccttccaaattctctcttccagagtcagagccacgatcgcctccaaggccacaaagcctgccaggtttccgttccccttctgatggctgcaccctctgccctggctccctccgccccagactgaacgcttcctcgcagtttctgaacaggccagatgctccagcctggacatctctaccgctgctgtttcccctgcctggacctcaccctcttccctctgggaaaaatgcggctgccccgagtcccccagcccctgctcagatgttacctcctcagtgaggccctcctcgagggtgccatccgaaatcacagcaccccttccctggatctccatccttctctttctccactgcatgcagagatttgtcggctgtgtccatcgatgtgtggcatcacctagacgggttccaggcactctgtaagagctgctgaatgagggcccgagtgctggactcaaccaggcttgcaggataaggcagatgttgtgggtggaattgcctctccccaccccccataggtcctcacctccaatccctgtgaaactggccttatttggaaatagagtctttggcaggccaagtggagatgatgtcgttaagatgggccctaatcgaatatgatgtccttgtcaaaaggggaaatttggacacagggcaggtatgcacagaaagcagatagcgtgaagacacagggagggtgcccgaggccaccaggaccgggaagagaggcccagagtagttctccctcacatgctcagagggaaccaaccccgcggcaccttgattccagatgtctggcacccagaagaatgagagaatgcacctctgtggtctaagccacccaactatggtacttattaccacagccttggagaacacaaaaacagcaggatttcatagtcacacttgctaagggtgggagagaaagcctaatatgccaacatgtgccagccgcaaggccacaccatccatgcaaatgccttatttaacgcctgggatggaaaccccggtgtgcgtgtcctggctgtgccatcagctgtacctctgtcggccactctgatctacacaaccagaagacaggggtcggaggaagattgaaggaattaatctgcaatagccagggcaggtaaagaagagccccgtcatgcaaggtgttacaggcactgttgacagagtttcgtgtttgtcctgaaagtactgggaggccactggagggctttgtgcaggagggagttccgtggagggcagattggaggaatatggctgtgattacaatagtccaagtgaaagatgcaaggagcctgctccagggtggggttagaaatggagaacagtggtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaagtccaagatcaaggcgttagcctatacatttcctggtgacggctctcttcctggcttgcagatggctgccttctcactgtgtcctcacttggttgacagcagaagagctggttctttgttatctcttatgattaggggcaccaattctattctggaggccccactctcatgacctcatctaaacctaattacttccccaaaacctcatttcctgacaccaccacattggggggcagggatccgactcagtccacagtagattctctttccctttagtgatttctgttgaatgacacattctgttttctttcccagctttttattattattattttttcactgttggattgattcttgcagatgctctaacctctctacaaatgaatgcatctcagggcaaatgacatttccctgcagattcaattagttatgaaggaaagtgggatctgacagcaagagttgggataaggcaatatgccagctgttcatacccacattcttgattattctgcagaatagattcattttgaagtcccttaaaagcattaatacatcacaagggcataaattctctatttctcatgtatcataacctcaaaaaactgaattcttattaattttttactttgtctttcttgattaaaaaaaaaggatgcttctttttaatcctataggcggaacctaagatatgtgttcagtattgaagtgggttattcagtgtcctatttgagcaaccacatttgaaatgataggtttttcatcatttcagtgcttcagataaacagttgtctattagcagtgaagatacaaaatagggcagagatccaaccctgccctcaaaacacttacagtcaatatcagtcaaggttcttaatgtcaagccacagaaagccactctggctaatttaagcagagaaaggatttactaatttaagcagaaaatagttattggtaaattaataaagttagaaagtagaatggtgttttgccaagggctaaaggaagggagaatggggtgattgtttaatggaaaaagagtttcagttttgccagatggaaagggtcctggagatggatggtggtgatggttgcacactgtgaatgtatttcatgccactgagtggctaagatggcaaattttgtgctatgtgtattttaccacaatttaaaattaaaagatattaaacagcaaatataatttctaggttagccagagaacaaggctttgtgggttcacatgcaggagcatgatgtgggctcccacagtagaaacagacactgccatgtgtcctgagggcttccccaccaggacgacctctggaggccgatccattgctcgatctctcagggtggatcccatgcaatctctcctttcctccactagtgacaggtttaaaatctccagtgcatatctctgatggtcagagcctgggtcacctgcctgccagcagcttcaggagagtgtggcatctccatatctccagtgggaggtaggctttgctagatcaagtgggagactccctgggactaagacaggggtcagagcaggtggatgtagcaattatcagcactcttcaccaaatactttcacctcccctcttcttgcccctggtagggtgtactttccacttccttgagagccatagcagccacatgacctgctttggtcaatgaagtataagtgcaagtggcttgcaaaacatctggcagaaagcttcaaaaccagtgcttggttttcccatgttttctctcttcccctctgccttagaaacccctccacaatccagatgagtcttctctgccaggtcctagaatggctgcagacaactctcagtgaattcgtaacacaaagtataagcatttgttcttttaaggcactgatacttggggcttatttgttactgcagcataacctagaccatcctgactgatacaagagcccaaaggaatcacagtgtttgctgaacaaagagtaaaagcttcaagctggctgaaagactgttagaaacaagcttttcctggcaaagaaatgttagctgagcaatgtgtcatttttagttattccacatgattaatttggtgatcagtgtgagtgttagttgtaacagtaatattagtagcctgtgaatgactcttctttctcaatttagaatgcagaggactttgaaactgtcaaattgtgttcagtgaggacatgctcacggttcctatgatacaatccattttacttgggagatagtgttttcagccacctggtgggaatgacctcacttttacaggtcaggccttacttgcttttaggtgagcatccttcaaattaaattagtggtttaggattcatcgggagggtcctgggaacgtcagcagcatttcctcatttaccctttgatgtgggaatttcctgtgcccctgaagtccttcccttaagacagagttgcagaaagaaacacagacaggcccgcagagggggcatctgaatgcctggctggctgtgggtgtagtgaggggcagcccacatgggcacaggccatctccctctcatttcccaccgttcctgctttgaacgctgaaactggacgaaggccaatttaagcaaagcccggcacatctctgcaattgatcctctcaaagtggctggcgtgcagacctaaaggccgtggagagacagcgggtaaattttttaataactccctgggttttatgtccgtctcccatcctacagatgagaagactgagacaaagataggtcaggaacctgtggcctcatattagagcagaatttttgacccaggcagtctctttcaggaatctgcaaaatacagtgcatgtgtgtattgcaaaaatacttttggttacacagatacggtggtctctccaggtgtacctgtattcacacacagcaccgctgtcatgggggtaattttgaattcaaaggacaaactgaatgatgtctgtataagtttgagtgagagatcccgaatttctaatatgtcatatcatcatcaaatttttctttacactattttcacactaagtttgtctttctgtttttctgtgcctgagtgaatgtaatgggttgacaaaaccaacacaggacagtgtcacgtgttgtttctataaaccatcatctacagaggcagcgcagtgtggggtgaagtcacgtgccctggttcgaatcccggatctgccacacggtcctcagctctttcagtgcttcagcttcctcatccataaaatagaaataatattatcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacctgtttgagaggagagaaagaaaccaactaaaaagaaagggtgaaagggagggaggggaagaggagcagaaagagagggaacaaaccaacaagggtctatgacaaatgacttcagagtaaggggtaggaaacaagacatgagatccttgagtcagagacagaagatgtggtcagaagcaaaaagagtataactggtacccattgcccaagctctaattccaaaggagcaaagtgaacgggaccagtgatgccacacacacacaggtggctgaattggagcaggggaaacctgggctgagggaccccggagtcctttataatgggcagtaaccttgtctgacttttgccctgaagcaagatattatttttatgacgctggcctgtaagcatgcctgccctctgctctgaagggagacaccatctctaccttctggggcagtctgctgtacaaacaacctcacaaacatcatctggacaaaggtagtcagtactgcttctcaccagacaggtagaaacacaagacagtggaccactgtctcacagcactattttcaaatgtattacattccaaaacctggaaatgaagacatcagaaaagattaaaatacctattctatctgcagtactaagagtacgaagctgagtaacagaaaaaaacttgttacaaaactaaaatactaatcacagtgctgattagattgaacaatacaccagaaaatcacaactaagcttggttactattttttaaaaacttggggttcatgttaggagctctggtttccaacaacatggtaaattaaccctggctactaagtggaagttaaattatcaaatggcactaacttagaaattttataaaatacacttctaaagaacccgtgtatcagctatagagagagagagctggattacaatgaaagcacgacaagcttgcaggatgcagggaaagcaatgcttcaagggaaatttataactttatacgagaaaagacacactaatgaacttaagatgttagataggaagaaaagataactgaagaaaagagataaagagtagaagccagtgacacagaaaacaacaatacgaagttgatgtgaactaactttgaactagactaaaggaaatacagctggaaaggctgatcacaacaaacagaagatgttaataatacttttaaattaaaaagaacataatcatacagccgattttataaagatgaagtattatcaactctctattaataaattagaaaacccagaaaaaaatagacaaatgcctggaaaaagtgtaaaataatgacactgattaataaaaaattgaaagcttaaaaaaatgataagtacaaatgaaaccaaagtaatagttaaatttttttccataagaaaaacttcaggcctagagagtttaacaaaaagaatcctaccaaatactcagatcaccccaatcttatataaacccttccaaaaaataaaaagacaacacccttcaagacattttaagagaagtgtatacctggatacaaaaccaaagatagtaaggaaatgaaaaaattataagcccatttcatcatgaatgtaagtgtaaacactctaaacaaaatgttagcaaacaaaagccaatggtatatttaaaaaaaagaaccaagttagtttatctcaggaatgcaagaatgattgaatctgagaaaatcttaaactaacatgaactatgttaacagaataaaagataaaaaccatattatcatctcaatagatatagaaaaactaaaaaaactcaacagaaatgcctttgaaagctcttagaaagctatgaataaattgttaacctggtaaaaggtgtttataaaaatcctataatggatgtaatcttaaatggagaaaatttaataaagtgaaagcataaagattggaaagaagaaaacagaattatcattgtttgcagaggatacaactgcctacatagaaaacacaaaatactacaggcaaatcattagaaataaaagtgtattaaagcagctagatgtaagatcaatattaaaaagctcaattacatatacttgtaaaaattagaaaatataatccttaaaacatttacaatggcaactctaaaagcacttaggaataaatcaaacaaaaatgtacaatatcagtacacagaaaattatgaaactttatgatgaaagacattttaaaactcaagtaaatgggataataagccatttggaggatggtaaaacctaaaatcgtaaagattgtttactctccctacatattcctattgattctatgcaatttaataaaatcttaaacttttcatgaatgttacaaatatattctaaaatccatttggaatcataaaggaaagtgtcctaccagacatcaggatgtaggtaagtatagtaattaaaacaatgggatgctgatactgggatagatcaactaactgatcaatgacaaatggcccttcacatttatggggctgtgatgtgtgagtgaggtttaaatggaagatcagtggaaaaaaagaagccaggcaaggtggtgcatgcctggagtcccagctactcgggaggctgaggcaggaggatcacctgagcccaggagtttgaggctgcagcaaactatgattgtgccattgcagttcagcctgggtgacagagcgagactcaaaaagaaaaaccaaaatgaaaagaagacattcttcaggaaagggacatggaggtggaaaacgactatgcattccatatggagaaaagggaaattgttcccttattttagaccatgcaaaaatcaactcgctctactctagagatttaaagttataaacttctaggaaaatacagatgaacatatttctgactttgggttagagcaaaagttttaaaacacagaaaactctgtctataaaagaaaaactggcaaatttggacaaggatatgctgtaaattttattaagttcaaaaccaactaaaaataaatagtaattaatactgacccatgtacatttgttaaaactttttcaacaggcaagggaatgataatttcaacagcatccactttggcagcagagaggtcaggagacaggaaggggtggtgtgcatgggtgaatggagacaggaagggggtggtgtgcatgggtgaatggagacaggaaggggtggtgtgcatgggtgaatggagacaggaaggggtagtgtgcatgggtgaatggagacaggaagggggtagtgtgcatgggtgaatggagacaggaaggggtggtgtgcatgggtgaatggagacaggaaggggaggtgtgcatgggtgaatggagacaggaagggggtggtgggcatgggtgaatggagacaggaaggggtggtgtgcatgggtgaatggagacaggaagggggtggtgtgcatgggtgaatggagacaggaagggggtggtgtgcatgggtgaatggagacaggaagggggtggtgggcatgggtgaatggagacaggaaggggtggtgtgcatgggtgaatggagacaggaaggggtggtgtgcatgggtgaatggagacaggaagggggtggtgggcatgggtgaatggagacaggaaggggtggtgtgcatgggtgaatggagacaggaagggggtggtgtgcatgggtgaatggagacaggaagggggtggtgtgcatgggtgaatggagacaggaagggggtggtgtgcatgggtgaatggagacaggaaggggtggtgtgcatgggtgaatggagacaggaaggggtggtgtgcatgggtgaatggagacaggaaggggtggtgtgcatgggtgaatggaaacaggaagggggtggtgtgcatgggtgaatggagacaggaaggggtggtgtgcatgggtgaatggagacaggaagggggtggtgggcatgggtgaatggagacaggaagggggtggtgtgcatgggtgaatggagacaggaaggggtggtgtgcatgggtgaatggagacaggaaggggtggtgtgcatgggtgaatggagacaggaaggggtggtgtgcatgggtgaatggagacaggaagggggtggtgtgcatgggtgaatggagacaggaagggggtggtgtgcatgggtgaatggagacaggaagggggtggtgtgcatgggtgaatggagacaggaagggggtggtgtgcatgggtgaatggagacaggaagggggtggtgtgcatgggtgaatggagacaggaagggggtggtgtgcatgggtgaatggagacaggaaggggtggtgtgcatgggtgaatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtattttttgtttttgttattgtttgttttggttttgctttttttgagatggagtctcactctgtcgtccaggctggaagtgcaatggcatgatcttggctcactgaaacttttgccacccgagttctcctgcctcagcctcccgagtagctgggattacaggcttgcaccaccacgcctggctaattttttttttttttttttttttttagtagagattgggtttcaccatgttaggctggtctcgaactcctgacctcaggtgatccacccaccttggcctctcaaagtgctgggattacaagcatgagccaccacacctggccagtaaagtttcttttaaaaggcagccttgtaagagttttagcacaagcttttcttggcctccttttcttgaccggcgtgaagttttgcatcagaagctcctttggaaggcagagcaaaggaaatgtatgctcttatcggtggatttatctacttttaaatttctcccatggcccattttactcactttcgatgttttctttttcttcttacaaatgtttaggtctgcaaagtcattcaaaattcagtgtatctttatttcctggtctggtcactgtattctttaatattatcttccctgggatcaagaaagtcactttgctttgaaacggtctccttggggagctgacttacgcatgcagaactgttctcacacctgcctggtttggaaaggcaccaggatacagaagggagactgcattaaagtcacacaggagggtgggggtagctcaaaaatcacagactcaaaggaaaatgatccaatatttcaaacaaaatcatgtctcatgtatttctgctccattacaatagggtaagttagatctagtcttacagggactgctatcttagatgtggaactctctaagtgcttaaaacgtcttctatgttattacatatacaaaggagctctttaatacagcaactgtctgtgacacggaagtcatatctcgattttctttgtcgactaaaaccactctaacctagaaagctacaccactactgaagaatttaaccagcattccccacaggtgaatgggcactaggtatgattcaattttaaaaggaaactgttcattgactaaattaccgaaatagtctacctgtcttctgttagtaccgtatttttatgactttttaatacatgcaaaatgtttcttgagtaaaaggctgtgcagtatttcctttaaaatggaaagatcctttgtaatttataaataggttcatctccccattgttaagctatgaataaattccattgattcatggctttagaaaataaactcttcgggatgtaattactttttcaacaacttctcaacaaattcactgccatgaagtcttattatgtgctccataaaaacaaatctaaaatgcaaagctaatgaaccaaaacatcatgcaaatctgagatgaagtttatgaaacatagggaagatgtatgaaggactagcttcatgcctaaactctgaatatcgtgacttctatatatgtagccatgaagtcatgtacaacagctaatggtaagcaaaagttgattggctggaaaacacagcatagaatctcaattttcatatttatccaacaaacacttactgagaacctactgcgtgctagccataagactgtctctgttctcatgaaattagcaattgcagtggacatacaaatgaataaacaggcataacaagaaggtccaacattaaattctttttattgggcgaaagaatagggtatgatgggaatgtgtaaaagagcatgttatagggaagttggaaagtttaacatagaaatgacatttaaactggtacctgaggagtaaacatgacttagccaagcaaaaagtaaaagtcactttaactattccggacaaaggaaaccatatgtgcaaaagctggtgtgcacgtgagaagaacaaatttcagggaccgaaaaaaatgtcagtatgaagtgattggagtgaagagtctgtgcatctggtagcaaagataaccttggagagagaagcagagaacaggcaataaagaagtgaagagatttgtagctggagcaatggcgataaggaaggaaaacgtgcaccagcttgagaggcctttgggtctgataatagaataaacagaaccagatgcttgggtcagtagaggggctgggggaagagtagagatgattcacagattttaggatggaccaggataaggaacaaagaggagggaggcggcagggaaggaaagagctcccttttggacttgctgagttatccagagatgtctgagagaagatgtacagttctcagctggatacatgactttggagctcagagtcgtatgagtccatgagttgagagtcatcctcaatgactggtgtctggggctgtggaaggagaccacatcgtcccgtttgctatagtaagaaccaaagaggaccctttggcacctgttgtttaaaggttaacagaagaacactcaaagaacactgagatggggagagtgtcaaataagtcaacaagataaaaatggtggaactgtgaagatagacaatgttagcagataggtgaaagaaatgagtcagcaaaataaactaggaatgagtagccagagaggtgagaagaaaaccaagagtgtgtgatgccaaacaaaaactcaaaaacagagcaccttaaaaagaagaatggttccgatacgacagcgtgaccaggaagaacagggactaaagattgtccattgggttcagtgatgggagaggatggttggggaggaagccagaggttcactaacagaggcgggttgagtgaagactggtaagagagggagccgaggcgggaatctacacagcgtcttcaaggagtgaactgcgaaggcagaaaagcgattatgcgatggctgaagggaaatcacttggcgggagtgctttgttttaagatgggagggactattttaaaggtccttcaactgatacctgcaagattccacagggcaaagatattgtaaacatacatttaacactcactgcactttagattatatatttacagagccacacaatgaatttacatctctcaaaatggaaattgatcttttttttaaattcagattcagtgactgcaaaaccctatgcagaaatatctgagtaatgaagatgttagcaaacccagcatggtccctgggcgtggctgctgtgggtttgtttgtttttacatttacactgttagaccatgcattgaacactccctattagaaccacagaaacccactggaaagagcctttaaagctaatcttatctgatttgttcttacatctcctttatgtatccccatcaagaggtcattcaacctgtgcttgaaaagctctgcggaccaggtattgacacatttcagaagtggcttgctctgtcctaaagcacttctgatttctagaaagctctcccttatgtggaattgaaattggcttccctataccttcttctgcttaggggtgatgaatgtaacttttcaggtcaaacttcctgggttcaaacccctgctctgccactaacacatcacgtgacatgggcgagtctcctatctctgttgtctccatgtatccatctgtacagtggggatgacgatcagaggcgacgtcacaaggcccctgccaggagtaacctgggtgctacatgcaaagcacctgggactcagcactcggtgagcattagccattatcacacccatcctgttcaactccatgggtccatgaagggaaaacaaacacaccagggacatctaatagtctcgacatgttctaacccttcaaacatttcaagaaaattctcatgtggctgcatttttctcttctaaatatcctaagttccttcacagcgtctcatctgacatgaatttaaattccttcgccatcttgtttacactcctttgaacatggttttatttatatccccttaaatcccatttatttatacccctctccttagcagtgtggtgcccggaacaggactgaatactccaggatggtatgtcctgagagacagagagagggcttattgcttcctgttttccttatgttgaagtttcgctagagctgcctaagacaccggtgctttttcgttgttacagtcccagcccacggctgaagcatgtggaatacacgacagtccctgaaacaacactgcctattcgcagtagagtgacgattctgtggaaaaactccctgtatcacctcccagctcatcccaccaacctctgtgtgccttattttccccgtgatgaaatgatatcatgataaccacgcctgtctcacagagggagtgaggatgaagaaggtttaatgtatgtcagtgctgggcagtgtgcccagcagagagtaggcctgatgcctgatactaatgttacctagcagtattattattattattattattattattattattattattattgagatggagtcttgctgtgcccctcaggctggagtacaatggtgagaacgcggctcgctgcaacctccgcctcctgggttcaagctattctcccacctcagccttctgagtagctgggattacaggtgcccaccaccacacccggctaatttttgtatttttagtagagatggggttttgccatgtcggcaggctggcctcaaactcctgacctcaggtgatccacccgcctccgcctcccaaagtgctggaattacaggaataagccactgcgcccagcctattattctaacaatattattttatcctaagtgcagaatattacgcagttctgctgcaactcttgttttgaagatacacgtttgttccaatgcagttgagatagtagggaacgatttgagctcagccccaaagtcgtatttgctcatgggcaatttcatctgtgataaacactagccgaatacagaaaattgcatgggctgaacagagcagcaaagaaatgtacaaaacccacacatgtccacgcctcaaacatctaccaacgatttcagttcactgagattttaggaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattgttttgaacatgtaaaaaatttgcataggtgacagaggaattaatgctcattgtaaaaaacgtgaacaatatacagggtataaaccctggaggcctccctgctctctcccttccatccccacagcaggtcttcttcccaagcggctggtggtcaacaccctgctgtttatccatatccccccctgcgccttttcctctccatttacttggatttgtgtaaatgtgtccatagagagcaatcgtctgtgatttttattttcttatgtaatgatttgttctatggatcatttcttggtggcgcaggtggatctcactccatctttttgcttaacttttattttaggttcaggttgctaggcctctttctggagattagtgtacgggtttgttatagaggtaaactgatgtcacagggtattgtacggattatttcatcacccagagactaagcatagtaccctacccagtagttattttttctgttcctctccctactcctacccttcaccctcaggtaggccctggtgtctattgttcccctctttgtgtccatgagttttcatcatttagctcccacttataaatgagaacatgtggtatttggttttctgttcctgcatgagtttgcttaggttaatggcctccagctccattaatgttcctgcaaaggacatgacctcattcttttttatggcagcatagtattccatggtgtatatgcactgcgttttctctatccagtctactgttgatgggcatttaggttgattccatgtctttgccattgtgaatctcactccatcttcctaatgccccagtgtatttagctatgggaggttgttctgtttggggacttgcaaaccagcatctaacattcccaaggcaattaccaagagtcacctgagtccagctccttcctaatcatggtttgtatgtgtatatgtttgatcattcctgtttaattcatagttaaccaaaatggttattcagttcatctacaatgaagtagcaaaagagagctaggcatttctcttggtattaagagtgaatcattatagttgccatttattaagcaattatgatgttctgggatttttagctacattctcttggttcctcaccataaaccttcatgataatattaatgtccacattttatagaggtgggggctgatatgaggagtgattaagtagctatcctgtgttgacccagctggtgaccggacttgagttcaggcacctctgacattccagtccaggctttcttcaccattatccagtgactcttaaaattttcaggaaagaatgttactcaatgtccttgggtcgagtctttagtattttaactctcacagttgaaacacatctctttttttgaaagtttttcctgatatgtaacgtaaggctccctgcatccagctgaactcttctcagcagggagaaggatcagctgagcgtacgacatcatcacagccatcactgtccatcacgacaccgagtgtcttgtacattcccttatctgctatgtggcatacttggacttaactgcaatttgacgaacttccagacagaagctggtcccgacggctaacacttgcagtctaccgaaaatgagaagaggcccctccagtgttttgggtgggagaggtgctcacggaacccaggccacagcgttatcctgggatgcctggcgagcggctaggaggaagttaaagtggcaaaccacgtgcaaggcagcaccagagagtggatgaccaagaggctggatttgggggctggattcctgggctgtatttgggcaaaggacttccagtctctaagctgtttctcttactgccttggaggtagtagaaggaatttatgaagcagccaggtatagtgagcttttacatattaagaagttcatcaatatattcaattttgtagcttacatttcatgaaaattgataaattttaatagttttaaactgatggggtcatggtttagagatggtttcatgcacgagccccacgttacagcctcctcccctctggggaggtgtgaaaagtgtcatggagagggtgattcagtgtcctcagggccagtcagggtggaaacagacagtcgaagaaataaaaacatcaatcaaggactggattctatcctatgcttcaaattcagcaagttcagaaacatggacctacatttactcctgtccaaagcaagccctgtgtgggtaaaatgcacgaaagggcagaagggaccggtcatcggactcagcatgaactgtgtatgatgtcatccttcatccaaatctgtgtatgtgaggcacactttgattgtgttttaggcagtgtgtgtgctcaagatctccaattctcagagaaaaagcaggtgtatttgcaattccttacctgaatgcaagctcaaaaaacatgtgtttttgacctctggaacccagtggctagggctgagctggacccacagtgggggctcaggagaacttggtaagacacgtgcaggtcagcttcctccatgggaagggtttcatctctttcttgctttctgatgttgtgggttgactttggtaattgccaacttcttagaagaaatgggatgcttagaaatgatggtttttatctagagggggtgaggatgctcctttctgttgaaatggccataaagtaaacgctataaaggatgtgtcttctctcagatttccaaggaccaatggctagttggctttggtgctttgactatgtcaccaaagtgactcatgatctattcatgaagttcagcaagttgaataatgataaagcacagttgctatgcacctgctgtgtgcatatcccctatttaatccacaccatgagcaaggtaccattatcaccccattttatagaaaggcataacctgcccaagaaggatggggagaacttgaccccagcggtctggcaccactgtacacatctaaccacagaaccctacagccattctgtagcagagatacagcacgatttgtctccactgttggaaattgtatcataaaatatcaaataagaaataaataaatggatgttcatggacaggagggctcaatgttgtaaagatgtcagttattctagacttgatctatatatttaatgcaataccagtcaaaatcccagcaagttatcttgtggctatcaacagactgattctaaattttatatggagttgccaaagacccagaacgatcaacccaatcaatactgaaggagaaaaacaaagtgagaggactgacgctacccaacctgaagacttactacaaagctacagtaatcaaagctgtgcagcattggtgaaagaacagacaaacagatcaatggaatagaatagagagtgcagaaatcagcccacgtaattatagttgactgatctttgacaatggagcaaaagcagtgcaatggaacaagatcatcttttcaacagatggtgctgaaacaatgggtcatccactgtaaaaaatgaagccagccacaaaccttacacccttaattcaacacagatcacagacatttataaacataaaatgcaaaactgtaaaacacccggaagaaaaaggaagaggaaacctagatggccatgggtttgctgatgactttcatatataacgccaaaggtgcaatccatgaaagagataattgataagctgaatttactaaaattaaatttctaggccagctgcagtggctcatgcctgtaatctcagtatgttgggaggctgaggagggcggatcatttgaggtcaggagtttgagaccagcctgtccaacatggtgaaaacccatctctactaaaaatacaaaaattagctgggtgtggtggcaggcacctgtaatcctagctacttgagaggctgaggcaggagatcacttgaacccaggaagcggaggttgcagtgagctgggatcccactcctgccctccagcctgggcgacagagtaagaccccatctcaaaaaacataataaattaaattaaatttctgccttgcaaaaacagtgtcaagagaatgagaagatatgccacagactaggagaaaacatttgcagaagaaacatttgataaagaatgttatctaaaatatacaaataactcttaaaattcaacaataaaaaatgaataacccaattttaaaatggaaaaaaaagtcatgaatagatatctcaccaaagaagataggcagatggtaaataagcacctgaaaagatgctccacatcatatgtcattagggaactgcaaactacaacaacgagatagtacacatgtattattataaaatggtgcaaatccaaaacattcacaacgcaacgtgcttgcaaggatatggagctctcattcattgcatgtattttcacctgggaagaccgtcatgctccttggtatttacccaaataaactaaagacttaggtgcacaccacatgtgtatagcagctttattcataactgccaaaactcgaaagccaaagccaccaagacatccttcagtaggtgaatggataaactgtgctacattgaaaagatggaacatgattttgtgctaagaagaaatgagctatcatgttatgaaaatatgtggaagaaacttacattcatattactaagtaaaagaagtcaatctgaaaaggctacgtgctgtatgattccgactatgtgacactctggagaaggtaaaattatggagatagtaaaacattcagtggctgccagaggttgcaggggagggaaagatggatgggcggaacacagaaagcttttagggcagtgaaagtactctgtatgataatagaatggcagatacacatcattatacacttgtgaaaacccataggatgtgcaacaccaagagtgaaccctaatgtgaactatggactgtgggtgatactgatgtgtcagtgtaggggaaatgattgtaacaaatggaccgctctggtgtagaatgttgatggtgcctctgtggatacagagggtacatgggacccatctgtactttctgctcaattttgctgggaacccaaaactgccctaaaaaataaagcctattaatttagaagaagaaggaggaggaggaggaggaggaaagaaggaggaaagaaggaagaaagaagaaaggaagaaaagaaagaagaaagaggagaggaggaggaggaggaaggggaatgggaaggggaagggggagggagaaagagaaggggaggaggaggagaaggaagaagaagaaggagaaggagaggaagacgaagaagaaggaggaggagaaggagaggaagacgaagaacaagaagaaggaggaggagaaaagaggaggaggggtaaggggaggaagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaagggggtagtgtgcatgggtgaatggagacaggaaggggtagtgtgcatgggtgaatggagacaggaaggggtagtgtgcatgggtgaatggagacaggaaggggtggtgtgcatgggtgaacggtggctattgccatggtttagttccaggattgggagatgggctcaagggggcttattattaaggataattatttccttattatcatttccttattaataaggaaaataaaagatatgcaggggtcaatgataaactcttgtaaaacaaggattatgacagctccaattctgagcatcttagcctttctaaaagtaaaaatgaaaaaagaaacaaacaatctacttattcctgtcttaacttctcccatggcatccaaataagaggatcagagacaaagtctgaagcaaaccacaacattcccaaaccacagcatgtgtggtactgatggcggtgggttaggtctttggacagacctgcacagggagattcagaagaacatgcagcaaggagcttcagaaagtttcatttgaaaaacagacatctattaagatagacaagtaaaggactgatatgtttttaaggccagatttgcaacttaaatatcatttcagtcacctggtaaaaagagcatgacttttgataggcataaatttaaaattggagggaagggaggagaagtaacatttttcaacagctttaatacccagtttctgaatttttgggacatcactgtatccagaaagccccgagccacagatttcagtgcaaatgtcaaataacaaacatgtctgttttgccttaaaatctcaagacactcctcaaactgatccggaaagctgaaataataagttcttatcatctctgaatgtgcatgcaactgccctgaggtgtggaacatgagaacttcgcagccaatgaaacatctataagccgttcacatagacgcatcttcaggaaaacaggttaaactgcatcatatattaaagcagtacttacattaagttaaaaatatatttgagtgggtgttttgtttcacagttaagtaggtaactatgttaaagagttactaaaatcaggcatttgatgaacgaaagcagcacagcaaatgaactggagcaaagtctaaaaaacccacgtaaggatgttatgaaataatgatttcaacagtagctcatgataatgtttcaacaatgaagaaagtactttaaaagacaattttgaattacacaaaacactttaaattccatccaattacaagctttaagaaagcttctgaaaataaatctgcagcactgtggacaggctggtaaagtgggcagaaatatattaacattctttctcatcaccaagccaactaactacacacttcattatctatggaaatgaaaactaatagttcatcaaaagcaaagactaacagccctgcagtataaaaatcataatagtgtattatggtgagcgtggaagagggagagaaaatgcacagcaattttaccgaaaaagagatgttgtgtttattgtttcggggaattttctctaaaatatctttcccttctccaaaatatttcaaatacaaaaactggaaaatgaaactgataataaaacaaagagtaaataacttcaagatgagcaactgttagattttttattttttaaaaaagtcatctttttattttttaaaaaggtcatctatttagggtctcccctcaggaagataacatgttgggaggcattagaggacaaaggtggacaagactctgttggttttctatgaccaaggtttgttttaaaagatgaaaacatacaatagtttgagtatctgtcctttcatggccaagcttgtataaaaccacgatgcaccccagcagctcttctggaaacatgctgggcatcccaggaaacacttcatatggtaatcaataaagctcctgactttggacttcaagaggtgccattcaacgtatgtcattaacatgttcttgttgctttatgggtgaacatcattttgtaccatttgaagcagcattcacccgtgcctatgtgctggtactcagcgtccttatctggcatgtattcagagcaatcctgatgatctcaactcactggcaacagacatcagttaaagctaggccagtgcctaacttctcttaaaacctggacaaactgaaaaactgaaccagatttcattaattacaaatttattgcttattcttcccaaaatgagttttcctgaacataatggaaatggccatttcaacaaaacaaagtgctgaaaggatagcagttaatgtacatgccacacacacatctgtttgagggttactgtcttcattcgcttatgtatcaactggattatactgtaagtctaataacgttcaccaaagagacatttataaaagggaaaataaaaatcaggaacaaccaaaatttctagcagtggaggaacactaaacagagtatggaagatttgtagtttggaagactatgcactcattaaaagaagagacatgtcatgacacaaaagatgttcatgataattttatatgaaacagcaagttataaaatagtatgatcaagtttctgtaaacacaaaaatatacatctatagaataaaacaaaaggggtcaaaagaatgctgtttctgcagaatgacagagatttgtgttttattttgcatttgtatttccagaaatttctacagtgaaacataacttctgtaataagcacatgttaaagcaaatatgcctcaccacaggctaaatgctttaacaaaaattacgtaaaatttgaaaaccacacgataggtttctaagaaccagccaggggctggtctatttagcacttgatgcctctataatttttgtcttgggtacgtgcatttaaaaagcgccccaatctggagtgggaggtggggagctgctgaggctcacatactctttgggccgcgctatcactagcaaatctggagaagatccctgactgcaagaagccccatcattatattagagggaagtcagagacattttaccttggctttcctgtaggcagatcatagcacttcaagttctaccacaaagatacagctattcgatccccaggaaatccaagtgggggctctggtttgctgttggaactcctagtcactgaccctgattccttgtctcaggagtaaagctgcctccgattctcatagggaacacgtctcctcaatttgtattctaagccagctactgcctgcaggccctggtcaaattaacttgtccctcatgaaatagcctcaccctgggcatatcctcctggtggaacgcaatttgtacaagaaaaatgcaaatctatttatgcatctccaattcaataaaaactggaagacttactatgggttaattcaattaagaatttttcactctggacaacggtaaagacttgatatataaaagctgcacagtctggaactgataaagcttgcaatctatcttgttgagtaatcatggaaaggagaattttgtttacacctaagttgagaaacaaagttcctaaaatgcacttaaacaaatatttaacctaaccaaacatgtgtaaactttcttactatttcagctttccaaaacactgtactactaaaattggttttaaaaataaaagcatacttaacttgggctttctgtagtattatttgactgaaactatgtagagtttaaggcaaaaattcaacccaggttttggccaatataacaacaattaaacagtataaaccttggggtggggggaaatgaggtaaaggggagagaagaggaagacattgaagctcattagcctcagcactacagaaattatgaagacacctgattttatcaatgatttactgagaattcctgaaaagcctaacaaagttattactcagaaaatcattttgcttgtcaatgtggcagtttgcaaatggagagaatggggttaaagtgacgacaaatccatttggccagcaagtggctctggagcactcacatcagaaactgccgtgggcacaggctcagaccacggcggcccaggcccctaagcagcatggtggtcaggaagagggtcagggaatttttgttgaagtatttagcctgcagaggcagcaatgaggagaactcagtggttcacaggtccaggcttaccagacccgggaggcagctagacgactccggggcacaacacacactttaggagctgcaagtggattcatagggttgggacccaaggtccacatgggaagtgaccactgaagatataggttgatccagatcaggaagggcctcgtggcccctgctaacaaattttaattctccaaaggcagtaactttacccaaacatcaaacacctccattctaccttcaattgctcccataactaagtgccacctaacctgttttttaaaaagaggattcaatatatttgcaaaagacctatctgataaaggactgttatctaaaatatgcaaagaactcttacaactcaacaatgagacaacagcctgattaaaaaaggggccaaaaaccttaacaggtaccttagcacagaagacacacagatggcaagtgtgcataggaaaatatgttccataccacatgtcctcagggcattgcaaagtaaaatgacaatatgacaccattacacacctatcagaatggccaaaacccacaatgacaatagcaaacgctgggaaagacgtgaattaacaggaactctcatttgttagtgatgggaatgcaaaatggtacgccattctaaaagacaggcagtttcttacaaaactaaacatagtcttaccttacgaagcacactgcttggtatttacccaaaggagttgaaaaggtgtatccatacaagaacccgcacagagatgtttatggcagttttattcatatttgccaaaacttggaagcaatcaagatgactccttcaagcaagtgcatggatacatgtactggtacattcaaataatggaatattagtcagtgctaaaaagaaatgagccacaaagacacggaggaatcttaaatgcatattactgagagagagaagccaacctgagaaagttacataccgtgtgattcagaatgtatgacatctggaaaaggcaaaactatggagacagtgaaaacatgagtggttacaacgggttggaggggagggagaaatgaacaggcacagcacagggaggtgttagggccatgaaaggactctgtgtcgtcccatgatggtggacacatacattatacatccgtccaaatccacagactgtccataaaaggactgttatccaaaatacgcaaagggaagggcacaggcaatctctcaaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaggatcagccatttctcagtaaagtcccattttgtttatttgtctttgtttgttcattttagttggggaacagatttcaagatcacagtatggaggctggcattgcccatatctgtttgtctcttgtgaattctaggccttttcaggggacagagctaaacaatatatgtttccatatctaaagctgtaacaaaaaaaaaatctcccaggttcatactgttccttccagtttcacttgggccctacaagtttttcaacttgatatttcctgttttatactagtttgggtggttttccatgctagcaatcctggttctcaagaccacagagcttgatagaatcctagataaagcagcttcatataattattcatttgctgcattccaccaccacacacatagctgtctcagaataacaataccaatactacttccactgaaaatagtaagaaatcaaaacaaaacaaaacgtgtgcagatgtttccccaccagctttccttttgcaggtagtcttcctctatttcccttgtcagggcacacagtgattccacaccaaactttccttactatggcactgaattagacttatctacaaataacttcatgtttagagcacactattagttcttatgtccacagctctctggtcatttttgttgtctaagctcattctatgatagattctcaagaaggactcttgaaagcaatactgcctgagttctcacaggtgacggcaaccttgattctcaaaagtcagttgcgctgggtataaaatccctggcaacattttctttttttttgaattagaaatgctggcattgaaaattttatgacaatttaattttcttttttaagtgacatcataattttgattttattcttaaaatattttatccttcttttgaaaataagtacttttattgaccatttctcattgttagttgtttgggggcaaattacttaggtatgtgatataccctattaatacagagatcagtttttttttatctcaggaaagtttttattgaatgttagtgtttatgcttttcccttgcttggattttcttctttagatacttagattttaggtttacgggatctgcattgccttatcttctaaatttgtcacttctctaaaatctttttcacacttattcatttctttttagttttcaaaatgtcctccttttcaacttctgtaactattaaaagattctgttgtgtttattcactcttgtttttcttttagtttacttttcattactgaaagaaaagtcttttatttataattctttcctgaattatatcatctcatttctgactttttctaattctgagttatatttttctttttcatcttgcactttttaaaaaaaaaaaaagagcaacattttcttctgatcgatgcatatgtttttctggtgtgctctccctctctgtaggtatgtttttctgcttctagcttattttatgtgattatgtgtatgggtttatatctcagttgcttctgtcgtttatctcacatggagttggtttttctagaattggataaggaggcatgtttccaagctcatcttctgaggtccacattacagacctctcatatagttaggctttgtgtccccaccaaaatctcatcttgaattataatccccatagtccccatcattcttatgtcaaggtagagaccaggtgaaggtgattgaatcatgggggcagattccttcatgctgttcctgtggtagtgagtgggttctcacgagagctaatggtttcattaggggctctttcccctttgctcaacatttatccttcttgtcaccttgtgaagaaagtaccttgcttcgccttcaccttacaccatgattctaagtttcctggggcctccccagccatgcggaactgtgagccaattaaacctctttccttcataaattacccagtctagggcagttctttatggcagtgtgaaaacagactaatacaacctccctcttctattttttcgtgttatgcttaaagacatggtggcctatttctgagatttcttatctcttgttttacaatatgcttttacctgtctttgtgtcctctccccagtttagattcccagtgcaaaggtttgtcctggtgggaagttctgtctggtgagtttgggagtctgtagggcccagtatccttttcccttctgaacttgcttgggccccttgactccccagctcttggagcaaagtctctcccagcttcagcttctgttctcacttggccagtgctccagccttaccagtaaacacctgctggttctgctgagacactgaggcctggcaggtgccactgctctctgcttgctcctgacaggagatgtttccacacaggtatgctgacttcgggtagtttgctccctcctcccatgtgtatttcccatttgtgttttgaggttcctgggggatgccttgtcatcagttttgttgtaggtttttgtcatgagttttcagttttatttttgtctctatttttatgggacaattatgagagtgaataaccatgccattgccatttggggatggtatagactgggaagagagaggagacaggaaaagacctgggagctctaaggtttagagttgagaggagatgttgcagtgtgagaacagcagcattgcaggtgccaggagggtttgccagagggtgtggggattgtgggaaatgctccgtgaatgtaggagactgagatgtcccttggatttggaaataggaggtccttgattatcttaagcaattttattggggactgaagccaggtagaacagaaagcagagaggaagaaatggtgaagaagggaatacaggacacatgggcgacccagtagtcccacggttaaacatagaaagtgacccttctggtcttcaagcttgaaccttacattcactgtatctgagcttcttcctcaggaaagaccttcaggccctcaaaaaacttatcaaagaactgaaactccccagatcattgtatccagaaaatgagatgcgggacccctcattcatcatgattgcttccttgcccctcctgggttcctgttttcttacacactgattcatttcttccctgctacataaacccctaatattagttggtcaggaagatggacttgagactgatctcccatctccttggctgcagcacccaattaaagccttcttccctggcaatactcatcatctcagtgattggctttctgtgtggtgagcagcaggacctggacgcagcccctcgtgttttggtaacactggctttcaaggagctggcatggaagggaggcgagtgccctcgtccctgtggtccttttctcccaggcatgttccacactgtcgtccagttgcctggggccttccatgcaaggtaccttccataccagaaggactgaggcaaacccagagggagattaggagttaagagaagccttgtaaaggaacagagatcaattctgtccttcaatgtcctgcccaggcttgtttggatccgggatcagcaccaagactgagactggccagcagccagcagtgggattgacgttgcccagtcgggttttgctacgctgggagaatgcagggagccaacctgcttctctctttttgggagttagagtgtgaaatgcacagagccagtctccacaggtttgcaggccaggaaaagcaagctgatggaaggcacagggatgaccagttgagacaccagcctggctgctgtggtattctttgctcagactgtcctcaaaatcagttccatttctttctgttccaagcaaaccaaagtaagcattataacaatagtcaggaaagaagatggatgtaattgccaaagtcatgttttgtgcagttttactcctgggatgtatttataaggacccttctccaaaagatagaacaattttattcaggtgacaaggttcaacttttaaagccctccactacatatatggacatttgaaaatggaaattaagcacttcccatatgctgtctgattaacggagaatgactgatcactttcacatgaaacggtgagtgcaaacggggaacgtttcacaacgagccacttctctcaatcggagagtcgtttcaatgctatttttgtagaaatgcacattgtgccgagagaacaagaccaaatattctcttcggaggccgccctctggtttttccttttaggtggcaagtgggtccttcaagtagtgggggtacccatgtcaccgcgagtaggtccttcgtgtcgtggggtcctgtgttgcaaggtgtgctctcaggtcactctcctattgtactgacattttcccaaatgctttgatgatgtgcttgagcttcaaagcaatgctggcagtggggtcgagcccacaggctggctaatctgcccgctcattccacaccatctgctttctctgcgtctggaccttggccggctctcagagctcctgtcttctgtgccccttcctgctgggccaacatgtagcatcttcatgttgtacttggccaaggacagcgctgtgatgtggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaacctgggcttgcaggcctgcctactgggactctaaagaaacgctcttagctgcacatccccttgagcacttatcatttctacgtgctgtgagtgttaaaagtcctctcttctaggtatcctcgaaatatacaatacattgctgccaactatggttaccctattgtactatcaaacatgagaacttattccttctaactgttgggtaattgtacccataccaattcctaatgagtactgtacccattagtaatggatactataactaatctcatatgcatccaatacccatccaatatcgaatgggtgttatacccattacccaacctctcttcatctccccaccgcccccgaacacacacacactccccactctggtatctatcattctattctctacctccatggatccatttcttttagctcccacacatgagagagaataagtgatatttgtctttctgtgcctggcttatttcacttacatcgtgacctccagtttggtggcagctttttgaaagcttccaggcactctgtgatgcccctgatggggcggccaggacctgctttctacctgggacaggacactggcctcaccctcactggggcatgggggcagctgccccatgagaagggttctttttgctcattagagcaaatgttggcattataaacacaaacccgtgccatgaggcaaaccctgctccttcaaggaagtcttgaggcttaaaagtcttaagtgactttgcagggcttttgaaggctgagaaagctttcattttctggaaggaatgggagaatagttctttattggtgttgctgatgataataaaatcggaaacacctaagtcactgtatataagcatactctttcatttcactattacagaataattctgatgagttctgtactgggccatcaggttcaattagttcattcatctgtaggatgcctcggcatagtatcttgacttacccattcatgcacttggttgacttattaatttagctctctacttattgacctcagtgggaactcctggcttgaattatgtgttcatttgtttgggtgtttgcttgggatgggtaatatccacacaggccacaggatttagaaggtacaaaagagtataacgagaaaataagttgccttttctcccctgttcttctcctttacctaggagaggcaatgacttttgatgctatcagaaagcacgttggttttcaggatggcttccgtgttcacaatcacgtgtgtgtcacacacatggtaatatgctatatacacattgttctagtcattctcagctggggacagttttgactcccggtgccatttcgccatgtctggagacatttttggttgttacactggaggtggggggccacaggtacctggtaggtggaggccagggaggctgctcaccgtcccgcagtgcacaggacggcccccaccacacagaaccgtctgacccaaaatgacattagtcctgaggttaagaatatctcgcttttatttatttatctttaactccttaagttgtttggactatgattcctcaagcaacttggcaggacgagaagaaagttttaaagttgcaggcgaaccggagctctattttatttctcgatatcctagcacctgccagagaacacggttcttagaagtctctccggcagtatgctttaaatgcataggcaatttgttaattatgggtgaagggcatttaacataagacgaaaggtacagtaagctgttctgtcttcaaatctgaacctcccaattgttctatagtgtagattagaattcgagtaccgtagagaaatacagctctacctgtttggattttttttttttttttttttttttttttggacccaaaaggaaacaatgtaggttaggatgaaaaacttccattttggaggcaaatgttggagaaattagctgcataaaagggtccccaggtccttcacctgtcctctgtgaaaaacaagttattaaaacaagcagaaagcttgcctgggcttttaaacggtgaggccagtcagttaccctgaataaaaggcgttataatacacataactgagagggatagaaggtgtttcaacttcatcaaaaggcttgaaaaggatgacactctttgcatctgtgctttcaggaagtttttcagggctgatatttattttaaatcagaacggcttacaaagcaaaccccctttataaaacgtgtcacatgtagcaatcctggagatgacctctacaattctaggctggacagagagattactcttaagagaaaaaactagatccctttaatcagctttaaaaaaaacattgtgaacagtcacttctcttatttaaaagtttaactttactttcatcaatttataatcagagttcctctggtatgtttgattcctgacaaacaaggataaaagttgtgtgcccccattgctaatgagatgataaaacagcagggatcaagtttttaattactacaggcgatgcactggagaggtaccgatgatattttctattgcatgtctaagttgtaacttcaggcttatgacagtcctgctgagttcgactgcctttgatgatcactcatttttgtctcctgagaacatacaaaaatttctgagctagaatcctggggggctggcaattattggcataacctggcacaggttcccctcttcaaccatcattgctcagtgaggatccagtttcttaatgcctgcccttacaccgaaagggaaattggacatccaaaatgtctatgaactttcatactcaaataatacccattctcacactcccagcatgggctttccgttaataataaaatatttaattgaattgggagatttctagtacaggctgtttcatttcttttcaaagtcatgatagaaattttttagttaaaaccttatttatctgcacatttgtaggtgcatattatatttatcgctctaaactatttaaacatttctaatagtattccctttgttactgcagacagttgataatagaaatgtttaaaggtgccattatttatcaaataaggtcagatgttctcaccctgtttgaaatggaaactaggagtggattccattaactctcttgttcacacaacacacacacatgcacacacgcacacacacacacacatctcagtggttggccagagcattcaacaaataagatttgctccaatccctgtttttagctatgaaaatatgagcagagagttcatgtgatatgtagacaattaccgggccaatctgaatacaaccacccaactcatcaaccaactaactaactagccacaatctttgagcactcaagtaatttcaaaattatgaagtaagaattgagtgtcagaattacaagcattggctgagtttactaagtagtttacatttctaagattttagatcataagcaaaaaaaaaaaaaaaaaaaatgcattctcagctactccattgggaaaaacccataaatgaaaagagatttacaaatagcaaaggtaaatgaactctttttttgtctgtctccttctcagaatctaaattacaatgcccttggggaatttcttctttctttctttcttttttttttagacagagtctcactctgtcatccacgcagtggcacagtctcggcccactgcaacctccgcctcccaggttcaagagattctcctgcctcagcctcccgagtagctgggactacaggcgcctgccaccacgcccaactaatttttgtatttttagtagagacggggtttcaccatgttggccaggctggtctcgaactcctgacctcaggtgatccaccctcggcctccaaaagtgctgggattacaggcataagccactacgtctggccaggaatttctatttttatggtcttttaaaaaaatcacatatgtaaaatataaagaccagatacttgcagcttattttcttcttgacaaaggaaagttaaaaatgttttaattatgcaatttgtgtataatatagaattcacattgcttgtgttaggatagaacagcccagaaccttggtggctggacacagtcgatgtgtactttttgttcatggaagtgctgcgaaggtggctggttgggcagccctcctggacagctgtcctcaaggactggctcccagagtccagtggctccttatcttcttgaatggcagtgctcccttgactctccacatcttggtggtggcagggcacagccaatttggaagatctcctggaagctttgtcagcctcacctggaagtgtctgtgtctgtttgctcacattccattggctagaagggcaacaaggcaccactaagatgcagtaaagcccagaaagaaaatgaattggtttgctaaacaagtgtgaacaaaagttctctgaaaaggaatttggaggaaagagactttattccagtgaacagtttgcaaactggggaaatggagtctttcctataaaatgaaggtgtgttgcaaagaaaaaaaggaaggctcaggttttaaagcgaaatgtcctgcccaggttcccaatcagatctgtttatgcaaatgaagaattgaaacttgcttagttctgattggttgatgcatttgagccctgattggttgatacagttgagccctgattggccaaggcaggtgaactctggttggttggttcatctgagctctgaaagtcccaaagataaaaaaaaaatgtagggtaactcaggagataaaaatgagtgatcatgaaaggccatgaaactcagcaggactgtcatcagccctgtcacactagaacacgtgtgtggcctctagccagcaaatggacgctgggcttagtcttaaagttgggctccgttagccactcaggattcatccaaaggctaagttcatatttgttcacacagcttaggtattttcctgcattaattataataatactctacccatataaaatgctttatacttgttgagggttttattaatattgtctcatttcatcctcagagtttggaaactagacagacactattatttacagataagaaaactgaggttcaaaaatattaattgccttgccagaggtcaaagagtcgttaagagctagaacgaaatgctagtattcttatttctgttttcctttgatttgtgttatatcacatgcttgccgtgatttatgaagcatactctcctttagaaacagttattataaagcaatctgttacagataaacactctcaaaacattttcatcttctgcataatgtaacttcatataaattgaccataaaatcctagtaatctaagctacagaaagctttcttgtttttaatgatcactcgttgacataatttgaagtcttttcaaaatttcataaagtatgaacacagaataaataagtaaccacggttatcaaagtgatagatcttgaaatttgtttacagatcttatactattgaagattatatccatcttaattagagcatgactaacattttcataattctagtgattgccatatagttaaacccttatattccttccatgatgctggtcagaccagaaaaaaggcatacatgttaaaaataatggcctaacattattgtgaaaatatattcatacagttgaataatatagtagatacatgaaaaagctcttttaaaaaaattctttcaagaacacgtagatcagagacctttaatggtcaaattgctcaactatgagaattttttagcaaagcgatttatccaacagtttagatttgggcaggtaggcaggttagagcaggtcgttgctgagtgagttcaaaactagggctgaccatgaatgggccagggtgtgagtgctttcacctggtgactccaatattgtagatattgactgatgcctgcagaatccagccaccgtacccagaatcccatctacattatggtgaatccatgcaacagaaatgcaaagtgttagtgtaggcccgcttccctttcttctaataaagattcatggagacaaagtgtcggggagagcctcatttaaattcagacgtggctgattctgaaggctgtgttgagatttttgaaatctgcaataaattgtgatttttgttcttcttcctgctccactcccttttcccctccttcccctcctccttcctctcctcctccccctcttcctcctcctccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaaagtgacaaattgggtattacttaagactgggtaatgagggaaggcctctttgcagaggtgtcacgtgagcagtgtatcagtctaggttcaggccatatgacagaggtcacagcaggtatttcagcagagagaatctaatacaggaaatgggtaacatgggtgctggaggactgacacagccaaaaggaaacagaaagaaacccagcaatggtaactgcagatactactgtcaccctaggctggggagcaggggaagagatgggtgatcagcacttaaaagctcaaaggaggagcccttggagccatggctcaggtccctgaagagggggtgctatccagtgaatgcaggaacctaatgagcttgaggaggagccccacttctgttctatcagaagctgcttctgggagtgctaaagaagctggaagctggattcactgctgatgttggggtgaagtgtccctggctggacagtgctattgctggggtggctgcaacagggacagcaagcaaagaggtagaaggaggcccttcttgaacctcgtgttttctctctagcaccgagcccctgcccaacataactggttggcagaggagaagcattctctgcagaggccagcccaggaatgctgagcagagcattggagggtaggtttggagctgaaggtgacaggtcagtaaccagcatgcactgagatccagaggtagtgagagaatgagccacactaacacccagggagaaacagttcagacaaaagggaaagcactggcagaacctgaggtgagagtctgcttgtacatttatgggacatggcccatgtgccatgaacaaggggaagtaataatgatttctctaccttcctgatggctcatgtttgcctgacataaatattgacatttccttctatattccccaagtaaataaatagagctgcgttctgccattgtctgtactctaaagagtttctcacaatctggcattaagcctctatgaattgcctaccttctacactccttctgaagctaatcaacgttgccttaaaagctcaacattgccttaaaatttttcaaaaggtcatagagactgataatgccataaaggtttggtttatttctttagcctccatctgggattttccttctttttcctgcctggaatagatgcaggtctggaggtgtggcagccttcttgcagccacgaggtcaccacgtatatgaaagccatgcactaaggagggtggagcgggaagatagtggagttgctgcatcagccaggcttttccatctcatgacttcttgttatgtgagcaaaacaaacccctatttgctaaagccactagagtcaggtttttgttttgtggagacaagtgtaattcctaacagatacttgcaatatctgttggtagggctcagttttggacattcgtttgtttccccagtaccatagaaaaatcatttttttagaaaaacattaaaattttagacattgtcaacataaacctggaattatagaattgagttgtgctctttctaaagagaatccacagttcttttatttagtaatttaaatatctgcagtctcttagacttgataccaagatggtgctgattaaaacaaacactccatgctcaggagtctaattgcaaatgattttttttcttttatgagacaaagtctcattctgctgcccaggctatagttcagggatacaaacatggctcactgcagcctctgacttctgggctcaagtgatcctcctgcctcagcctcctgagtagctgggaccacagatgtgcaccactacacccagctttttaaatttttttgagggattgggggggtctcactatgttgcccagctggtctcgaactcctgagctcaagccatcctcctgccttagctcccagagtggtgggattgcaggtgtgagtcaccacacctggccgcaaaagttttttatgcaggagatatactgtaaaaagttacaagcctcggctgggcatggtagctcactcctgtaatccagcattttgggaggccaaggcaggtgcatcataaggtcaggagatcgagaccatcctggctaacacggtgaaaccccatctctactgaaaatacaaaaaaattagctgggcatggtgccaggcgcctgtagtcccagctactcgggaggtgaggcaggagaatggcgtgaacctgggaggcagagctggcagtgagccgagattgtgccactgcactccagcctggccgacagagagagactccatctcaaaacaaaacaaaacaaaacaaaaaaaaggttacaagcctcaacaacttgcacgggatattttcttctcccagcacagagagctccacccaagccagaggatcatctgaaaatggcctaaagtcaagtgcatcttaaaggcaacaacttaaatagtccaaagatggcaaaagcatgacttggcaaacactacgagttcacaaggaaatttgagaatgagatggcctcaataaaggcaaagtcaaatttcaaagtgaccaggcaggatatccattattcatcaaaacgtaaatgtatgttacaagagtggagcgcaagctgtttgagaagtgttattattctcctgaggaggaagacacagttgctggggaaatgatggttgctttcacaggcggcgtaccttatctaatacagtggattgggtgtgatgacttagagatcaatagaggacaagagctggagccagatgatctggtttaaatcccagccccagcatctcacaacaggatcacctccagtatgcggtgcagcctttctgtgcctcaggatcctcatttgtgaaatggaaactataatagcatctatctcttggaaacatgaaaagtaaaatgagctatatttaaaataaccagttgtatcaactatacgtcttcaaatcttagatgccgtccattttaaggcccaccattaattatataccactactaattaggttgacagttttcaaacagaaccccaagtattttgacattcttctgtataagaagtggggttgggaggggaaaggcttccagatagaaaggaagaagtaaaactatctctacttacagataacatgatcttgcaaacaaaaaagaaatcctaaggtatccacaaaaaaaccaatagagtccacaaatgagctcagcaagtttgcaggacaaaaatatcaacatgtaaaactcaaaaaaatctctacacactagcaatgaacaatccaaaaatggaattaagaaaacaagtacattgacaatagcatcaaaaggcattaaatacctagcaataaatgtaagagaagtacaaggtatgtacactgtctagaatatcatttaaagacctagataaatggaaagaatatctcatgttcatggttgggaaggcttaatattgttgagatggcaatactccccaaattgatctacagcttcaaggtaatctctatcaatgttacagttggcttctttgcagaaattaataagatgatcctaaaattcacattgaaatgcaagagaccaagaatagtctaaacaaattttaaaaaaaactttctgaattgaaaacttggcacactgttacagtaatcaacacaacattgtaatagcacaaggatacacatggagatcaatgggatggaattgagagtccagaaataaaccctcatatttatggcctattgatttttaagaaaggtgccaagaaaactcactggggaaaataatagtcttttcagtgaatgtttctaggacaactggatatccacagaaataagtgagattcctacctcaaaccagacacaaaaatcaactcaggatggatcaaagacctaaatgtaagaactaaagcaatacaactcttagtagaaaacagaagggtaaatcttcatgactttgagttggcaatgccttcttagatatgcaacaaaaagcgtatgaaacaaaagaaaaagataagttggacaacgtcaaagttaaaaacttatgcacttcaaaggacaccatcaagaaaagacaactcatgtaatgggaaaaagtttttgtaaattgcatttctgataagagactcatatctcaaacatatagagaactcttgcaagtcattaacaaagtgacaaataagccagttaagaagcagccataagatctgaatagacatttttctattctttccaaagaaggtagaaagatggccaataagcacctgaaaagatgctccacatcattaatcactatttgaatgcaaatcaataacacaatgagatacaactttataccccatagaatgccaacaatcaaaaagagtgataataagtgatggcaggcaggtagggaaatgggaatcctcatacattactggtaggattataaaatggtacatgtcctttggaaaatagtttgtcagttcttcaaaaatttaaacatagagttactaccatcccacccaacaatcccattactaggtatacacccaaaggaatataaatcattctaccataaagacagatgcacgtgaatgctcattgcagcactactcacaatagcaaagacatgatatcaacctagatgtccaccaatggcaaactgaataaagaaaatatggtacatatacaccatgaaatactatgcatccgaaaaaagaataagatcatttcctttgcagggacatggatggggctggaggtcattatccttagcaaatgccatatgttctcacttataagtgagaactaaatggtgagaacacgtggacacaaagaggggcacaacaggtgctggggcctacttgagggtgggggtttggaggagggagaggagcagtaaaaagaaccgttgggtactaggcttagtacctgggtgatgaaataatctgtaaaacaaaccccatgacgtgagtttacctatataacaaacatgtacatgcacatgtactcctgaacctaaattaaaagttaaaacaaattaaaataaacatagagttatcatatgactccacaatttcacttccaggtacataccccaaaaaattggaggcctgtggccacacaaaaactggtacataaatgttcacagcgtctctgtaatagccaaaatgtcgaaactatctaagtgtctatcttgataaactgataatcaatatgtgatatcccctacaatagaatgttattcagccataaaaaagaggagagtgctgacacaggctgcaacacagatgagccttggaaacatcacggcaagtgaaagaagccacaccaaaagaaacgtcaccgatcatatgatttcatgtatacaagatgttgagaatatgcagatccacagacccagaaagctgatcagtcatttctaggggctaaaaggaagaggtgaggaatgactcctaatgggtatggggtttctttgagggggggtgatagaaacatattagaattagatagcagtgatggttgcacaatcttgtacatataataaaagccactgaattttacaccttaaagggtgaattttatggcatgtgaatcataaatcagtatgttttaaaaacagacaggaaaccatgtctttttttaacttttattttaggtttgggggtgcatgtgcaggtttgttacataggtaaattgagagttgcaaggacttggtgtacagattattttgtcgccaggtaataagcatagtacccaataggtaccttttcaatcctctccctcttcctaccctctaccctcaagtaagccccagtgtctgtttccttcttcgtgtccatgtgcactcagtgtttagctcctgcttataagtgagaacatgtggtatttggttttctgttcctgcgttagttcacttaagataatggtttccagtcccatccatgttgctgcaaaggacatgaccttggggaaccatgtcttgatactgggttctataatggcttgaccagtagactatggtgggagtgaccccctgtcactttctactccctctctcaggatgcctgctcttttcatgccctggccgccatgttgtaaggaagctaaagcagcctttggagaaacccatgtggaaagcaaccaaggccaccagccctcagcaccggccacactcccaccaagttagaagtaaatccttcacgcccaggcaagcagccctgggtgactcctcacagaacagagacaagctgtccccctgagccctgcgcaaattgaagatttgtgagcaagataaatgattgttattttaacactgcaaaataacactaaggaagaaaagtccctgccaaatacagtctgacacaatgtcttaattataatctcctgtggcacatgaaccagctaccccaccactcttggctgtgaagtttctctcatctcttctgagtgccagggcagtgcctttggccaagcctggcactgcttggcacgtgagggctcatccttgtgctcaaatctcagcttcatctatttgtggatgtcttcctggattccctaaagcctttggatgttgctttggaagaaaaaaatgtggaattggagtcattcctcttaagacaactatttgcctttttgatagcctactgaggcctgcttttcaaaaccaaaccaaagtgttattttttttttataacacttcaacagtgactaaactcaacacatgtagtgctgacagcatacataagtcactgatgaacagctacgaccacgcgtgagcctgggcaggctgtgatgaccaccatgtcaccacagtgacctgcccaacagcaattttaagacgccattgggggcaaagcccatgtagacgtcagagatgaaagatgctagtctttgaatcagtgaaatacagcctaaatgcttaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtatgaacagttacatgtttaaaggatttttaggtaaagccccctccaaatcatgaggtacagaaacaaacatggaagtgccttgtaaagtgctttaaacgtgatatttaaaacttctgacatgcctgtgatgcttattctcaatttttcaggtgaaggaattgacactcatattaaataactggtttccaaagtatagcaaggacataagcatgacagccagtgtgggtgaccaggtagcagggggtgcctgcctcagtcatgcacccagaaaacatggttcctcagcaaccttcaaccctggcccaaccctcgacatgaggccccgtggtccaggcttctgcatgtcatgtactgggacaccagctgtggctcacttgtgccccagagggggacttcctgtggcccaaaaactaggaccctgctggcctgagcaaaccagcagacttctctgccattccaaaaggggcaaggacagccttctccaatgaggtctgagcccagcctggggaggggccttccagcttgtccttccttattttttctatcccagtcctagagtagcctatattttatagttaatctcttatcatcatcatcatttacattaaactttccttgtttaaatcactgtgcaatttgtgtctcccgattgtacccaaactagtacaacaggtaagtgtgttttgaaaacgaacaaggaatgactttacacaacaaaatttgtgtataatctatctatatgtatagattcaaattatatttgaataaaatactttcagaagtcaaatgtgtgtgtgtgtgtgtgtggtaattaagatagaggggattcgcaaggatatgaacagacaggtcattggaacaagatataaagtcaaggagaagaccaaataagaagaaagataacatttcaaatcagagttgaagggtgaattgtttattataacaatttgttttgagacaactagatagccatttacatagccatttaaaataaaattaattaacttaaatccctaacatatgactttctctgaatacattttaggcagtttaaatatgtaagtgtaaaaaatgaaactaaggaaatgctagaccacaatattacatggctacatgtctgtttccatggtaaaaaatgcctttccaaggatgaaaatgaaatatcttccttaaaagagactaaggaaaagattgatattcatgactacagaaacatttaaacttttccataaaattaaaaaatttcaaaagctaacttaaaatgcaaataacaaactacaaaaagtattgtggataaagttttaaaatttcaaatatctaaagaattcttataaatcaatcaagtatagctaatgtacccagtggaaaaatgggcaaagaatagatagtcacttcaatagctagtaattttttaaaaaacaaaaacagcataatctcattattcatcaaacaaatgcaacaacaaaggaatttcattttatgcttatcccataagcaaacctagaaaacaatagctggtgtgttggctcatatctgtaatcccagctctttgggaagctgaggcaggaggattgcttgagcccagaagttcaagcccagcctgggcaacaaagtgagactttgtctctacaaaaaatcaaaaataaatcagccaggtgtggtggctctcgcctatggtcccagcgacttaggaggctgagctgggagaatcacttgcgcccgggaggttgaagttgcagtgagctgtgatggtaccactgaattccagctgaggtgatggagtgagacccggtctcaaaataataataatgataataataatatcctgttagtgagaacacacacgagtgcagcctttttggggatatttccataacacatatcaaagttcttcaaaatctgcaaatctctgacgtaggaattctacagtgaagaacttcgctttaggaaatggtaaaaaataagctctaagaagtatagacagagatattctttacagcactacttataatattgaaaaatggctaacaaagttaattcccaataataggcaattggctaagtaaagataaaaggcatggagtgaaaatttgtgcagtaattatcaataaagtcacaaaataatccttaatgacacatgaaaatggttatggtatattttaaatggaaaaaaatagcaggtaagagcaagctgcatatgtacaaattacacgcaattgttggataaaaatatccaattttttaaaggggactgcagagccagtatcaaattgtcagctcaggaagcacaggacttctttatagaggtccttgttttgggctgagtctttccgcaaagacttttctggaaaaggcaggcatccccctgcccgttgacagccctgaggttatcctcttgcctaacttccatggggggttataaatagaagaccctcttccttcagaaaggacaaactctctcacagatgggtgtgctcctatctctggcagccagacctcacaactgggatcacaggattctttctcttttgccatctcaatgagcatagcggaaagtgacagcaaatggaaccattggcaggattggtctctcagaggaatattatcaaatgggacaccagtggcgcttggtaatcaaaccaaaagcagcggtagggaagagcatttataggttagaggagacactggagaattaaggtgcctcgggagaagagtgcaaatgccagctgacttcactaaaacatctgtcctttatgactcctagtttttaaaagctaattttaatttggaagcatcactggagcgctcggctgagcccagtagattccctttttgctgttttgtagataaaatgaaaaagtcactcatcccaatgaggatcatctttatcacttgtactgagccaaatgaataaatgataatcttcgaatcaatcagggtcccagcagggagaagaatctcattcagatggttccctggaagacattttaatagagggactcccttcaaaggtgggcaaagttaagcaaaacacaagagaggctgaggccccgagggagcagtgatggtaaggagtagtaccctctcccccaggcctggggggcaggaggaaggagtagcgttcccagagctgcagacggccagggccttggacatgggcttggtaagcgggagctgcaggtgcgcggggcacagccacactaagccctgagtgtgacagcagagggcggtgggaagaaacgtccgacctgtctctgctcctgctctctgcttcctggccagtgcctctcacgggccgaacccacctcgaaatgcaacagcaagtgagtctgagggatgccatccaagggacgttgaggagtgtctcctcaacagtcacgtccacacccagtctcagaatgagcttgtttgaggatagagtctttagaggtgtaattggttaaggatcttgagctgaaatcatcctgaattcagggtaggccctaaatccaatgactggtgtctctgtaagaagaggagaggacccagacacagaggagaaggccatgtggctatggagacagaggctggagaggtgccgccacaaggcgagggacagaggacagccaggagccaccagagccaaaagggatgagcaaggatcctccctggagccttcagagggagcaggaccctgctgcctcctagatttcagacttctgaccctaaggactgcgagagaatatgtttctgttgttttaagccacccagttggggtgatttgtcagagcagccccaggaactaatagcagtcatgagtgtcagcctcccatggcacagagtagggccctgcagtgggggctggaagggtcttaaccaacagtaaccttacagccctctcccaagggaaggaagctactggattgcttccatacattggttgcaagcaacagaaatgaactttggccagtgccaatgaaaggaactaaaagggagcttgcagaattggggaaaaggatgggaaacaagcactggaaataggcagagactcggaaactcaggggcttggatgcaggggctatagggagcagtgctagagcaggaacttgtaggtcaggacgcaaggaccccagaacagccaacatgatcttgtaaaagaacagccaagttggaggactcatagttctcaattccaaagcttataaagctatagcaatcaaaacagtgaggtgctagcatgaatacagacatatagctgctcactggaatgaatggagagcccagattatagactcttatttatggtcagttaactttccacaaggaagcaatgacaagtccatgggggaaacgatcatcctttcagtaaatggggagagacaattagaattccacacgcaaaagaatgaagttggatgcccatcttataccgtattatacaaacattaacaccaaatggaacacagcccccaaattaagagataaaactataaatctcatagaggaaaacataggcataaatcttcatgactttggattaaacaactttttcttagctatgataccaaaagcacaagggagaaaggaaaaaaaatagatatgagtttcatcaaaatttaaaacaggttttgtgcccccaaaatatactgtaaagaaagtggaaagtcaatctacagaagaatatatttgtaaatcatacatgtgataaagggcttgtatccataacatatgaagtactcttacaactcataaaaagcatgccttttgaacatggaaaaaggatccaaatagacatttatccatagaagacatataaaaggccaatcatcatataaaaagattctcaatgtgggccgggcgcggtggctcactcctgtaatcccagcactttgggaggccgaggcaggtggatcacaaggtcaggagatcgagaccatcctggctaacatggtgaagccccatctctactaaaaatacaaaaaactagctgggcatggtggcgggcgcctgtagtcccagttactcaggaggctgaggcaggagaatggcatgaacccaggaggcagagcttgcagtgagctgagatcgtgccactgcactccagcctgggcgacagagcgagactccatctcaaaaaaaaaaaaaaaaaaaaaagacaaaaaaaaattatcaatgttatttgtcattaaaaaaatgcacatcaaagctacaatgagtattacttcacacccactaggatgactgtaataaaaaaacagacagacaataacaagtgtggtaagggtgtggaaaaattggaaccatgatacattcctgctctgattgtaagtggtgcagcactttggaaaacagttttgtttgttctgcaaaaacattagcatagaattaccacatgattggcaatttgacacctaagtatatacccaagggaattgaaagcatatgtcacgtaaaaacttgaacctgtatgttcaaaatagcccaaaggtggaaaaaccccaaatgttcaccaagagacaaccgaataaaccaaatatggtattctatacaatggattattattcagccataaaaaggaatacaatacatccgctacaatgtagatgaaccttgaaaacacgctgaatgaaataagccagccacaaaagaccacaaactgtaggattccatttacatgaaatgttttgaataggtaaatctgtaaagtcaggaacaggttaatgaggctgtgcgtggtagtgtatgtaatccctgtaatcccagcactttgggacgcctaggtggaaggattgcttgaggttaggacttcaaaaccagcctgggcaacatagtgagatcttgtctctacaaagattgttttaaaaattagccaggtatagtggcacatgcctgtagtcctagtgacttgggaggctgaggtgggaggattgattgagcccagtagtttgaggctgcagtgagctgtgattacacctttgcactccagcctgggcaacagagtgaggggaaaaaaaaaaaaaagagcagtgaacgaatgtttctgagtcccagggagaggtggaatcaataacaactgctgctaatggagatgccgtttctttctgcaatgacgaaaatgttctaaaaccagatagattggtgatggttgtacaacgacatgaatctatttaaacctactgaattgtaaattttaaagggatgaattttattgtatgtgagttatggctcaataaatttattttaaaacgtctagccctttgcgaataatttatttttcgcaatcttgccaagatctttgtacaaaatatgtattttaataaaatcatttgtaggtcttggaatttcccacgagcttcagctcatattacggtcacttactacacaattgatttttttttaggttgggtcacttgtgtttattttcctgtggggtgtcctcagcaggaaaaggaggctctttttttggcactgtggtaaaatttcttcatgttatatttatagaaacataataaattcttttaaaataaatggtaatgtcacactggtctttgtttctttacccttttaaatatatcctagtatcctagctttttttttttttttttacctctcagcaatgacataaagtattttttgtttataaacatcaaagactctttttaaacaggagaattgcttgaatgtgggaggcggaggttgcagtgagctgagatggcaccactgcactccatccagcctgggcaacagagtgagactctgtctcaaaaaaagaaaaaggctcttttaaaaaaaattttatgccatttgcatattgtaatnttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcagcctgtaaaaaagtttcttccacaaaaccagtccctggtaccagaaaggaacactgagatataggacatttccagcatccagaagtctcccctgagcccaccccgcaggggaatcacaaatccgaccccgagaccctgagttcgttttgcctgttctccaatgtcacataggtggaatcgaatactctgtgctcctttgagtcttctccaggactgcctgctaggttcatacacattgttgcttgtattagcagcccagtcttttaaataaaggaaatattaaaacttaaaatgaggaagactaacagaattctgattctcccagtggtgtctacttgggtgctgtactcatctgttttcatgctgctgataaggacatacttgagactgggcaatttaccaaagaaaaatatttaatggacttatagttccacgtggctggggaggcctcacaatcatggcggaaggcaaggaggggcaagtcatgtcttacgtggatggtggcaggcaaagagagagcttgtgcggggaaactccagtgttcaaaaccaaaagagagagcttgtgcggggaaattccagttttcaaaaccatcagatctcgtgagacttgttcactgtcacaagaacagcatgggaaagacccgcccccatgactcaattacctcctgctgggttcctcccatgatatgtgggaattgtgggagctacagttcaaaatgagatttgggtggggacacagccaaactatatcaggtgccttttttcaatgtcaaattttttcttttcaaataaatgtatgcatttgttggcaccccaagcctgtgttttctctgccttcagagagggagacctgtctccaaagcccgccggagtccaggatggtaaaccacagatgtggagtgaatgtcattcagataatgcatggatctttgacttttctggtttttcatctttgtttatgtcagtggttctccactggggtccatttcttttcccagggacaactggcaatatctggagatattactggctgttacatcttgggagggttccatgggcatctcatgggtagagaccaggtttgctcatagcatgccacagaatacaggagtgcccccacagcacacaggagcccccccacagcaaagaattatgatgcaaaatgttagaatggtgcaaaatgttgagaaacctggcttatgccttttatccatctctaatggatctctttgaacctctatctctttgagcttgatgtgcaccgaagtctggctcaagccctggtctaccctggaaagcctcctctgaaggccgattggtggctcttagcccctcccaatgggtgagacaataagacccttatcatttaccatggccaagatgctaaatcagtagttctcaacctttgatgttcattagaaccaccaggaaggggccccagcatctgagattggtaaaagttctctaggtgactctagcgaggctgaggtcaaaaaccaaatctctggcccttgctactctaggcatggttgaaagtgtggcagccccgtcaccttgttccaaatgcagaatctcatcccccaacccgtgcacgcacttttggaaccagaatctgcattttgactcccatgcccgtcagacatgggaaactccacgctggatgatgtagccctgcctctctccagcctcaccctcagccctcttccagcctattcccagcctcagccatcctccctggggcttcagtgccatcttcccagaggtgctgccatatcacccccacccgcccctcccacctcattgctctgtttgctccatagctcatgtcactgtctgaaattacactttttttctgggttttttttttttttttgagttggtgtctccctctgtcacccaggctgaagtgcagtggtgtgatctcggctcactgcaacctccgcctcccaggttcaagtcattcttctgcctcagcctcctgagtagctgggaccacaggcacctgccaccgcactcagctaatttttgtatctttaagtagagacagggtttcaccatgttggccaggctggtctcaaactcctgacctcaagtgatctgcccgcctcggcctcccagagtgctgggattacagatgagagcccccgcgcccggcctgaaattacatttttatttgtttgcgtgtttgctttctgtcctccatctcctcccaggtagccttcactatggcagagactttgcttgtcttaggaattatattcctagcatgaagaataattttgctgtttaatttctgaataaatgctgctgcaactctttgacatttaacgattaatattcttttcttcttatagacctcgtctccccaacttgattaggatcttacctccaggaaacatctttctattgatgggcgttgctcttgagtgcctggcctggaggcttcctgtaggcagtagatacacaataagtatgtatggatggtgagcaagattttgttgattcaggtcattttttaaatagtaaatacattcaacgaccaatcttccacggtgagggagagcgtgtgctgtgactgaaagccacatgtcaccaccagtcccattcgaatactgatcgtcagcgctgtgaactaaagcagaactaatacttttacctttcactcttctcctgaccccatttgccaagataaagatggaaagaccccggcattgtccagtgggagggaaaaatgaagctccgcagaacttttctaaattggattagcatctcctgccgtatgcgcttatttattcagggaatttccaagtcagtgttgcagacatgaatgtggcaggggattgcacgctttcaggatgaaagtatttgggcttcctaagtgcgtcgacgagaagagaccagttacctcacgtttcttcttattttatctttagcctctaaacatagcacacagtaaatcatcttggacatctagggatccctttcttcagatgattataaagactcagctgaaattgtcgttatccttatttcacggggaggaaaacagaactgttaagctctgcctcttgctgctgatcagccaactgaagccaggtggtgggtgtggcccaggaggcacgacgactccacggttctccagctatgtggccatccccaagaatcacacggtttccagacacttaagcgtgtgttccattccccaccttacagcccatctctcatctcaccaacgcttggaggaaacaaggaaaaaatcggtgcaggaagtccagagaaggaatctcaacttttcactctttgctcaagccccggattacgtctctgaacagcctgagccttaaacaagggtttaaaacagcagaaagacagatggtaaatgcaaccccgcccgttaggtgctattcgaaacacagatggtaaatgcaaccccgcccgttaggtgctattcgaaacaaaaacgccgggggtgggaggtctgcctaggaaaaagccatccagggtggtgtccgttcagggagcccctccagagggaagaaaggggtgagaaactctgtgaaaagtgtttgggggtggggggatgaagaggccttaaaaggaagctgagcgctttgctgcctggcggtggcggtgcgcagcggctccccctgccggggagtcgatgaatagcgctgcagcgtcaagctgggcccaggctcgggggctgggaggccaggctgaggcagtgcgcgcggggctcagccattctaaacgcaaacgaagggggaccctttccacccaggcccaaagcgggaggattagaacagggagttcaaagctctaaaatggcttgttcgttctttcttttttcctccccaccctcccctttattttttaaaggggccagaaatatggctggttattatcccaagtgattgctacaaagaatttcgaaattaaaagataagcacgccgaggaagctcagtaattttcataaaaggggacttaaaacagatgtgccctctttaatcgaagcatgcttgaaaaaataggaatgcatttttaacatagcagggggaaaatcacatggcttcgcatttgtcccctgagagttgctgtgtgtggatatctgtgggcacggggagatggtactaacgcgctagggcagccgcaaatggcgggtgaacgtgctttcatcttcctggccctggggtaaatgaccagcctctgtgctccagaccttttgctaactagataatttatttatttatttttttaatttcttaaacaatctgccatccaaaatgtgacgatggcatacaagcaacagaccattatttgcaaggaaacccagattttgtcaacaacgtaacccttttcttcctctttgcaggagacggtttttccgtgttttctttttgacaatttgcacaaagcaaattcactcttaaacaaggctggtttgtttttatttcaggttgttgacatgtcagccattcagctttagccccaattcgtccgttcaccagatgagggtagctgtgtgtcaattcttaccaaaacaggagtgtcacgtctactcatttcctgcatggtgagaaggaaatgaaagtgctcggtctgagattccctgagaggagaaaccaaagaccgtcagaccaacaacagtgcttttaaccagtgaaagaggcaaacattgaagcatatttaggagtagcagggcactaaagccagcagttgcttgattctctgttgccgtttagctgagcgtgtgtcccacactccctagcggcttcccaagtgatgcagagactattggtggatacttttggttgttgttactttaaatgtttcctttttattttccataaaaacgatttagctcatctttctcactgaaagtaggcaaataaaaccccaactccatgccttggctatagtagataataaatatcagctgacttttattgcttgaatacttttagaaatatttcttttcttttttttttttttttttttgagatggagtgttgctctgtcgcccaggctggagctggagtgcagtggcacaatctttgctcactgcaacctccaccttccaggttcaagcaattctgtctcagactcccaggtggctaggacgacaggtgcgtgccaccatgcccacctaatttctgtgtttttagtagagaccgggtttcaccatgttggccaggctggcctggaactcctgacctcaggtgatccacctgcctcagcctcccaaagtgctgggattacaggcatgagccaccccgcccagcctcttttcctcttttaacttggaaattaggcttttcaaatccatttccaccagacctcataatgagacattttacaatctcgggtttgtggagactttctttgaatcacctcctttcttcacctcttcatccacacttcacctaaaactgagctaaagaaacagcaatggtcaaagggaacataaccttacctgggatgcttcaggtctgtgtttattttggttttacaagcattaatttattctctgggcatctaaatttttctattttttattttaacatgtaagtaattatccttaaatagatactacattgacaagatagcaaatttaaaacgtaacaatttcaccccagaacagtaacagcttatggactgccattctcatcagtggctaggcctacttctggagattattttcgtccatataagaagatatgtctgggctgggcatggtggctcacgcctgtaatcccaccactttgggaggctgaggcaggcggatcatttgaggtcaggagtttgagaccagcctggccaacatggtgaaaccgtgtctctcctaaaaatacaaaaattagccaggtatggtggcacatgcctgtaatcccagctacctgagaggctgaggcaggagaatcgcttgaacccgggaggtggaggttgcagcgagccgagatcataccactgcactccagccctgggtgacagagtaagactctgtcttaaaaaaataaaaaagaagagaagaattgtctgtctgactgtatataccatttaaaaaattcctcacatagtggcacactctaccacataaaccttcaccctaatcttgctctgcattaaaaacttttatttctataggtgattgggaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaatcgggactctcaggggagaggccaggtgaacagtctattaaacaagtcccaggtgatttgccagggacttttggcaaatgctagttgaaaggggtctccttaacatcgtcttggttatgcctctgctgtggttttcatcagacaaacctgttgcatgcggcgacagagactaggttgatgtctgagccacaccgagtacacggagcactgtcagagaattcactgccgcactcacaaagaacaaagcaaagactccgtgaaatcccaatttctcctttcacgtgggatgtgcgtatctgagtgggatgtccaaaagctttagtgttaaacacactgacctcaggctgtcccttcccaaagcttcgtctgaccagtctacctggtggttcctgaaggaaccccagggatttggtgggtggttccccaaaagtgcatgcctgtaggaagtctgtccactcttttctgggtacattttccttcaaaattcaaaaatgtgacactcattgaagcattctatttagcaattttacacgcattccctaagtcctacaggagttttttggagtaatctcctgaacctgctgcttacacacagtgacggctctggctctctcctcagagtcaaatagaaagtattttcaacagcagtttcattctgatactatgatacgagtcttcagatatttcgtacatttctaagtaaaagcttaaagtttgtgtaattggtattgtcattcagatacaagatttcaaaagctaggtttaattttctttaccttcattattactacccaatgattttaaaaatccattgtgtacaatagagaaactgtaaaattttcaagagtagtcaggagggagtccctgcacttggagtaagatgactcttctctctaggccaccattcaaaggaggctccatggcctctacactctgagttaagctgcccttcaagcaccctgtgctgccagaactcaagtgggcacctagaactctgcactgcggagtccagcgctctgccctcgtccatcgcagccttcccactctcatgcctgggaaccccacgaccagtggcatgccccatccctgggctcttcccacaagcccaaagctccaggtgatccctcgtatttcaggctcatctctgaggagctctttgcagtctcttttttgacaccatcccctgctcctcaacttttcctgtgtcctctggagctcattctcaacagcctcttaggggcggtttctttacatctccctttaacaaactcggctttctcccgggtcactcacagtgctgctgttgtctctcctacacttctcgtctgccaaggtctggagggtgaggtaggtgtccctcttgctcctcactgatatttccagacaccccgacccccgcaaaaaagaaaccactcggctttgaatctactttgatcagatcatgtcagccgctccccctccctttgccactttatgctccccgagctccgattcctccttgcagatggtagctcctggcttgctcacattgtcctgtggtgctttccttctaattcttggctaaaacacaccggtgaagtccagctttttgcctacttgcctgttcctttgcaaataaacacggctggagaaaagcacgcaaccctgtgtaattgttgtatttcaattcatgatcacaagcaggtatttaatgctgtcaatacatgtatgtctagccattggctccacagctctctgatgtttttcataccttgtctccttacaccaccaccaccaccacctccatccgcattctcaactactgtctattttgctaaaaatccaggcagagcttcacaagctcccacctgaaccgcgtttgctctgcagcccggtgttgtggcggcacgcacggtctgtgcactcggccagagcacaccccacctgcttgggcacaagacattcatttttggaggatgttgttttggaatctcgtctctccttgtttccctgctttagtatttttcttttcctattcattcccaacagcttgcaaaactggtgtcattttttttttatgttaaaaaataaaagccttttgggccccattgacccttaactactgttccatttctctctttccctcaaaactcctgtgttgtctggacttctttcctccccatcctctcttgaatccagtgccagctgttcaattcctggccatcctccagccagacctgctgcacgcctggcatggtgtcccctttctcctggaaacatgctctgcctggcttccacgatgccatgctctcttggctccccacacctgactgttccttctcagtctcttgctggttcttgtctctaaggcctaaatgtgccttcagactctgccaggatcccctttctttctgctcttcctctgttggtgatttcacccatgactcatttgtatgaagatgcttcccagaccacatctccaggcccagtttcctccctgaactccacactcacatcatcagctgtctcctagacgtctcccttaggctgtccaacacaatgctgctcagacttcttggtctcggaactgcctgacactcttcaattactgaggacacagagattttgtttatgtgaattatatctgttgataattaccatattaaaaattaaaacatctaaaaatatgcgtgcccatattccattgtcagaatgatactgtcagcacatgacgtgtagcctctggaaaacactgtatatgcctgagggcgcgttagagtgcaaaggaaaagtgacctctcagtatcatacagataattttgatttcgcagaactccaaaggagtctgagatttccaggggcctccagaccgcatttgacaacctctggttgaactggtgtttcagtatgctcaaagttaaactgtgatttcttgaagccctgttccagctccgtaaatcaggacttcatccttccaaatgttcattcaggccagaaacctgggagccatcctggagtcatctcttacatcacacctcagattcctcagtgaagtttatcagcttcactttcaaaatacgagtacctgtccactaatcctgtcagcctagccttcctaacccatgtctctgctcttgcctttgccccgactttggtccattttcagcaaagtagtcacagtgatgaagtcacacatctgcttacagtcccactatggatccccatctcaggaacacagagtcgttgccaggttcccatgttgtgtcatcccagctgctcacaggagactcggttctcctcctgccttagggcctctgcctggtttcctctgcctgctgtgctcggagcccaagttcccgtgtgttccttcaggtctgggctgaaatggcaccagcacagggaagccctctgtgaccaccccctgtgagcgtgcagcctagacacctacccttcgcctctcctccccagcttcactggtatcattagctagtgtagtgcccagcttaccttttctcttactcatctcccgctagatgctgagcccatgagggccaggattcttgagtgttttgttcacttttgtcttcccagtttcgatgatccccagtgtatagcaggttctcagatatttattgaacggataggtgaataactagtgccgcccataattcagaaaaacagcccctagtatttcctgggcatgttaaagttgaagggctctgccccaacagtggtccttgatccttgggtgcacatggcggtcaccagggagctctagcaacccctaatgtcggtgcgcacgcagttcacggaacaatctcagctggagacctggacgtggatatgttagaaatctcccctgggaagtaagttacaccaggcagagaggtggggccgtccagacaggcgaaaaagcaacccggcttttgagaaacctggattctaaatctcagcttccggctgtatctgaacaccagatgctctgctggcattgggtggttttcttcatgggtgcctggaggagtaggtccagtccatcctggccatgtccccacccatgtggcataaatgcaatgccagggtgtgatctggaggcacgaaaggagccctttggtgtggccctgtggcctcagctgtggcagggcctgaggtaccttagcacaagcgggcactttgcccttggtctggggcctgggggctgcatctggcctcatgatttgctcgctctcaccttccatcggaggccaacccttcccatttggtcccaggccctgtgaagtggagagcgggagtagtacatgtaccttctttctggacagcgcaagaatctttaaacactttaatgctattctccctgacccaacttacatgccattgcttctgatttaaatcaactgtactgaggtctagtttatttacataaagtaaatgaatacagtgtaatgagtttggacaaatgtctatacctctggatctactgccaccatcaagttttagagaatgcctatacccttcctcccacaaaggttccatcttgcctctttgcaagcagtcctccccaccgggaccagatgcagcagtgacctgcctctggaatctcacctggagaaccgggtagcatgcactcttgtgtctggcttcttttggtctgcctggtgttttaaagcagagtctgtgtatctgtgtaagtgggttgtttgctgggtggtattcgaccgcgtgatgagttcaccatttgtttattcatcatcaatcagtgggtgttttggatgtttccaatctttggctagtatagtagactaccatgaaaaacactgttgaggattttgtgtggggatgtatgttttcatttctctggcggatacatagatgaggaattgctggatttatatgggaagcatgtctgcaacttcatgaaaagctaacaagctgtcttctaagtatttatgcccttttccctttttctttacaatgcgtgagatttcattgctccacatcctcaccagtatttgatgatgcctttttaattttagtcatcttgggggtatgtaatcttaccttattttggttattgtttgcatttccctggtaagtaatgttgctgagcatctttttgtttacatgttggccgttcttacatcttcttttatgaaatgtctgttcaaatctcttgcacattttaaaagtattttattgagttgtaaaagttgtttatgtattctggatacaaatcttttgttgtagacatgcactgtgaatatttccttccagtttctggcttgctgttttgctttcttaagtatcattcgaagagaagatgtttgtacaactggatttcaaagtccactgatgggggagaaccatctggtgaggacttaacacttcctactcttcgatgtgcttcatgcatggttgaaaatgtaattgtcaaaaaaggctgccaaagttcttgatttgtattctgacttgcagtgtttactaaataatatttggaatagtatttggaaaaaagtatcttccttagctgtttaattcgctgtagggtgagatagacttactttaatgtaagtttggcagttgacttcatttgtacctggtactggtatctataaataatgccttttttcttcattcttttaaaatttatttggcacatagcagacactcacacatttgtcaaataaaagaattgtacaaatttttttcttattgaaattcaaaccacattgaataaacctaaatgcttccttgacagttccttcaactccctcatcccaattcccatccaagcattgacagttccttcaactccctcatcccagttcccatccaagcattgacagttccttcaattccctcatcccagttcccatccaagcattgacagttccttcaactccctcatcccagttcccatccaaacattgacagttccttcaaatccctcatcccagttcccatccaagcattgacagttccttcaactccctcatcccagttcccatccaagcattgacagttccttcaactccctcatcccagttcccatccaagcattgacagttccttcaactccctcatcccagttcccatccaagcattgacagttccttcaactccctcatcccagttcccatccaagcattgacagttccttcaactccctcatcccagttcccatccaagcattgacagttccttcaactccctcatcccaattcccatccaagcattgacagttccttcaactccctcatcccagttcccatccaagcattgacagttccttcaactccctcatcccacttcccatccaagcattgacagttccttcaactccctaatcccaattcccatccaagcattgacagttccttcaactccctcatcccagttcccatccaagcattgacagttccttcaactccctcatcccacttcccatccaagcattgacagttccttcaactccctcatcccaattcccatccaagcattgacagttccttcaactccctcatcccacttcccacccaagcattgacagttccttcaactccctcatcccaagtcccatccaagcattggcagttccttcaactccctcatcccaattcccaaccaagcattgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccattacaattaaaatatgttattctttgatatactgttaagaggatgaaaagacaagaaacagactgagataaaatatttgcaaaatacatatctgatcaaggacttgtatccaaaaatagacaaagaacttttaaaactcaacaatagaaaagtaaaccaccctattaaaaaatgggcaaaagatgtggacagatacctcaccaaagagaatatacaaatggggaataaacattttaaaaagtcttatcatcagacatcattagggaattgcaaaataaaacaacgagataccactgtccgtctattagaatgcttaaaagtccccaaacctggcaatattaaatactggggaggattcagaggaacgcgaaccctcattcattactggtaagaatgcaacataagtcagcaacttagaagacactttggcaggtttttttttgttgttgtcttttgctttttttaagcatagtcttatcatacaatcaagtgattgtgctcctaaatattgacccattgagtttaaaacttaagtccatacaaattcctggacataaatgtttatagaagctttataatcacccaaaactggaagtaattcatacaccttttaatatgtgaatgggaaatgaactatgacaaattcacacaatggaatattgttcagcaatcaaaagaagtgagttatcaagacatgaaaagatatgaaagaaacttaaaggtacatagctaagtaaaaaatcccagtctcaaaaggccatatacttatatgctgtattattcccattacattacattgctgggaaatggtgaatttatagagatagaaaaaagatcagtggttgccaggggtttgggggttggatggcaggtggtggcgaggaatagatgaagcacagggatttttatggcaatgaaactgctctctgtatgatattgtaatatgggatgcatgacatcatgcatttgccaaaacacaaatgctatgcaacacagagagtgaaccttaaagtaagaaaaattttaaaaagttattgaagaggtcaggtgatcctagtaaagactagtagaccatgaccagaaaatctaactgtattataaatatatgaaacaacctcactgaaaagggtgtagaaaaggtgctaacctgtgtaactttagaaataaatggaatttgtaagactaaaggcaaaactaactacagataagcactttattcttgttgacagaattgtttcctattgaaggtacaggctaacaattctgataccactatacacatatactttgaattgaacaatgaagtaaatggcctatggtgggagccaggcttcttattgttggaattggaggttacagacaagcaaaggggaaaggctagagtgatctatgtggtaaaagagcttccaatgtccaaatatggaacaatctgagcaagaaaatagtgttggattaaaacccaaagtataaaacaaatatccatatttgtttataaatataaaataaatatttgagaaaaactagtaaatagaggagaagagacaaatgtgtgcagaattgcacatcaattatgtagacactccaccagtgaggagaggaagcataactccctattccctaagtgtgggatgatcatattaacatccgtccaaagacagtagggacagaaggaacacatttgacaatggagaaacctgacaaacgctactttagacagatgatgaatgtcaacatcagcaggcatttatcatgttgatattatacacccttgatataatgtaatggaaatggcactctacctctgtgatcttcctcctcacaacccataactctagtctcagcatgaggaaaacttcagacaaattccagtagagggacattctgcaatataccagaccaatacttctcaaaactgtcaatgtcatcaaacgtaaggaaagtctgagaaactgttgaacagacacttttcaaaagaaacatacttgtggccaataagcatacgaaaaaaatgctccacatcattaatcattagagaaatgcaaatgaaaaccacaatgagataccatctaactccagtcagaatggctattactaagaagtcaaagaataacagatgctcatgaggttacagagaaaagggaacacttagccactgctggtgggaatgcaagttagtttagccactgtggaaagcagtgtggcgatttcttaaagaacttaataccgaattaccatttgacccagtaatccccttagtgggtatatccccaagtagtataaattgttctaccataaagacacatacacacatatgttcatcacagcactattcacaatagcaaagacatggaatcaacctacatgccaccaatgatagactggataaagaaaatgcagtacaactgctcagatgatgagtgccctaaaatctgagaaatcaccactaaagaatctattcttgtaactgaaaaccacctatacccccaaacaattgaaataataaaaaagaaacagcctaaaaaataagaaaaagtggaaagaaaagaaaacgtggtacatatacaccatggaatactatgcagccataaaaataacaagatcatgtcctttgcagcaacgtggatggagctggaggctgttatcctaagcaaactaacacaggaacagaaaaccaaatactgcatgttctcactcgtaagtgggagctaaacattgaatacctacggacgtaaagaagaaaccagcagacaccgggtgaagggagggaagagggtgaggatggaaaaacgacctatcaggtactatgcttataacttgggtgatgaaataatctgtacaccaaatccccgtgacacacaatttacctatataacaaacctgcacatgtaaccctgaacctaaaacaaaagtaataaaaataaaaataaatctcacaccttcttggaccttgctctcccgtccagctgctgcaccacttccacttccctgctcaggaaagctcctgggaagcactgcccacgccggctgcctcctacttcctgtccttattcctccagtcaaagccctccctctgcatgcccattggacctccgccaggagctgtcagggagccatggggactggcaagtctggggtttaggctgaggttcaggctgatgatatccacttgggagtcgttgccagagaggtggtcattaaagccgtgagaagagatggaccccccgattgggggtggaggtggacatgagagggctggcctgggctctgggtgctccagggtcctctggtccaggggaagaggagggcccagtaggccctgggagagagcagcttatagggcagaaggaaaagcaaagggtggcttcctgaagccaaggggaaatcacgtctaaggacaaggaaattcttcccagggccacagagggctgaacgctccagcagggagaagactgaggaccagcattgggttctgcaggcagaggcccatggggaccttgatggcagcaaagccggtgggcatggggtcggggcaggagctgcagacagcccagggagacccatttcagactttgtgagagcgtgagctggtggcgttttaatcaccatgacatttgcagtcatttattacaacagcagcaggaaacaaacagtgctcatgatgtccacatgtcatgagtggagggtacaactcaccgactcctctgcagctggttaaaaattatagataaggagattataaagggagatagatagatagatgaatgataggtagagagatgaatagatagatagacaataggtagatgatagatgaatagatagatgataggaagatagatgatagacaggtagatagataacaggttgacagacgatcgatgaggagatagatagatagatacagatagattatagataggtagatatatggatagataggtagatgataggtagatgaatagatagatgatagatacatacatagatacatggatggatagatagagctggatagataggtagaagatagatgaaggtaggtagatagatgatagatgaataaatagacatagataacttatagacagataggtgatacatgatagatggacagatagatgatagatgacaggtaggtaggtagagctggatagatgataggtgatagatagatagacagatattaatatagatagagatgatgatagaggggatagtgatggagatgcaggtgtggtgtagaccaagttgtagatatgaacacacatgcagcctccaggctggatggagatgatggtagaggtgacaacgatggagacataggtgtgggtgtgtagactgggttgtagatatgaacacacgtgcagcctccgggctggatggagatgatgatagaggtaatagtgatggagatgtaggtgtgggtgtggtgtagaccaggttgtggatatggacatacagcctcctacctggatatagatgacgatagaagtgacagcgatggaaatgcaggtgtggtgtagaccgagttgtagatatggacacacatgcagcctccaggccggcatcattgcttctgctcttggtagctgccgcagctgcctgtccacacagcagccctggtggtcctgtaacagccccatcatttcctgtcactcctctgctcctcacttccagtaactccccacctgacttagagcagaggccgtggcaccggcagggtccacacagcctcctgtgatccgggcctcagcccctcctgctttcctcttggctaattctgctctagtttccacagatccttccagggccaggttggcctacctcggggcctcagcaggtgctgtctcctcagctgggatgctcctccctccaacctttgcccagctggtcccctttcctccttaaaccctgctctcatgtcaccttccccaggaggcctcttctgcaatcgctgtccagaatttcagcctgtgaccccagctccctgtcttcattgcttttatgtctccagaaccctgtcctcatctagcacatgagagacgctaactgggatcacactgaacacctgtgtccatgcctgcaagggtgggtcagggaggcaggggtctgtgtgtctcattctgcgttggcatctcagtgccttgagcagcacctggcacacagtaggggcacaggagtcacttgttgaatgaatgaataacattataatttatcagctgggtttattataaacacagtatggtcatgacaatagattagaaggttctttttaggataaaagaagaaagagatgatatactcaatggactttggcgagcttagcactacagcgtgctgaaaacccaaataaagaagcgtccttattcctttacatacagtcctcttttaatgtatcatcaagaattgtgttatttggggacacagaaaaattcaaacactttgatcatgatccattcattgacttttcaagaagaaccttagaagggattttgactgtgtttgatgtacctgattagaaagcaaagcctcccctacctaaacttccattgtaaaagcccaaatctcacagaagtgcatcctgcagacttcaatgggttcgtccaaggagcaggttttgttcatttggaagaaaatagtatttgcaggattttgagagcacataagttcagcactactgggttcaaatatgcgcaacagacccacccactccgatgtgtgctcccttccatctcagaaagggacaggagtcctgccacttccagctcccactccacttgacagtcacccgtttccaatctcaggagtctaggatggtctcacttcgatctttcataagaagggagagtattgcccactcataagaagggagactgttgcccatttggatgggagcatgcattttccatggtgcagtgcagatgggcatggccgcagagcaccagctcccatcctctctcccctctctatgctgtttaccgttccagggctgagggccctggttacaattccttgacacccactggcagagtgaggtgcttcataagtacacactaagtattgctcagtgatcccaataactgccccaaacagcaaatgcagggtgaaagcgagcacaagggattctccataaataataataataacagcctttattatctcccaggtgcctccttggtgacaggccctctacatgctgtccccattacatcttcccgacaacacgaggtagaggtggctcctgattatagaccaggaatctcaggctcagaagaacccgggagctacccaaagccctcagcagttgagtgcaagagctgcaagtgtgaacctggactctgtctccccagggtcagcggtccacaacccatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatgaactttcgctttttaagactactgatgggtactcggccaactttactatcaacctaatttcagatcatgtctcccctgcccttagtcttcatttatgaagtgaattattacctgccttagctttgccaaagcaacggccaccccgcactccctcgagacagagaaacggaacccacacatttatgtctggggcctctctctggcgtgctgtgggagaggacctttgcttctcatggcatacttcaacaactgaaagaacaaatgaacccccctgacctttcctggtgggaaacggggacagtacgatgttaccaagtgaattctgttgttggcgctcacacactcaataaactgtaacactgtacctactaggttcctcctgagggttcaggtacagcaaggagagctccatcccccacagtccatctccattcggggtcacctacgtcatctatgggttctggtagtcctgggagaggcagggaaatgtcctcgaaaaagaaaaaggggctgctttccaaaggcaagaaactgctgaaaaagctgggtgcagtgaaatgattcatgtgcttccggacaactgccaaatctatgtaattttctttaattccaaactagggctttcatgactcaagtacttcctaaaaaaacccaatcttctcccctgacaccagtagagaaatgcacttttgcactaccaaccactttaaaccaaccacgagaacaaagaggagcggttgctctctgtcaccgctggcagtctgctctcattgtccaagctctgatttgggaggtgggaggggacgtcttattaacaaacgggggcgcatagctatcacctgtagctccctccctacctgtaattccagtctttgtgcatttgtcatctgcccttaaaggaatgattttcaacctttctcccttctcaaaatgcttgcctcataatgcataactttcactttgactctggtcttgaaattcctagtttaattcgccttgatgttctgccttataaatgcacaatgatttgtactgtctaataaaaacagtgtatactttgtatgtgtcgtgcattcagtggtcttcatcctgacacagtggtttgagatcaagttgtacaggctgtgcattttaagatactagtttcagtctttcaaagccagccaggctacacacagaaaatgtttactcaatcattcaaaaaagagaaaaggagagaaagtaactttgtttggtaaagcaccagtactccaaccttccagaaagccgattatcttcattgcttttaatgttctattctgtggcatatggttttctgttactttcgttgtcaaaatgccatacccaaatacacagcaatgaatggcacacaagtaatccacataatgcataagccacaccaaaaccagactcaatttaaatctgctccaaatgagtccatacccatcttcatcattggcatttgaacaaaagacttacttacaaagttgctggcagatgtatttgatggttactcttttgtaattcttgtccacttgtaaattgtttttactctttatacatacttttcagactgcctttcttttgtaatttatggacggtttataaatgaatgacaaagctttccccattgtgtcttcaaaaacgctattataaattgtaatataatagtatgtggtagatttattattaaaggaaatccatgtgtggttaagctctgtgtgggtgtgtgcatgtgcacagttagtgtaaaatattttctagaaataaaatttgttattttatacaacactgtttattctctttgttttaaatattttatcatagcgggataactgacttcctttctcttaatgtttacaaaaagccccataaccttaccgtttttgggagtatttttttttttttccaaaaataattttggtctatgttttgggagccattgacaatgttgtgacactctcatactaccagtaacagtccagtcagtgacaaaaggtcattcgcacggagtcagtataagcactaccaggatgaattcaaacacaaattgttaattccctctggcagctttagaattcaagtgaaattaatgaacggctacagcaacataatacaacaaaatataacttcccaaatacatacaattttcctaaaagccttattttagaattctccaagtaaccagatgatgtcttttcaaagaaagaggtaaaaccaacacacttacggcaagatgaaaatatagttcaagtacataatttcatgaacctataatttatctcataattgctaccataatatctttttacctacagtatttacaggaaaagttgaagagttgctaacaaaaagtatccagaactaatgtttctctaaatcttttgaaaatatttaccaattccccaaagtatgaaaatgtaggcaaacctgaagtaataatgagctggtcttagcttttcttcccccctattttataagtaagtacaattttcctaaaaccaaagcacccaccctgaggacaagaaagtgcttaagtcacatttaattactcattccagccccaactccctcccagactgagctgagagtcacttcagcaatctcccttttctggtgatgataagagaaaaaccatgttttgcttttgttttatgaccgaaaattgtaccaaacaagttaggaagctctccattaccagtgtgagtgtaattttctgtcttcacaggttagtctaaaagtggaagcccaaactgtacagagtactcaaagaacagaaaccatttcctcttgcagttaaatggctccaacccttcctcccgctgcttctaaggaagtggctgcagccctgacccatgagcgcctccccacattaccatccatttgcctctgctgctccccctcccctgccaaataaaacaagtgattctttcgattcagaatgaccctcccattctcatcctgacctgtaaaggcacaattttcattgaacaacaaacaactatacctaaattcttaatttcattttctgttatgactttcctatgtatattcaaaatgagaaacttttgccaaatttcgttttgcagttacttctcatgcacataaacatttttctatcctctcgctaacacttttcaaataaactatttgcttaaactagaacacaaaactcctgtgttccaccaagtgagctttactgtattttcttattcttgaaaattatttaaagctgcactcagaaaaaaaaaaaaaaatgcaaaaatccccaaccttccagaaatttctacggtacttttttctgtggccccgaggtagaggcagtctggcagtgacgaactgggttcttgggaaaagttctgctaaataaagcttgtttgcaggtatattggaagcttttgggaaaagaaagaaaactacattgaaagcctcattcatattaaaagaaaaaagatatacttctaaacatttttaattttgaaaagaaaaccgttttatgtgaagtgctctttcatatgggtaaagaaaaaatacctagctatcccctggctggctccgtgcacctccgcgtgcaagctcactgttgcagtcggactccaggcccttgtgctgccagctggcgcagccccttcctgcagcccctctcatcacagagaactgatgcctgggactaccaaacagtatatggagcttatggtagaacaacaataaccaaagtctctaaaaaagaggatgaatcaagtgtcaaagtgaaattaagaatacgaaagaaatccgaccctatgtggaaatactccatggagcaggaggagctatgcagagagagtgccgagaaggcccaggtacaggctttccacccacatgcatggtaggggccttctctacctttagaaccttaccccaaagacgtcaataaggaatccgtaaaatacatacagcaaacacaaaatgcccaacttcactagctgaagaaataaaaactaataatgcaaaatttttctgctccaaagttacccaaaagccaaacatgaaaccgctgatattggggaggatgggagctcctgccgtgggggctgcagtctctatcgtgtgtcttacgcacttggccaagtgactttctaaagccttgaacgtgtgtgtttatgtcctttaactgaatctcatttctaggaatccaactgaaaagagatatctaggcaaggatttaagaactaagaaatgtatcacattattataatagtgaaaagtggtaaattcacaaaaaaatccaataccggtctagtgaaatcatagctattcatcacaggattcaacattcaccaggtaactgacacacacacgtgaggatggtgactgggtcatcacaacattcagtattcaccagaactgatgcacccacgtgatgacggtgactgggtcatcaccacattcagtattcaccaggtaactgacggacacgtgatgacagtgaccgggtcatcacaacattcagtattcaccaggtaactgacgcacccacgtgatgacggtgactgggtcatcacaacattcaatatgcaccaggtaactgacggacacacgtgatgatggtgaccgggtcatcacaacattcaatattcaccaggtaactgacgcacacatgtgatgacggtgaccgggtcatcacaacattcaatactcaccaggtaactgacagacacacatgatgacggtgaccgggtcatcacaacattcaatactcaccaggtaactgacggacacacgtgatgatggtgaccgggtcatcacaacattcaatattcaccaggtaactgacggacacacgtgatgacggtgactgggtcatcacaacattcaatatgcaccaggtaactgacggacacacgtgatgacggtgaccgggtcatcacaacattcaatactcaccaggtaactgacgcacacacgtgatgacggtgactgggtcatcacaacattcaatactcaccaggtaactgacagacacgtgatgacggtgaccgggtcatcacaacattcaatactcaccaggtaactgacggacacacgtgatgacggtgaccgggtcatcacaacattcaatactcaccaggtaactgacggacacacgtgatgacggtgactgggtcctcacaacattcaatattcaccaggtnactgacggacacacgtgatgacggtgaccgggtcatcacaacattcaatattcaccaggtaactgacagacacgtgatgacggtgaccgggtcatcacaacattcaatattcaccaggtaactgacagacacgtgatgacggtgaccgggtcctcacaacattcaatattcaccaggtaactgacagacacacgtgatgatggtgactgggtcatcacaatattcaatattcaacaggtaactgacggacacgtgatgacggtgaccgggtcatcacaacattcaatattcaccaggtaactgacagacacgtgatgacggtgaccgggtcctcacaacattcaatattcaccaggtaactgacggacacatgtgatgacggtgaccgggtcatcacaacattcaatattcaccaggtaactgacggacacatgatgacggtgaccgggtcatcacaacgttcaatattcaccaggtaactgacggacacgtgatgacggtgaccgggtcatcacaacgttcaatattcactgggtaactgatgcatccacgtgatgacggtgaccgggtcatcacaacattcaatattcaccaggtaactgacggacacgtgatgacggtgaccgggtcatcacaacgttcaatattcactgggtaactgatgcatccacgtgatgacggtgaccgggtcatcacaacattcaatattcaccaggtaactgacgcacacacgtgatgacggtgactgggtcatcacaacattcagtattcaccaggtaactgatggacacacgtgatgacagtgaccgggtcatcacattgaatattcaccaggtcactgacgcacgcatgtgaggacggtgactagggggaaaggctctcgtggtcacaggcccttatcaggagcagcatctctgttaaggttcaaggaccccttacgcatgcccccatgggtgtcgcaggtggcctgtctgcatcctcacccctctctggcccttctccattttctctgacactcagaccctctctgctggcttggcctcatctaccacagctggtgtctgcctccagcctccctaccattctgctggggtctttgcctccagcctcgtgaccattccgcacttcacaatccctattccatttagttaccagaagaagaagacacatgtaagtaaccatacaaattgaaaataataaagcttttttctagtcccttcttaaaagacttctctggggatagagtaggaggaaaagggacgggggaggaaagggttaaacaacaatgctgccttctgatagcatttgatgagcagtcaccaaaacagctgcctctaattttccaataaaatccttgtagagatggctggacttgcgtcagatttggggcgtaatctccacacactgtgagggaaaaggagagagagcacggccccagcgagaatttccagcgctgtctcacccgcgttgttcctgaagacattgtttccgaagcggagacggtgagaaggcaggcggcctcaccttggcgagaagccggggctcagcagcccttcctcttcctcaggcccatgtgctgctggttgtccctcatccaaatcagcaactcctgaggaacttagtaggaagcagggagagaacagtgagacgcccacagccattctagggacacagccctggagtgcgatccacacgacagaagaggggaaagagggcgagggccccggggacagcacctgctgggactctgattttccatatgtgccagtgcacagagaactatgtggggaaggcaggaggcttcaaagcagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagtatgaatatcctctccgaaggcaaatcagaatccaggcacaggaaagagcctggttatcctacacatgcctgcggctgtagcatgttagacttgaagaggaacctaccgtccaggatgtcttcagttcttgccgattctgataaaggcggtgggggagcaggtggaaacacatgtgcaaggtggggacccccactgggctctgcgcagggtcctaagtggccctgtgggcttctggtcagggaggggcagctacttgtaaagatgccccagctgcggaaactttgagataaccccaccccattccctccctttgccccagggagtattcaagacatgctccaggggaacagaaaaggagggagggtggctttgaggtccctgccaggaatcaccagcagcaaggggtgggggcggggtggggggttccaagctgctaacagcagttggctctagaaaaaaggtaagggagaagtcctaaaatctgtggggttttaggtttttgttttgttttgtttttgcttatttgtatttcttccttttcctaaaatttatttttgacctatacagttaagtaatctagaaacttaaattgttttgtaaatgtttgggtggcagcaatttaaaaaataagaatatgaatgtatttgttttgtttacagtgcatatacattgaaaacactagtattagcaaggaagaaacaatgaagttcacagtcccaactttctagattatctataactcagcaaagttctataactcagccaattaagcaaagctatcagcaggcgtatgacgttcatgcccaattttaagagaaggaacggactagcaaaacaaaacacacaaaataaatgaaaatacaaaaatcaaatggtacttcttgatatttcaaaaacttacataataaaatccatcttcatcaatttcaccaaaaactgtaataatatctcctgtgcaaaatgtaagttcggcctgtggagatgaaacataaaattaatcgtatttttctacacaacagtagtagttttttaaaaataagttctctatgctttcccttactatttgagaatttctggtattaatctactctttcagtcaaataaaggtagaagctaatgaatggctctgtccacagtcttctagaaagtaagaacaaaccaagataatgtgcacctaaaaggaaaatgctgcagtgctttgattttggccaaaattcaagattattaccatgttctactgataatacatttttaaagctagtgaaatggttaattgtaaaaacctggaatattagggaaatgttctctgcagtataaggaccattacgtaaatatcctttcactgagtattttaaaacctactcaattattaatgaaacatctatttatttattgagacagaatctcactgtgttgcccaggctggagtgcagcagtgcaacctcggcccactgcaacctctgcctctcgggttcaagcaattgttctgcctcagcctcctgagcagctgggactacaggtgtgtgccaccaagcctggttaatttttatattttttatagagatgtggttttgccatgttgcccaggctggtcttgaactcttgatctcaagcagtctgcccacctcccaaagtgctgggattacaggcgtaagccaccgcacccagcctaaacatctctttattcagtgtctacgatgggccgggctgcagccccaaagcaggcggtgtcaaacacgccccactgccctcaggggtccaactgacccagcacattttcagttcccagtcacccagcagaacatggaagcagaaatctagacaatattcacaaccaaacacattttctttctaaatgtcaaaatgagggaatatagttggtgagccagtggcttgtcagagcaaagtactgtgtaacatgggttcacatacatcttgtcatctcagctagtagctgcagagactggaaaccccacctctcatttctgaaggcagtggtttcagccttcaagacaccaggcatcccaagctgtgccaggcgacacaacctcacctatcactggtttcctctctactgttctatgtgtggggcctgactgctttgcttttgtttgctgaccacatgtgatgggcttttatttctctcctaaagatggccctcaggtggcatcaccattagatgtggatgacagattgttctttctgtcatggcacaggaaaatctgggccatggggacagggcttgtcaggggctggccatgtccctgggaatcccatgatttctctcctgcgtggccatgtctgtatcagccatccctcggatcggcagcccttcctacggatggttcggagagaaggaatgaggaggtgaacacacgtggcctcagtgtggtgtaccacgagggaagggaagggtgtggttgtgtccgtcatgaagtgcagtgtttggctggtacctcgacatcgacgttgggcgagctttctctggggtcgtagtcatacagggccaccattctccgcgtcgataccgaatgacgcctgccacttctcctgcttctctctgttcagatcacaagggggaaagaaatccatcatgaggttatttcaaacttagcggtgttcccctccttccgggtcacacatggccaatacagccgagacctggcactgctaacagggccacgtgctcctgggcactcacatcagcaaacgtctctactttgggtcagtggtctgggactccatattcttatatttttgctgtagtatggtttctcccccttagactaacatgaaccttttccttcctccagtctgtccattaaaccagtgagactcacatgaagcacggggctctcgaacagcaaatttagacggctttggccagcacggggaggccgtggcttgggaggccctgcagagtgcacggttgtgacattgctctgggaaggccccatagacacagttttaaaagtgcctgtttgtgtaactatggtggcgctacaaaatcaagtcatgctcccctaagcataggcaaaactaaggcactgtcctcaggagaagcacgaacataaacagggatgccttctccacccagcccagtggcttccctcatgctgcttccctggcatccttccattgtggtttagcagcggccgtagagaagatcccagctctgcacagtcgacttagaggtgcattcccacggcctggctctgtctctgccacagatcggggcctgggcatcatcccagcacactcagaagcataagaaggggctgcagaggaattgccctaggctctgcccagcgtgagcgctccacacagataacaggtgaacactctcaggacgtaaggaggcctcagtgcagagccgcagaacctggcccaatcacgaaacccctgtcagactgaaggggtggggctgtgaaggactttcctcctggcgaaagttggcatttatgtgtttcttctaaacacagccactttttgcttacatttgatttggggaattccaaacatacagatgaaaactatcaaaggcaaatatctcaacggcaactaaagtcagcgatgtggcttttcagtggttttcagcaggtacaggggccagctgtgtagccctgcaacattccagcgattactctccccttgggttctggttaggagccactgctgtagtttacaggacgcacacacgcctctgtgcacatgtgtcctctgcaggacctgcacatgtgtgtctcctccagaggttcgtgtttctcagcattattcatgttacagggaatgttacaagtatgacttttgaaaggtggcataacaacatacatgtacttctcactgaagtcaaacttacatacacgaaggctcactcttcccagcgtgcagtactttacgttgtgataagcacacacagtccagaaaccccacaacaatcaagatatagaccggccatagtcctctgtagtcacttcagcccagatgaccacagatctgtttcctgtcccagaccttgaccctttccagaatgtcactaaaagggactcatacaaaatgtagcttttttttttttttttttttttttttgagagatggactctcgctctgtcgcccaggctggagtgcagtggcgcgatcccggctcactgcaagctccgcctcccgggttcatgcgattctcctgcttcggcctcctgagtagctgggactgcaggcgcccgccaccacgcccggctaatttttttgtatttttttgtatagacggggtttcaccgtgttagccaggatgtttcaatctcctgacctcatgatccgcccacctcggcctcccaaagtgctgggattacaggcgtgagccactgcgcccggcccagaatgtagcttttgagacaggcttctttcatctggatgacgcctctgagattcacccctgtcactggctgtattagcagtggctctgttccattgctgagtaggccccattgtgtggggcgccttcgttctgtttctgtcaccagctaaaagcacctgagttgtttccagattttgatgaccgttggtcaaaccactattaacaaacattcatgtacagtttttttgtgtgtgaacgtaagtttccctttcttctgagtaagtgtataagagggaagttgttggattgtattgtaagtgcacatataactttacaagaaaccagcgaactgttttgcagagcggtgatgccattttccactttcaccagcatgcacaggcccacctggcacactttgtgcccacacctgcgacggccagccgttttaatcttagccattctcagtgtgtgtgcattggtttctcagggtggttttaatttgtgtttcactgatgatgttaaagatcttttcatgtgcttatttgccacccacatatcgtctttggcgaaaggtcacttaaatattttgtacatatttttattgggttgttttcttattgatgagttttgaaaggtctttgtgtattctgaatgcaaatcctttttccagtgggttttacttgcaaggattttctgccagcctgtggctttttattctgcactttttaagtgcagagtatttaattttggtgaagcctaacattgactttttccttttatgtatcatgttttaatgtcctgtcaaagaaatcgttgcctgattattataaagttttctcctgtgttttcttctggaaatattagagtcttaatttttatacttgaaactatgatccatttttatttaagtttttaatatggtgagagtgtggttaaggttcattttggcatatggatgtgcagtaatgtcagcaccaatgattgaaaagagcatcctttctccgttgaattgcctttttacctttgtccaaaatcagtggactccatatgtgttggtctgtttctggacttcattctgccccattaatctatgtttctatcctttctccaataccacgttgtctcgattagcatacctctatagtagtaagcttgcaattagcttatgtgaatcttccaagcttcttgttcttgttaaaaatagttttggctactctagttcctttgcctctccatatacattttagaattagcttgttgattctacataaatcccagcacacatttcgaatggtcttgcactgcatctgtaggctcactcggggcagctgacataccaatattaagtccatgaatatgatctctctgtccatgtatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtttattaaggatgaatttcacgtttgcatgcggtcaaatgtttctggcttgggggtcatgaccataaaaggtccttcaaggtgatagaaataatcacctcattttgtttcaattttatagtttcactttccacatgtaaatctcaagtatctaccattttttcctaactatgagaacaaatgtctcaacacatttactaaataatctgcactttccctactttaaaaaaatcattttttaataataaaaaatgaatacgttttaaaattaaagtgtaaataggaatttaatacttagagtatttatggactttaacactactccatgctgtcttaattattgtatttttataatgcatttttatgtttgggagggaacattttgtaaagagtcccacctccacaacaaacctatacttttttgtttagatgtacatttagcttttggaagaaatagacataatattgtctttcaattctgacatagcatgcgcctcctcttaaaaagtttttcctttcatctgtcagaaaagattcatagatttattcttacgcatcctttatatatcttaagtttactcttaggaactatatagatccaacggccgggcacggtgactcatgcggaggctgaggcgtgctgatcacctgaggtcaggcattcgatatcagcctggccaacatggtgaaaccccgtttctactgaaaatacaaaagaattagccgggcgtggtggcatgtgcctgtaatcccagctactttggaggctgaggcaggagaatcacttgaacccaggaggtggaggttgcggtgagctgagatcatgccattgcactccagcctgggtgacagtgaaactccgtctcaaaaacaaacaaaaaggaattatatagatcttattatgattgtgaatgatttttccccctagcatatattccactgttatttaaaaaacatgttggaaaagtgtgtgtgtgtgtacatgtcccccacaaatcatttttctgaatgcatttatttctcttatcaaccgattcccttgggttcccacagattgtcattattttgcctcctcttcaccaatatttataatttgtcatcatttttaattgtcttactaatcacttagaacgattctgaataacagagataaggaaatctgtgactcgttatgtattttagtaggaataccactcatattttacatgttatatgtaggttagactatcagtaaagatagatggtctttataatacggagaaagtatcctttataatgctaagaaagttttagtttgctctgcttatttttcatcagtaaattactggccatcatatataatatttttaaggcactggaagttgatttgctaatattttattcagaaattatattccagaaataataataatctgtattcattggaatacctttgttgtagcttttgataccgggattatgctagaattaccaaataaactaagaaaatttcaacctttttctatgctttagaggagattaagtgacacagcaattactattatttgaaggttattagaatctgcccagagagagatcctttaggttcagtatctttttagactgcagttgcacaaaagtttttatttgcttaaatggttatcttatcagtttttaacaatctacatatcttcagaggaatgtacttttcatttagattttcacatgtagaaacaatgggctttcctggaatttaagaagatttttctaatttgtctgcatgtttctattccccagttatgttttatcttcttagtttcttgaatagtcttccctaagtttttatattatagtgggaatcagatctaaattaatatgaaacgtatgcttctttttatttaccactcctccaaatggttttactatgattttgctggtcatgttcactgagcggactgcccagttcatttaagtatttcttatttgataaacaatgacaggggacacctaatttgataccaaaaatcttaaatttcttggtactttgttttgatatctgtaaccttaaacatctcgagagagcgaattcaaatactccaccggtcctaatattgtaatatcaccctcctctttctctgttctgctatatcccatatcagtaaaacaagcgtaagcagggacccccgagggactcctgctgtcctccctggccttttcctccttttgctatttcataatttacatcagcccccattaagtcactgaagacttctaacaccccatcgtgttttaaagcgtgtgctgttcttgctatagcccagcatctcggtatctgaaaccttaaatcctgtaccttcctatgtcaaaagcaagccatcacgtggcgtactaaggtacgggagataatccagaggagtgtgcaaacacgagtggatgtctcactgactggggcacagagaaaactgggaggggatcgattttggtgttttctgcctttcagcctattcccattctgtctggacattaggcctccaggtagttactgtttggccgcaaatagagaaatggtgggaaatgaggcgtaggagagaagcagagatcaaattatggagggactgaggagggaaaggtcaaggtgaaatttttttagagaaagttattctgtaaagggttttgatggtacacttttgaagggggatgggagtgggtccaggaggctgggaaacatgctatatggaaccctccaggcaggaaacatggcccgaaatacgtcagtaccaggggaaggcagactcaagatgatcttatccagcgttctgactgccagtcagagggacagagaatgtcgtctgggggagccttcgattctgacctaggtgatgggtgcccttgagaacgcaaggataagaacaacgttgaatggaaaacctggcttagaaactcttgagcttgaggggtgtgaacaggacctttgagcctctccaaacagaacggaacttaggccaaagcagtattcacaccgcgagcaagtcccgtcgtcactttggacgcagtagcacgcagtggtagaggcatcagacatggggaagggagtgacatggtacatgtgcgttctgacgtggattttactagggctgtgtgtgttcagcccaaaagaacaagagcaataaccagtgcaggcagttccacccacattttactcagccagagcaggggctggcctggaggcctggctctacaggagcctttgcaggctggggtacacacgcctcttgtggtgtgagcatgacaccagcggagatgtgtgcataacattgtgtgtgttcacagaacacactccccaaatataagccaactactccatctggtgctcagccagaggaagaatcttttctaaggctggcagagaaatctggctgttggacctaatgaggggggacttgactggttataacttttgagtgtcttcgtatttagatgttattaaaaaccctcgataggaagaaatcgccaggggcacatgcacagtaaaaaggataggtggcctagaaatagtctgtaatgtcaacagagaaaaataagctaataatggagccggtgagagaaggcccagggcagtcacaggtaaataagagtaggaccttcaaggtccaagcagaagagtggggcggggcagggcagtgagtgtgcacctggcagcgttgctgaacaggaagatgcaggaagtatgtggggctgcctcttccaattaatttttgtgataaaatctacataaaatttatctaaaattggccaggtatagtgcctcagcctgtaatcccagcactttggaaggctgaggcgggtggatcacctgaggtcaggagttcgagaccagcttggccaacacggcgaaaccctgtctctactaaaaatacaaaaattagccgggcatggtggcatctgcctgtaattccagctacttgggaggctgaggtgggagaattgcttgaacccgggaggtggaggtggcagtgagccgagatcacgctactgcacttcagcctgggtgacagagcgagactctgtctcaatttaaaaaaaaaagatataaaatcatttttaagtatatagttcagtagtgttaagtatgtttacattgtgcaaacaatcaccaccatccgtctacagaactctttccatcttgcaaaactgccatcttgttttcaacagcagctgcaccatctcaccttcccaccaaaagtgcacgagtattcgtttcttcatatcttcaccagtacctgttttttccattttgtttttgatagtagtgtgaggtggtactacatggttttgaactgcatttccctggagattcgtggtgactggcatcttttcatgtgcctgctggccacctgaatctcatttttggagaaatgtctttaattgggttttttgatgttctttatatgttctggatattaaccccttagcagatagatgacttgcagacattttctcccattccacaggtactcatcactctgctgtgtccttcactgcacaggtgttttgatgtagtaggctctttatgtcatttcctagaccatataaacagagaaacaggattccgtgttgcccagagccagccaattttgaacttggtttaggcactttatgggcagatgagtttggggaagaagtgacgtggtaggcctgtgagccacttggtgcagatgaccagcaggcagatggactcatggatctcgactttagacaaggcatagatatgtaaatgagtagaaagatctggaaggatatataccaacctgaagcagtaatgtctgaggaggttatcaacagacactttcattttctccatattgtttgaatgtttacgataataacctatccatgagtaagagggaggacagtcttaaggctgagtagaccagtagcgctcaagcttgctggcatgttaggaccaccaggtccccaccgtctgaaggtgtccatcattggtctgggctggtgtgctgagcgatgtgtttttagcagctccctagtgcctcagatcagccaggcccgagaaccactaaatgagatctgccaaggagtgtttccttcagaagcctgatcctaagaatcccaggggctctttggccaaaaggcagattcctcagctcctcactgaacaggagaaatcaagaccccaggaaaggggcttaggactctgcatgttgctgaggaaaatttggaaaccctgatttagagtcctttcaagtcctgccacttttgaaccagaataaactcaccatgtacctgtactctgagctgtattcctttagccaaagcaagatgtgggtttctagaaaaataaatagttcttctgcctcacccctggtgttttagggggagctgaatgggcagaaaggccttgtgccctcaaacttcttggaagaagtgcctgatgacgtagaagtctatctttctgatgctccatcccactactctcaagatacgccaatgcgctcaaaggcaaaaagggtaagcaaacctatttagcctttttaatctctgtcccgttctgccatatgtggtctaatacaatctttgcactgatatttttatatcttgggccgaaaagcgtaaatacaccctgaattttttttctctgccctgaagccatgggagttgtacctaaaaattcttaattctaaatcttactcattttacaaaaaaagaccctttcaattctaatcaatcaatctgcctttactcacaaagaaatgtcccatcctacattatagaagcacatttcagtttgatcaagagtgaaaaggggatggctcctcttcaaatttggtgggcaatggaggttatttgccctctgttaggactttagtctcttcacaaggatccaagggcttctcaagcatattgaactattagactacattcatgtttagtatctcatttttattttatttcatcactgcaaggttttctatattatatttttatatatatatttttatttctttgctcatctgcttggaaacagaagaagagtgttcatttcacaccttaatcaggcaatgtagccttcacgtaagtgagcaactgaagataccgataaagataccaacttaagctaccttaaccgggccagtgtggtagacttaaggcttcattgtggggttaaaaaaaaaaaaagatacaaagaaatatgtctcaaaaaactattggacctaaataattagaatattacttggtctcagttgtaaagcaactgaatttatagtgaagcaaatcatctttaataatcatttcctactatttgcattaagaatatttgaaaggccaacattgggaacatatttcttaacaagctaactgtgtgtttacatagagagagctgcatattgcattgttagccactcttggaaaaagcacaacctaacaaacatgtttactataggaagctttactttagaaacttaacccaaggtcaagcagatgagtagtgaacacaggtgatcgagtgttggctctgaacactccaaacactggctcgagtggccagaacgtgttttccttaagtaaccctgcctctaccttacgagagagctatgctcctcctcaaagcacaatcatcctgtgacagaagttgctgcaacacgcgtttgttgttggtataccaatgcaatactaagttgatgaagcacgcagctcaaatgatcacattagatggaatagatggtatcttcaggtgtactttgggatgctttactaggtgttttccattagaattagaccttgattttaaatccaagcaagcttgaagccccttggcttacagcatttgcctgctgaatactaaacactcacatggcaagagttgctctggagaggtagggccagaggaatgctgctgcactgccaactcaggcacatgcttagctgtaaagggaagcgaggtgaagtcgtcctgcagcgtattagagtaaaagtctacccctctgaagcactattaagcgcttaacgtatatttaaatactaccatgtgctatctactgaggaagattcatgttcaattatttggaaataatgcaagcatccactaagggcctttaagctttctttgattataattaaggttcattttagtttttttttttctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctatctccatggttaccaggagttggtgaaagtagacatcaggcatggtgtgtcttctgggaataagtgctgggcattctcctctcccaggagatccatcccaaggcccctgtgtatcatctgatgctgaccttctgtctcctcatccaggaggaggggagggcgtcaaggattgtgaggtggtctttctcccacaccatggtgcccaccatgtctgcagtgggttaatgcccaggttcactggaaggcccggctgaaaccacaaacccccttcactaggaaatcaggctccttctggaatctaggagagaagtcagaatccactgattctgctggtggggactcctttggaaatatggatctgagagcgtcccaatgacgcaggtgcgatgaggccaggtaatctccggaagtcttaacaactcctccaaacagactgaatttgaatggtgacaagctgctttctctcctctttgagaaaaagaagccaaaccatctaaattccctcgtgtgatcccatgtttttatacaagagctcctggatttttcacttctcctttctagccactccctgtgtccgctacagaacatgatctgtatggagagaaaggtttagtgcagaggaaacatgaaatcaggccagaccagaggcacagaagaggagaatcctgagttcctaacagttccgttttgctacgaatgagacctgcaaaatggatccttgtcctttggggttcctccagagactgattttaatcagcgaggcattttcacaggtggctgtcacccgtctgcatgggcatttctgcttgatgctcagaactgaaagggcccatctccatctggactgtgtttccaccacctccatcacctgccctatttagattttccaggaaggcagtgagtgtctccggcataaaacccgctcgcctttcagtggtgaagggtcaaggccagggagctttctgactgcgaaattgccggttgcttctctcactttcctcctccatgcagctcggtggccctttctctttctcgttggtccaatttctcaccctctctcctttttgtagaaatactgagtctgtttcgtgtcctcccaggagctgttagacactgaaatctgcagctgagctgaattcaggttggaatgctgcacccttttctagttgcaaagacgcacagggttaaaagaaggaagagcatcccaaataggcttaacagaaaggaagccgggatccccagaccacaaaaccagtgcaggtggggaggccgtgcagaaatgtgtgtgtccttctcatgtcagaatcttaaaaacgttttatgagcaaagttaatggagaaggcaagatgtttaatgaataataaagtcgggccatatgctttatccagagaaaagagagaaagaagtacatgtgtgcatgcacacacacaccacacacacatgcacacacacacacacacacacacacacacagagagagagagagagagagaagctgcaacgcattctttgttaacccaaccacaatccaattaatgatgaaagcattttagccttgttccagaacataggggagatgtttcagatctgtttctgttacctcttaggggacctgaaaggaaatccctactccaaaatattttccaaattaaagtgtctaacaatcagctctgtcaacaaatgccttttcctctccctgagttcagtgctggcatattttcagaggtggaatttgtagttatgtctataaagcaccgactgcccctagggtgagaagccctcatggtgccagcccatcttctttaagcctgttttctccaaagagttcttaaaaggcattttcccaaatctggaggtgaaaggcccccagggccataatatccatcgtcatcttctaagcaagaacacacatggcttatcctgaagatgaattcacacggcaaaacttctctatatgtttctgggtggctgctccggatttgtacaaatttcccacccattaaatccaagatttctgctctctcctccacaagaaaaaataaagaacataagccaaaatgcccccaacatccacactctctgattataaacaaaatccacagtgatccccatctcttctttggaacaaaatccttcttccttcccaaagagtcacctctactggacgcttggtattcattccttcctcttaattcttgcagccaggacttctctgtaggagccgaatgccccccacccccttcactgcccttccctccaaggtttctcaagctatgactaccctcctaccaggtggcccaagcgccctttcccccaccccgccccccaaacctgcaaccagtctgtgtctcaaatccccaacgttctctaatggaacttatgtctaaaaagtcaccttggaccgtccatggtcaaatggctgggctaactgcccctcctatcctgtttgatgtcctaggagcgtgtcacactgttgcccactctcctccagaaattcctccttcctggatttctgtgcatggaggactcctcccttctctgctttctcctgacccagatgttgttgccctgagtccccttctgggtcagcccctccttccctgacagacctcctctcccatggctcctaccacactctgagctctaactctggtgctcccccagacctgtcccctgagctggtgcctcatttcccaagggctccctgacacactgcctactcaccttcaagcagctgcgatgaaacatatctaaaattaaactcactgtggcgccctcacacacacctggctctggtccggatgtcattctccatgtcaatgacttccttccacctgcccttcctacccttccataaccggttgtcctgtcccatctctttgagctctcagagctgggtcttcctctgcctgaactatggcagcaacccctacactactcccagtggcaatttcttcaccctccagcttttcttttgttttggaaacatgcatcagactctccagtgatttccaaaggcatcatcttatttaatcctcaaaataacctttcaaggcaagaggacgacttgagcccaggagtttgagataagcttgggcaacataatgagaccctgtctctacaaaaataaaaatttaaaaattagccaggcatggtggggcacacctgtagtcccagctacttgggaggctgaggtgggaggattgcttgagcctgggaggtggaggttgcagtgagctgagatcacaccactgcactccagcctgggcaacagaaaaagatgctatccccaaaaaaacaaacaaacaaaaaaccttttaaggttggtactcatatcttcccattttacagccaagatgagggaacaacttgcctaaggtcccatagatattactggaaatgccccagttaacattcacagcatttattcagcctcatttatttacatctacagattgtgtttccagttatactactattcccaaagctgtttatatattgatttaaataaagggttcttcttttggtacatgaagctgtgtaaattttacacttgtgtttcatattaacagttctttccctgtgcaccaggaaaccgggctcatcacatatgctcatgtgatcaagacaaagcaccttaaataaataaatagtcttgagactgtggaaatatatgtagcacagtggttaattgtcccctcctgctgtgtgggctttagctggaattattatacacatgcatacacacacatgtgcactcttactggcagacatgcatgttcacatatgcattcacacatgttcacatatgaattcacatatgaacacacaccccacacgtgcacatatatgcacatgcttacatgcacacacatcccacacacatatgcatgcatgcatacgcacgcacacacacacatacacaccccttacctttcctcgcttcaaaatttagagctctattcattctacattacttagatttcctttttatcatcctcacttgcaaagctgtctatttttacattcattccaagggcatcatctaatgatacgcagtagggagtcacgggcttttttaaaaagcacagctctaaagtttgtggaataaatgtaaatgtgttcacttgtatggaatttttttcatagtaatatatattttgatactctttattatatataggacagtatatagtatagtacagatacagaaaattgcattaagaaagtgtactgcctagtgaaataatataaccaaaactttcatagctgccatccaagtcaagaattaggacattgtcagcccctcgccgctccccactcccagatgctgttccaggcaccaccctgcactccactttggaagtcaccgccactcttatttcttcataatcaatccctggttttcctttaaagtttcatcactcaagtgtgcattctaagcactgtagtttggttccgtccactttaacatgtctcgtaagtctcttttaattgacattgcttttgtctcttttttcttttatgcataatttatttgttgaagataccaggctgtttgacatgctgaggtcccgtggttaggattctactgaaagcatccccatggtgtagtttaacctgttcctctgttcctcatctttcctgtaaactgggagttggactgatatattcaatcagatttaggggggcagtttcttaggtggtgtggtgtttacccaccaggaagcacatggtgatccattgtctccctttttatgatgttagcagtcatgggtcctcagtgcttagaaccaagatcttcctagaagtagtgaaatgatgacactgtaattctaccatatgttccttactagctggaataatttcataaaaaggccatttctttaatgttttatttgattttgtagtgatacagttcatatcggacagttcatatagtacagttatttctcttttgctaccaatttttgaaataatgagtgagtttaacattcaaaggccatcaattccatttttgcagcaacatcatgagcttgtgggtttaacatgttccatgtgttttcactcattgctgttgctgtttgtggcagtctgttcttgcattgatataaaggaatgcctgagactgtaatttattaaaaaaaaaaaaagagagagagaagtttatttggctcatggttctgcaggctatacaggaagcatggtgctggcatctgcttctagtgagggccgcagggagattcaatcatggtggaaggtgaaaggacagcaggtgtgtcacagggtgagacagaaagagcaaggggaggggaggtgccaggatcttttatatttttgtttgagacagagcctctgttgcccaggctggagtacagtggcatgatcacggctcagtgcagccttcaactcctgggctcagatgattcttccaccttggccacccaaataactgggactacaggcatgtgccaccattcccagctaattatattttttgtagagatggcggtctcactatattgcccaggctggacatgaactcctgagctccagtgatccttctgccttggcatctcacagggctaggattacaggcatgagccactgtgcccagccaccaggttcttttaaacaaacggatcttttgtgaactaatggagtgagaacttgctcatcatcaccaaggggatggcaccaagacattcatgagctatctttccccatgaaccaaacacctccttccaggcctgacctccaacattgggaattacctttcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtattaaagaactaaggcatggaactccagcctctagctgctgatgctcccttcttccctttttccctccctttccctctccctccttcctctcttccctgcctgtctgctgactgacaagtgttgttttaaaatttggagcctgtgttatttttctcaacaacgtaggccctaatagaatccagagttcacaggacatatttgggtgtgtttgtgtgcacacaaaccgggcagatgctggagaaggcactttgcagagggcagggcccttgccgtcacagcaccatgccacctcctcccgtgcctcgcccatggcctgcaggagaaggccatctctaagtcgataccctgttgccagtctctgcccccatgacccagacccgcctcaggggctgatgaagccgcccgcaggcagccatcccgcaccttgatgatctggccttctttaaagggaagctcctcctctgcagcatctgggtttggggacatggtgagcgggtcgtagtcaaagagagccacaaagatccgggccgggagctcttcggcaccagggtcagtttctgactcttcatagaagtctggagaaaggcggtctcgcccgtaatcgtctgcgagcaagtgggggtgaagaacagagcggcagtgagcctaactgaggagcgtgcacgggaaatgcagctttggaaagcagtgaggatggcagcggttccttgacttttgtcttttttgtgtcttaacatgtaggtggaaatagatcgggaggtctaggtcagatgaattggagaagcacataaccacagccacactctgtacctggccacactgcatgtgaaagcattgagacagggctgggcctcgggggcctcctcagagagcacaggctggggcaggggctgcggccgtgccaggggcaggatggcccatgctggggagccttcccaggacccacacactctgcaaaatggaaagctaagcacagcccacgtttaaaatgtttgtatgttagtcaaagtccatagaggtgaccaactgttcacttacgtaaatatgtaactggcaacaaatgcatccttattacagtgaattaataatttcctggtgaattgggtttcaactccatataccacccagcttccaaaagtggttcttttggactagaggaaatggatacattcctagacacacacaacctcccaggattgaatcaggaagaaatcgaaaccctgaatagaccaatattgatgaaatgaattcactgctgaattctaccaacatacaaagaagagctggtaccaattctactgaaactattccaaaaaattgaggagaaaggactccaccctaactcattctatgaagccaacatcaccctgatacccaaatctgacagacacaacaaaaagagaaaactacaggctaatatccctgatgaacacagatgcaaaaatcctcaataaaatactagcaaactgaatccagcagcacatcaaaaagacaattcaccatgatcaagtaggctttatccctcagatgcaagattggttcaacatatgcaaatcaataaatatgattcaccacagaaacagaactaaaacaaaaaccatatgattatctcaatagtgcagaaaaagcttgcaataaaatccaacatcccttcatgattaaaaaaaccctcaacaatctaggcattgaaagatgtacctcaaaaatagtaagaggcatctgtgacaaacccacagccaatatcatattgaacaggcaaaggctggaagccttcaccttaagaactggagcaaggcaaggatgcctgctctcaccattcctgttcaacactggagtgctatagccagagcagtcaggcaagagaaagaaataaaaggcatccatataggaaataagaagtcaaattatctctcttcactgatgatacggcatccatataggaaacaagaagtcaaattctctctcttcactgatgacaaggcatccatataggaaataagaagtcaaattatctctcttcactgatgataaggcatccatataggaaataagaagtcaaattatctctcttcactgatgatatgattctaaacctagaaaaccctgaagactctgctaaaaggctcctaaaccaatagacaatttcaataaaatttcaggatacaaaatcaatgtataaaaatcagtagcatttctatacaccaataaattgttcaagctgagagccaaatcatgaatgcaatcccattgacaatagccacacacacacacacacacaaaatatacagaatacatctaaccaagacacacagaatgtacctaaccaaggaggtgaaagatctctacaaggagaacgacagaacactgctgagagaagtcatagatcacatgaatgctaaaatattccatgctcatgggttagaatatcattaaagtagccatattgcccaatgcaacctacagattcaatgctatttctatcaaacttccattgtcattttatatagaattaggaaaaactactctaaaattcatatggaaccaaaaaagagcccaaatagccgaagtggtcttaagcaaaaggaacaaatccggaggcatcacattacctgacttcaaactatactataaggctacagtcactataatagcatggcactggtacaaaaacagacacacagactaatggaacagaatagagaaccagaaataaaaccacatgcctacaaccctctgatatttgacaaagctgagaaaaataagcagtggggaaaggactccccattcaataaatgctgctgggataactggctagtcacatgcagaaaattgaaactggactcctaccttttaccatatacaaacattaactcaagggggatcaaagatttgaacgtaagacctcaaattacacaaatactgcaagaaaacctaggaaataccattctggacatcagccttggcaaagaattatgactaagaccacaaaaacaattgccacacaaacaaaaattaacatgcatgacctaattaaagaacttctgcacagcaaaagaaactatcaacagagtgaacaacaccctacagaatgggagaaaatatttgcaaattgtgcatctgacaaaggtctagtgtccggaatctgcaaggaacttaaatcaacaagcaaaaaatgactccattaaaaagagcaaaggacatgaatagacttctcaaaagatcacatacaagcagataataaaatataaataaaaaatatatttaaaaaatgtataaaaataaataaaaatgctccacatcactaatcattagagaaatccaagacaaaatcacaatgagataccatctcacaccagtcagaatgacgattaaaaagtcaaaaaatagacgttgggggtgactggcaggggagaaaagaaacacttaaaaaatgtatataccattggagggaacggaaattagttcagccactgtggaaagcagtttggagatttcttggagaacttaaaactaccatttgacacaccagtgccattactgggtatatacccaaaggaaaagaagtcgtttcaccaaaaagacacaggcactcaatatggtgatcgcagcactgttcacaatagcagggacatggaatcaacctagatgctcatcaacagtggattgaataaagatgtggtgcgtataccacatggaatgctatgcagccagagaaatgaacaaaatcacgtcctctgcagccactggaggccatcatcccaagaaaattaacacaagaacagaacaccagatacctcatactttcacttataagtgggagctaaacattgggtccacatagacacgaagatgggaacaacagaaactggggaacactagatggtgaaggagggagggggcaagggccgagaaactcctgacggggcgctatgctcactacctggatgatggcatcatttgtaacccaaacatcagcattctgcactatacccatgtaacagacctgcacatgtaccccagtgaatccaaaataaaagttgaaagtttattttaagaaatcaaaacaattattttggaaatcctaatacatatgcatatatatacatgtggatcactaaacatcattagatagatgtgtacatatgtgtatatatgtatggagagagaatgggaggggagagggaactgacagataatattggtctgatcatgggaggtggtctcacaacaccatcagggaagcaagtgagaaacacgccagctggcagcagagagagcagcattgggagaagcagcccagtgtgagcttctgtcccagcacgaggaacacaggtggtgggacgagatgacacaggtatgcagaagagacaggacaggtggtggagaaagaaccaaaccgtttggcctctttcaccagaaaaaataaaacacgcagtctaacaaaagcactttggctgcaggaaaggttgaattttaaaatgcaatgaattgtttacattattgagattcagagtcttttttgaatgcctaatctaaaatgtcagtaatttctgccagggaacaaaccttttccacagcagccttcattaatttctccaggctgttatgattttgttgatagtccatgaaaaaacctgacttttttctagtttcaagtggtatctgagttcaatagaatgtgaagcgctccatggcctctacaacaggcacagctgtgcagcccctgctcacacccagggatgatggtggagaacagctgtggctgcatgagaaggacgcctgctttccattctgctggagatctgctggaggaacttaatgaccatgtcagtgtgatctagtgaatgcagttccaggtacggaaaaatgccagtggaggagaacctctggctacaccattttccaagcaagttctcagcacttcccagctgagtttatgtggcaagtttgtggcatcaaaacgtgcagaggggtcaggggctaaggtcagattctagagagagttgggtgtggtcaacataccccttgaaaatctttcaggtccctcctatagcctacgtaagagtgcattttctcagtaggtggcttatactcaaggaccatgatctgtgaaaacatctttgtgtcttcaagtccaaactcacatggaccatgcaactggccacaccacgggaggcatttaggcagacaccccaacacagagctgcctgaggccagtcccccaacgaaggctccttccagagaactgcccacaatgtcacgttgttttggggggaagacaggtgtggggtagaggtgggtggagcacttggagttgaacgtatgtgaataaaatcagcgtatgcggtgactccaccgtatgttcttccagagaggatgcactggatgtgttatgagcaccaaacctcgacagggaaagagtagcagcctccctggaatgtgtccatggaaacttggcttcactgcagactggactgggcagttgggggtcccttgtccttggtgatggcaggcgagactgaaagaagcacttacctacagctgtctgtctgaccctggggggagtgggcactgcctcccatcctgctgaggaagtgtgctggcccaaggggtctttgttaggaggaagggtgtgcatatcgtgtgggagatcagggctcatgcctggacgcctgggtgggctcccaaatccactggtgccataagaataagcaccgtcttctacaggagagaggtttccctcactacctggcccagaccgactgccctcactgctactgtccgttgtaatttctatggagataaagggaatcatctattaaacagagttgacagcttttgattttttttattgcagggaaacctgaagaaaagagctcccctttttaaggggcaaagctttgtcaatagagttactaatgtttttatttttcctccctggacacaaagaaaacacgctggactttcctcactttgtaggctcagtagccaaaataacaaaaaatgggagaatacagaggagatattcagagttgattcctaagaacagaatcctcttgaacgtggtgcttcggttttagaagagtgaagctacaggccttctgtctgacaggtcaacaactagataaatgcaaagaccaaaagttataaaggataaaaatcaaacctaattaagtatatatttgaagccacataattttgttttttaatcatgaaggacattttttaaattttggaaatccagaaaatattaaaatttatattatttttcattgtaggtccactgcttattaaaaataggaagtgtatggtttacagacttaatttcctctgaaaaagataagtaatcctttgaaatatagatttctaaaatattgttttctagtattttcacaagaaaaatagaagtaaatgacaactagaggaatatcctgtctgttcagctgtcactgatgttcatttcccaaagctctttgccgagtcctcctcctcctcaggtgggtgataagcaccctccgcttctgtttccttttgaaaccataataggtgctgagatgtgtatttgtgtgtaaagtatctggttagagttattttatgtggtgtcccggcttgctacatgataagaagtcagcacaattaaagcaaacctatcataggtttgtcagttaactcttttctgagttatgttcagaggctttttccttgttaaggtgttgacatagatttgctctttcacccaatttaacaagtgtgctactgaaattaagacacgcatgcagcctttggaattctacggcttcagaaaaatccaaccacattcatcaaaagtagtttcatttgggaagggtttttatgatactaataaaactttaaagcttctcactgctgatgaatgcagttttaaaaaaaaagtctcaacaatatacagccatttgaaaagcaatactgatctaggaaaatagcaaaccaaagcggagacaaaaaataattatttaagccaatattgagtctaagtccaagcaacaagacaacccaggacagtagatttaaaccagactctgacagcgagggtcaccctggcaagactgcaggcccagggttggttttcttggacttcctggctcaagtgctgatttgtcacagcacaattttcagttctcagtcctaggagactggagtagaagacctaccatgcctcttccaaaggacgtcctttctgagcgcctacagcattaacttctcagcggctacaccatccccaggtcacttcctgagccatgcttgcagtcttcactcattaaagttacagtcaaatgaagactcgaaatctcaccctaaccacagagagagaatgagagccttgaacagggggattggccttttccccacatcgtttctcaaggcaggacatctcggacaggtcatttaacatgaaagccaggagaaccgatttattaagctccatagtccctccagagggaacgacacacgaattgaatgaagatttgagagacacacactaggtttagaatacccgaaaggaatctgggctccactaaccctgctagctgatctgtaataagtgccatcaatgttctgtgagcctgactgcatcttttattactcagttaactgaaaatacggtttcctaaggatctttaacattgcatgaaatttttaccagagaaacataaacacaatctaaaagctgtgaagatggaatttttttcttattgtttgaattgtacaaggaagaaaaagtctggcaggacacaatttcaaagaatctgttttgctttatgaagcctttcttcattttgaattgatggaaaagaccaatggccttttaaacttcagctatttcaacgagattccaggtggcttttcagtggcctagactatccagaagttatcctccttgagccctgtcatgccaaaccaagacggtttctcctcatctatttctgctgtatcaagagttctccctgcatttatatgtgtgtgtgtgtgtgtgtgtgtgtgtgtgtgttttcatagaagcctggttcctctgtgctgatgaccagcttccattatcttgtgcataatactttttggaattctccttgccatgattgattccaataatagaagtatccccctccatggattgattaggatgactaaaacgatagctttcagcatggctggctgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccaagggaggatattcaaaaaaccagaggtataatcattgaaaaaatatgacaatcgcaaagtcttatgcccaaaagttatgggctaatcttatatataattataaatagacaaaatattagcatactgagtctagtaacacattaaaaggataatatatcatgtcaaggttgaacttatttatcccagaagtctttagaatgatcataaagaaagggatggaaaactataaaagaatagaacaccttaaaaatgtgtggatttgcaaaagaagcatgtagaaattctaagattaaaaaaatagtgttggaaataaaacagtcaacggatgtgaagtaggaggcggggcatagctctggaggcagggtccgcactccagaccagatcaaagactggctgaaaaacaggaaggaggtgaaagcagcccttcataagacacgcccaccagtgcaatgtcagtttaccattgccatgggaacacccataagacacgcctaccagtgttatgtcagtttaccattgccatggcaacacccagaagttactgccccttttgcaagacaacgacccagaagttcccaccctttttctagaaatttctgaataagctcacccttgtctgggatggaattaaaagtagatataaatatggctgcagaactgccctgggctgctgctctcaggcactgcctgtgggccctgctctgctgtggtgtggtggtcacggggctgctaccctgcacctccataaagctgcttcctcctaccaccagctcgctcctaagcacagccaaaatccttcccgggctaagcccagtgtggggttcgcctgccctgcttcagacggattgaagatcagatcagatacagcggaagaaagaactactggactggaaggtaaagctgatggccttttcccccatgaaccacgtagagatgaaggaatgggaaaggaagaggagaaccgtgggctctgccaaccattcccctgtgggagcgtgcttggtctaacctcactcttccttttccattttgctgtggccacctctgccacctcagaggttcctaggtgccattcccactgcctgggcctctcatattctgcctcttcccaggaataattttcatttcataggtgtcagctcaagtcccatttaatgcattcaacaaatatctatcgtgcctcgtgttctcactttgactcagcagaccctgtggatagagagtgagacagacaagtccctgtcctcatggggcacacactcaaggcttgggggcatggggagcagatcatcaataggatgacacagaaagaagcatattttaattttgataagcggtacgaaggaaataaaacaagttttttcagggaggccttccttggccatctgatctaacctggccccctattctctaacacgttggtcaatttgtcagacccattgagcttaatccatgagaatgtcagctctctaagagcagagccctcatctgccttgcttatggccatgtccccagtgctgtggacacaatagctgttggacaaataaaagagactgtaaataaataagtgacttttagtggctctcagaggcaggtgctagcctcccatggctaattttaagcctaggaatgtctttgctctcatccatcccctccccctttgccagcagtgtgctagtaaaggtttaacaattaactcttcaggaaaacaaaatgaccagaatacaataaatacaataaacacacttgatttgtcatgtttgccaatttccatggtgtaaatactcccatcgtgggcaacttcaagttaccaacatgactcaccagacggagatgggaagagatgcctgcagcccccggcgagcgtttcctccacgcagtgagcctcaggagcacaggtcatcacggagtgcattgaagctgagttctcttctacctttatttccaatacaattgctttaaatgtacatttatgtaatttaatttttaataattctgtgtttacaactggctcacaaaattcctggaaaaaaaaaaaaaagcctgtatgaacagactccagtgcacaactccctgatgctgagaatgaccagaaatgtaagtggattgaaggaaagccaggtcgttaactcccaaatggcttcccacaaagcgagaagtttcttcctgcactggcacaaggaggccaaagaccaaaagacatgtctgagggcaaaggatgggggtcatatgttatttgactgcactaatggcactcagttggcaaaaacctccttttgtgagtgaggcccacattcccacagcgtctgagataaatgggctccacactccagaatcccagctaattcagctagtaggaatgcaaacactgatctaaattgaggccccagaacagtctcttacatcttcctcgccccaggggggatgaatgaggaagattacttgtggattataattgcttaaaataggttgtgatgtaaaaatctaatcccttctactcttcagtagtaaagtcctacagacagagaaattatgcttaatgccagtgtattgaaggtaaaaagaaaattccgttctccctctgggggaagaggaaggacatctttttagagctgtcagaattcacaagccataataaattattctttttcattactgatttattaagcaggctgcttggtgtaatggcagaaaatttctgtttaattttcatagtattagacgactgtgattcccgatctgaaatcaacttgagttattaaaagaagggaatgtatttaatgtcgtgcatcagggtctgtcttcattaaattcttccaactacagggtttaagcatttatgcaacatggctgttgtttgcttggaaacgagacaacagccctttcttgggacagtctgtgtcaggtgtgctcagcccaatactcttccattttagtgattggcaggaaagtcagccataaaatgctaaaaatgggtctgaaaatcccaagctaaagaatcatagaacccaaataattctctaccatacattttcactggaattaagagtttttaaaatacaactgaccaaaatgtgagaatcattgatgtagctagaactggggtaagcatggtatgtgtcagaaactttcaatcacatacatgaaattataattacgtgagcaatatttgtgcccacgaaggagcaaaacaacggtgcctggctgccttttgcttatccctctgctgctgggagggtcttacactgagttacaggatttcacagatcttagaataaacaagcactcaccaagttcttactacgggatgagtaagactcattttcagccctagagggaggttttaaaatattctggaagacaattatctatcgaagatccacatgaaatacgggatgtacaagtcaggtctgagaaggtgcacagaggcatatactccaccccacctggggggtctcatcagctccaccccacctgggggttctcaccaggagctgagccttcccgggttttatggaattcatctgcaatagaaattttgaataaatgcagcctcttactgccttgcataatatcattagaattttcttgaattagcagaaccagtgagtaaccgggtactaccccattctaggtaacataatctctaggttgttctgttgagtttcacttagtaatcaatctctgagtttgcagaagctggccaggtacaaacgaaatgtgcaactctatccaactgaatgagcttgggacttctggccatgttctaaatatctccttggtgtcttcatatgggcatccacttttcttggatgtagctggccaaatagttgagaccatttctggagtcttcaatggggctctgctactgaattgttcttttcacatggtgctttgaatactagggccaccatgaaggcaaatgccatttgttccccatgaatagagggaggtggcccggatcaccacccagcaacgtgcccggcacaaggagggcactcatcagtcaccagggggcaggtaagtccaacttaccatgactgcttccacggctctggcattcccatagaaggggctgggccatccgtcgcaaatacattccgataaagatgaatgtttagaagaaaataaaacaggggcaaagggatagaggtaacatcagcacaaggaggcagggtgaggaggatgctgtagatggtgtgtggatgctgtgggtctcagagggtgcactttcctgaggctgggatgaccacagaagcccatcctgtgaggaggtgaggatggcattgatgctgaagccctcacggggcccagggaagacagaggactgtgtggagcccaggagagctgggcaggaaccaggtcacacaggactttccagcccccaggagggagttggcattttcctctaagagaatcctgggtccacagatggttttaagcaagagagtagcacaatgtttattttagaggggtcccactggctgcagagtaagaaagaagatgctgactccaaatgacctccaggcaaggtgtgaggtggtgtgtgcttgggtggaagagggcatgaatagcaagggctgtccttgaaatatgtttggagactgaaccaacaggtcttgctaattgactgaatatgggtggggagggtagtgtgagttggtatccggaacgacacctatgttttttggcacctacggttggtggatggagttagcgttcagcagcaagagaaagacggggaggagaacaagcctggaaaatggagtggctgaggtgggagaggaaggctcttgctgactgaacaactttgtgttggtgctctcctgcctccccgccagcaggattcactgggcctgtgacatgtgaccacctcctgatcagtccacggcccgcctcccaaaatggtgccaaaaacaccgcactgcatcttcaaggaaaaacataaataattccctgccaaggcattccagcctgactcaaaggaggtggggtttgtttgaagaaaatccagctctcctgggctgccacccacctgttcatccaccagggacctcctccttgaagacacctggatgttttggacttggagtcattgacccagtttgcggatggtaacgaaggggcaggagttgtattcacaaaacccactgatccagaaaaccacgatcgggaaggattttcaatttcaatggcaggggtggtgggggtggtgggggtggatattaaaggggaaaaaaaggagcagaaacaaaaataacaaggccattaatctttcattaagttaaagggatgaaaaggaatcgcttaaagtatcattctctcctcgcaccacaagcatgttgccccctgccaacttcaaaggctccgaagagaagttggttaatatagttggcacagtatcaggctctggtttacttttgcttaagtaggatcttttttttccttttaaacaaagacagcataagggtcggacgctcattgatgggaggtgcaacctgtaacagatgcctttgtgttgggcgcagaggcctttcgcggcggctctgccaatccgcggtggttgtggactatttgtcacagactccaacaaccatcacaggaaaaaaaaatctgccagaaagagggtagagaatagaatcattgttctgttcattctccgccttccgcctctgtagagtcaggcctgttctgtgactcggcatcagggctcctggtggccttcctcaaaatgcagtttgcaggaaagcaagccaagtgtcccacttttcctgcagagtgagtgagcggacaatccctcacctgtttgcgaatggggggataaagagttctgcgctctgggaggctgtatttttctttaaggcagttctgtttatactgaaaacagaactaattggcagtgagtggcagggctttgtggctaggccttggctctgtgttgctgcggctgcaggggcagggcaagctgtccctcctggcaagtgccgaggtctgtgtttgttgggagggtgtggtgacctgcggaggaggccagagctggaagcccagcagaggtttctgaaggccattatcaatgtcctgccatattgaaaggccgtttttccatgtccattccttggtttgttttttttttttttgtacttcattattttcattttcttaagagacagggtctcactgtgtagtccaggatggaatgcagtggtttgaccatagcttactgcagccttcaactcctgggctcaagtggttcttcggtaccaccatacccaactacttttttttttttttgtagagatggggcctcactatgttacccaggttggccttgaactcttgacctcaagtgatcctcttgcttcagcctcccaatgtgctggaagggattacagtcatgagccaccatgcccagctttggtttacttttaatgaggaaggcagagattggggaaaaaagacacgtttgccttttaggaaacacgccataaatgtgatttcctaaagtaagtgggtgcttggccttgcctattggtgccataacaagtcagggttaagtacttcagatccagagatagggtgaccagaggtcccagtgtgtccggaattggtgggttcttggtctcactgacttcaagaatgaagccgcggaccctcgcggtgagtgttacagctcttaaggtggcgcgtctggagtctgtcccttctgatgttcagatgttttcggagtttcttccttctggtgggctcatggtttcgctgggctctggagtgaagctgcagatcttcgcggtgagtgttacacctcataaaagcagcgtggacccaaagagtgggcagtagcaagatttattgcaaagagcgaaagaacaaagcttccacactgtggaaggggacccaagcgggttgccactgctggctcgggcagcctgcttttattctcctatctggccccacccacatcctgctgattggtagagccgagcggcctgttttaacagggcactgattggttcgtttacaatccctgagctagatacaaaggttctccacgtccccatcagattagttagatacagagtttccacacacaggttctccaaggccccaccagggcagctagatacagtgtcgattggtgcactcataaactttgagctaaacacagggtgctgattggcgtatttacaatccctgagctagacataaaggttctccacgtcctcaccagagcagctagatacagagtgtcgattggtgcactcacaaaccttgagctaaacacagggtgctgattggtgtgtttacaatccctgagctagatataatgactctccacgtccccaccagactcaggagcccagctggcttcacctagtggatcccgcactggggttgcaggtggagctgcctgccagtcctgcgccgtgcgctctcattcctcagcccttgggtggtcggcgggactgggcgccgtggagcagggggtggcactcgtcggggaggctcgggctgcacaggagcccatggagggggtgggaggctcaggcatggcgggctgcaggtcccgagccctgccgcgtgggaaggcagctaaggcccggcgagaaatcgagctcagcgctggtgggatggcactgctgggggacccagtacaccctccacagccgctggcccgggtgctaagtccctcattgcccggggccagcagggctggccggctgctccgggtgcggggcccgccaagcccacgcccacccggaactccagctggcccgcaagcaccgcacgcagccccggttcccgctcgcgcctctccctccacacctccctgcaagctgagggagtgggctccggccttggccagcccagaaaggggctcccacagtgcagtgggtggctgaagggctcctcaaatgccgccaaagtgggagcccaggcaggggaggtgcggagagcaagcgagggctctgaggactgccagcacgctgtcacctctcaccagcatccccagatggctccagaatcactgagttaacagcctctgaaaccctcgactttcactgctttgcaagtatcgtcattcaacctactgaataaattaaatcaggttgggtcctggctccatcgtcatccctggtgagttctgggcaggctgctcacagtctgagaacctctgcttccacttggcccatggtgagaataacattcttcctgggttattgtggggactaattgagagagagtacaagaccccatctgcatgtcacaaacacctgctgcctccgtaaaacacaatggggaacagtggcagggaatgttagcttgtccaaagcattgagtttagaaagaagaatgttatggtttttagaaaacatcatgtatgtaggctgaaataaatgtttctaatagcttacctctgtggagagaaccacaaaacaaaaataagttaggaggagggagtggtggtgcaaggcaaacctcgtctgctgagggcctgccacggggtttgggggtgcagctctggggtgccttcttccagcacctgggaactctaaagcatgtggtagtttctttgcagggcttctgtgaatgtgcaaaatagagaacagggccagcacatagtacacactcagttaaagtgaactgttgacatcattgccgcatttagtaagaaaatctatgaatatagatatatagagatagatgtaaatatagatgtagatatatagatacagatatagataatagaatatgtttcaaagcaggccactagaagaggggccagttgctttccaaagctgggggagactgaggcaggcactcagacagcaccgaaccttcaaggatcttatggataagccattctgtgctactagtgaaatagtcatgatatataactatttttttgagacagggtcttgctctattgcccaggctggagtgcagtggcacagtggtagttcactgagacagggtcttgctctgttgcccaggctggagtgcagtggcacagtggtagttcactgagacagggtcttgctctgttgcccaggctggagtgcagaggcgcagtggtagttcactgagacagggtcttgctctgttgcccaggctggagtgcagtggcgcaatggtagttcactggagcctcaatctccatgctcaagcgatcctcctctctcagcctccttgagtagctgggactacaggtgtgcactaccacatctggctaattttctttttatttttgtggagatggggtctcactacgttgcccaggttggtctcaaactcctgaggtcaagcaatccccctgtttcggcctcccagaatgttgggattataggcgtaagccactacaccagccataaccaactttcttaacttccagttaacttctttccatctcagtttggaaaatgaaaatatttcctggctcaaactgtatgtcaaagaaatcacaaaaataaatccctaattatccatttccctacattataatttgactactatacctagcatctgaaccatacccatgtccagagccagggcagacttggtgagttgagatcataaacaactgaaacccaacatgactgaaaaaacaagattcctttcttgctgaggttccaggctcctcatggatctccgggggagttctgccccgtgttgccctcggggagggggggatgtaggttaacagaactgctgacacgtggccaggctccatgccagagggaaaggaagtgtgacaggacctgaccacggtgtgagcctggtcagaaccggacccaggaccccacctcgcagcaaaggggaagcacagttgtgccccacatcgggcactcactggacatgtccaattgtcaagacctggattaccaccaatatgcgagctactccccaatccatccaaatttccttctccaggctggaccacttccctgaactccagacccaaattttcttctccaggctggaccacttccctgaactccagacccacgtattcaactatttctttaacacctgtgtttggaaatctaagaaaaatctaacatattgaaacccaaacttttggtctttctcccaaacatgcttctcctacaatgcccccaattcagttggtggttaattctatcctcctagttagttgcttggactaaaactcttagactcatctgtcttgctcaaaacccacatccaaacaatcagcaaatcctataagctccaccttcaaaagacccagaatgtgaccttcccctgctgctgcttactgccctggtgcaagccaccgtctctcctcccagatgttcacaattgcatcctaacccgcttctctattgccatctttgcaacctttagtccaattctcaacatggcaacatgagatgtttttttaaagataaatcaagacacacctctgctcaaaccttccaaaggcttcccagggccaccagagtagaggattttcagttgacaatggccttcaaggttcccagtgccctgatctcccactaccttcttgagggcgtctgcttcccttctctccatcacctgctcctccaggccactctgttcctccaccctccaggcaccgccatccagaggctctacaagcagctccctctgcctggcccctgctcctccagctacctgtgtgttctgtccctcactgccttccagtggtcagtaaacatttgatgaatgaatgaatagctgtatattcactagtagttgacgcctgggccatgtgacctgtaattttataagtaaggattacaaacactaaaatctttggaaaagcagtagatattggccagtagtgccctggaaggggacaaacgattgttcctcctgagaggcacatttgtcagagtggggctgagtgggcttcacccaaagcatggagtgcagggcagccaaggggatttatcctcagttatccccaggttcgacacgtgcacccagctagaaactctatttcggagctctccctttagccctggccaggaatggcaagagctggtgcagctggtggcccagggatagaagacaaggacccaccccagatcgcccctctgtcccgcagggagagatagaaataagtgtttttcttgtctcttgtttggggcagcctctattttatgctctctcttggagcagttcagcctgtatcctaactgcatcaatgctgtgttcagggcggggggagcgttcgccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttaaaaaatttttcttttcccttaaagtttgtaaaagcccccaaatgggcctttttttttttttttttttttttttttttttttttttttttgagacggagtctcactctgttgcccaggctggagtgcagtggcgtgatttttgctcactgcaacctccgcctttcaggttcaagtgattctcctgcctcagcctcctggcaccacatctggctaattttgtatttttagtagagatggggtttcaccatgttggtcaggctaatttagcttttatgaatggaattgtatgcacttttaaaaattaaatgaaaagaaaacgcacatactttcagtaaaacaagaattacagttattcaaataaggtgacaatcacatcaattttattttataacaaatagaatcatgtcccagttccaaaacaaaataaatagtaatgttaatatagagatttactcatggccttttttgttaaagagtcttaaaatgtttctttggacaatttaaaaattttcaatgttttttttactcccatacaacctagcccccctgccaaataaaaatcaagcatattttctcctgtatcttgtgtataggttatataatagtaccttttatctttaagatatgagctgaaaccccacctatggttgtagtgagcatcctactttacgcctcttatctcctttaaattcaaaacaggtatctcaaaaataaagttaatataggtttataagtaggacttgctcactcctgaaagtacgtttaagtaaatctccaaacacatttcaaatactctcagagagtctgttttatactaccaagtatcttatccacatttcttcaaaataaacaaaaaaatgctcacaaaatatctatgagaaacaagaagataaaatataaaatcttaatttttacgtataaaataaggaagccggtgaatagcaatgctagaaataaaatgctagatctcctaatccccttcccaagtttcatccagaaagataacagttaaaaaaaaagtaaataaaagcttaaaaaaatcccaaagtcatttcaaaaagaaaagcggctgcatcgtcttctgcaggttagaggtagtaaaggcggtttgacagtgacagatttggctctctgtgaatactctggccaacaagaaaagccagcttgtgggcgtactggcaaggagcaggaacacgaatgacaccctttagtggaaggaaaaaaaggttctattactctagacttagcctctttcaattgcaaatctcagtattaaccctaaaagccttttaaaccacagctatttcattttgaaaagtgaatgtcctttatttgctaaacatcaacaagtagaagcacttactggccagttgtaatagatgtggcacagcttgtaggtcaagcgctgtatgtggtctggcttcaggccgctgttgtcatagatgacattgtaatgtgtgggagaaacactaccacttctcacagcctggctcacgataaaaaagtcatacctggaattacagaaaacacacggatgtgctgaaaactaaaattagggtgattccagtttcttacagtgaaaagctctgtaccactcttcactgtaagttactacagtaacctcatctcttctcacgctgtaacgtgcttccttgaagtccaggagcctgttattcatgaaccatttgggactgcttatgtgtgaaagatgtttatcataaagatgatgattttgattttaaatatctgtcatgatgcctcccagcagaaccaagcatttgttacgggcgctaaaaacgatggcatacttggccagttcctgttttccaccccgacccccgaaccatgtgactgagccttcagactctggaagcacgacctgtgggggcagcgagtgggtcgagcttcagggactgttactccccaaacatgcttttaccacggaatcttttcccctcttgctgttcccattgttatttaacaaaagtagaattcattttaatccccaggaatttaatgcgggtctttaagtggaagggaacatgaaagaatataaactagtatgggaccaaatggaagaacaaaaaccaagtatagccatccattgggaattggttccaggacctcctgaggataccaaaatcctcggatgcccaggtccctaatataaaatgatgttgtctttctataacctcccatatacttgaaagtatcatctttagattataatacctaatacaatgcaaatgctatgtaaatagttgttttactgtattgtttaaggaataatgacaagaaaaagtctgcacatgcttagtacagacttttttccaagtatttttgatccgaggttggttgaatctatggttgcaggacctacagataaagagagccgcctgtagtacaaatatgaaggaatacgcattagttttttttttttttcattttcttggtaccaataaaatatcaatccagagatattgtaatttgacccaataaagatttaaggaaattaaccctgcgatttattatgcccatcaaaactagtaaaattaggaaagcagaactgatctacaacagatggtatagctaccttttcaaagaatgaggagttaagaaatgttaaatgacttgttcagaaagaacagcgaaatcatgccagggctggaatccaagcccggcttcccagcttaggcacaaaccatttgcagtgctggtgattacagatgactttggtgctcattaagagcgggcttctcagttgcaacaaaagcaaaaattgacaaatgggatctaattaaactaaagaatttctgcacagcaagagaaactatcatcagagtgaacagacaacctgcagaatgggagaaaatttttgcaatctacccatcttacaaaagtctaatatccagaatctacaaggaacttaagcaaatttacaagaaaaaaaaacattaaaaagtgggcaaagggcaagaacagacacttctcaaaagaagaaatttatgtgtccaggaaacatacatgaaaaagctcaacatcactgatcattagagaaatgcaaatcaaaaccacaatgaaataccatctcacaccagtcagaatagctattattaaaaagtcaagaaacaacagatggcaaggctgagagaaataggaacacttttacactgttggtgggaatgtaaattagttcaaccattgtggaagacagtgtggtgattcctcaaagatctagaacccgaaataccatttgacccagcaatcccattactgggtatatacccaaataaatataaataattctgctataaagatacatgcacatgtatgttcatgcagcactattcacaatagcaaagacatggaatcaactcaaatgcccattgatgagagaccagataaagaaaatgtggtatatatacaccatggaatactatgcagccatataaaggaacaagatcatgctctttgcagggacatggatgaagctggaagccgttatcctcagcaaactaatgcaggaacagaaaacttaacaccgcatgttctcacttataagcagaagttgaacaatgagaacacatgaacatggaggagaatgacacacacactggggcctgttggggggtaaggaggaggaagagcatcaggataaatagctaatgcatgagctaatgcatgtggggcttaatacctaggtgatgggttgataagtgcagtaaaccaccatggcacgatgtaacaaacctgtacgtcctgcacgtgtgtctcggaacttaaaatgaaactaaaaaaaaaaaaagagtgggcttctccaggtgtccgaatagcatcagcagttgctacattttaataatatctagtgaaaactcatgacgttttttatacttcataattcaactgggattttacccaatttgtttaagttactgtcttcaggccaatgtcacatctgggctttggcgttaggagtagtagcaatgttggaaagcatcgggggtcgttttgaatacggtgaaagagaatcctgcagaaatgaatttgctatgttaacatcttagccttcttttgtctttctagccaatttttccccaataggctagaatccttctaacctattagaaccttgtaacctaagccaatgccataacctaacctaagccaatgccataacatctgtctgagaaaaagacagaaatccaagataatgtatttcaaaataaaaatttctctccactgtcagataacagagcagactagataagactaaactctgtatgctattatcattttccacctaaagtcgctatagtattgcctcatttacccaagattcacacaggagaagtgttccacatgtcaactttgcacacaggccgagactttatcctcttaaagtcgccttcttcacaaaggttccaaagcacctacatagaaaaacagaagtcctcccaacgattcgctgtcctgagtacagtgtcaacttagaatgactgatgggttgccatcacgaacatgctcactgcattaacaacacctcacacaaaagggtttttgaggaactcactaaaaatggaacaagtttcggctgggcgtggtggctcatgcctgtaatcccagcactttaggaggctgacgcgagcggatcacttgaggccaggagtttgagaccagcctggccatcgtggtgaaacctcgtctctactaaaaacacaaaaattagctcggcatggtggtgcatgcctgtaattccggctattcaggaggctacggcatgagaattccttgaacgcaggaggcagaggttacagcgagccgagattatgctactgcactccagcctggggaacacagtgactctgtcccaaaaaaggagccaagtttcctgactttctcacggaatcctcccgtgctactaaggccatttccctgtgcctgccggtgcccgctgtaagctccggctggcattctgcttttcttgcggtcggtgagtgcagctcggctcagaagccactttactcataagcacctctgtctcagataaaacttcttgacctttagacaactaagtgtattacaaatctaaacactttttactagaaaacaatctgtggataggttatgtacgtaaaaaatataaaagcaatctacagaagcaatgcttaatctccctatgtgtagttaataccacagaaaataatcctctttcccccaatgaaaaactgtacttggaaacctctgttcagacaccaggaaaccatgggctttattaattatgtttgaccaaattagttgaaaaaattaatgtttataaaaaatataagaacaaaagtaaaatgtattaaaattggtaaagcataggggccatgctaaagaaaccaccaccaaggagaaaacaaccttcagctcatcacatggaacttaccattctggtctggtaacctctacatcaataactgttccaggaagtggattctgaagtcttcctccagactgagcaaaaaatctggtgttcactcttttcttcaccacaattaccgttagtctagggcttaaaaatgatgatgaatgtaactgcatttagccagtcatattttcagggcactcattcattcaggtgttcacatgctccatttaaaaaggaacacatccctcctggggcgtatcatctgtccaggttgtggagaaggatcaggatcttactcttgacaggagtaaagaccacggataaacggtgagagggaaaccaaatggcacatatgtcctgtgacacacggtcatgtagatggtttatccatagaccaaacacattacataccaatcacaccaaaatgttaaatccagcatgtcttcaaaattcacaatttataacagtcttcagtgggcattttctactgtgtagaaaatataatattaactctaaaatctttgacaggtaagtggatttaagtagtgcttttcaaaattaccgtttcactatatatcggggatacacacagacacacattcatacatacatactacatattcatatacctttttcaggaggagtaacttcattttcatactcgtgtttcaccggagtctcaaatgacgttttccgcagaccccaggacggccccacactccttggcctaccacacgccagatgcacccatactagaggctgccctttttagccacccatccccacctggattcttcaggcggctctcctgtgtcaaggttcatcaggcttcttggcctggacacagccgtgcactatcagctgtccgtcccggcagatccctggcccttctgccctccctctgaccctgcggagagcagccctgcacttgcactgcctggtctgcttgagtacctttcacatccttttccaccccctcctccaggctcacttcaaatccttttgaagcagccacacttgtacacacacaatccacgtagttaatccatgaattagaacaggtagcaattagaacagcactgccaggtagtaagcactagataaacatgattattagcacctccatctccaactacaacattagttccttaagaggacagatacacttgatttccaatgctgggaagcagagggttttatacagtatggacctagtaatgtctgactcggcaatgttgctgatgtttttcactgaaaattgaatagggcaagaaactcagtgagagtacttgagtaagcagaggacatcttcagaaatgtccctatctgcctacgcagactactgctgcccagcgactgcccgtgctaatagctctgaatataacaaagccacaatgaacgtgttgaaaatgtgtgcagccctctgtttcaaatgcctctgccacttacagagattaagttcagcatagggccttgttagaaagtgatgactatctaggacttcatgacagcatctaaaacaagtatcagtcttaggaacggaaggacataaggtggataaagttaatcctataacatcacgagaaacaatttagcaaatatagtaacaaaaacaggtcacaaatatgctggcatgactttctgatttgttcttgcatcaaacagtctaaatcagctgccctgtgatacgttgctataaaagcttaaaagcaacatttcaatttgaaagcaaacattgtggttctaatgataactattagacaaacattgaagtccaaactttgcattttctaaaagtgaagaataattttcagatattttacctttatgtacaacttgaaggtttttcccagaactatctaccatgtattgaatacttactggatactgtgtgaagtccattacgtatattttcatttacgccttgcaatgcctcagttaactgttcccttcttctacaaacgaagctaaagctgggattaaccaaactctgattttaagacatattgctttttaccactgatccctactgccacagttcacagtgtgcagtctacttcacgcaacagtgcactaagtgtcagcccaagcagtcgacttaggttctccttccctgcaacgctgtgttcccactcgctgatggagctgggtaggcgcacccaccagctgcaccagggtccactctgcacactcaggacgactgtgcacaggtactcattcactagggtggcaacctccttttcaagagccatttctgccagtccttctgggaatcaaacccaaaggaccctaagaaacagagatgacccagcaaggccaggagtgtgtactcctagtagccctacaattcagctcaagggaatgtgacgaacttgcactatgacctctattcatcatttcttgacaatttccttcacttcaggtatgaggaaatgacaataaagactagaaaacactgtgtgctcaagtagtaaatcgcaggaaaaaaagagtaggaaagaagcagtccaagtcagagcctcctttactgcttgctgcacacaccacaccacacctccccacacagacagaaaggccaagtcagagaacaacatacaataaggcttctaaagcctgaaaacaaagtatcattatttgacaaaatataagcattaagagtcttaagggaataggaaagaacattaactttcatttccaaaatattaaaaaatgcgtggtcttttaatctgaaacacaactatttcaaaaaagataaaaacactcctgactttctctgagaccttcacggcatcacatgtcattttaagaaacgtctgggataaacacttattgtgtggggccttttagcattggccaaagatgactcagaagcccgttagtagaaataaggaatgacctcttggtgcttgtccttttcctacgcaccagataaaatcaagccccagatgtggccagtggctttcagaatccctcctttctataatgatacaaaatgctaaaatacaagaataatgggtgtgtaatatgtatgtgcaagcacacgaaacaggatccaagatcttccaaatatcctgaaaagttcaatctttaaatctgtaatgtattatgcacttagcccttaatacaacagtccctgatttcaaatcactcacagatctgataaagaggactagttaacgtaactgattagaatggctctcttgcgatggtacacattttattgactcataatggcactgacggaaatgtctgtaggagagcagaggaagacaaaaaccaatatgggtttcaaaggaaaacaagtgcagcatctggataccatcctcggctgtccacattccttaaaaggacaaagtagaggctgggagttgtggctcatgcctgtcatcccagcactttaggaggccaagatgggtggatcacctgaggatgggagtttgagaccagcttggcaaacgtggtgaaaccccgtctctactaaaaatacataaattagccaggtgtggtggtgcacgcctgtaatcccagctactcaggaggctggggcaggagaatcacttgaacctgggaggcggaggttgcagtgagccgagattgtgccactgcactgcagcctgggcaacagagcgagactccatctcaaaaaaaaaaaaaaaaaaaaaaagggagaaagtagaactacccctgccccatgagactagatgctcgccaaatcaccttactgatcaaacactagtcaagtccacaaggaaatgaaacaagtattcagtaagctaagactgtcaggaacacttatttcaataatgaatcctgtggacgcctttggatgtacagaattatcagatacttgcactccaaggccttaggtaagaaagaaagctgatcaatgattggtaatggtgtcttactgtcccattctgtgaaggaatgaccctctatactacccctcaacacagccttcttgtgaaaaatttccaatagaaacttccctctgcccttcccatcacctcaaaggccctacagtccctatcaagttaggttctccctcatcctttcatcttgtgatgctaatttcaaagatacaaaggtgcagttttataaaaagaaaatgctttacaatttgcatgcttacttgtaacctctaccaatggattttagacaatccaaaaactgtggcacttcgtagttcaccagtgttttcagctggccgtctcctacgccatcgcggtacacgatgatccggctgggcatgtactcattgcagctattccaagccctcagagccgctgaaacaggccagagaagttttatgtcaattcatgcctacgacacaactcgtctgttcttcccaaagtctgggcccatcaataacacagttcagggtaatttctggaagaccccagtttagagagtagaatggcaaccccacaggtgactaaccttgcaggcagactttgagcccatctaccagctcctgtcctctatcctgaaatatgcagcgtgagaaccagctattcagagaaaaacacagctagaataagaatgcaattgtctatcaatttttcctttctgaattattctatatttatttcactcttagcaatctgtcatctttgtaactgccttaaagacatctgttaacatctccaaatactttataaaaaccttacacagaaggagcaggatacaagagatcccgtatcagcatcacaaactgtgtctgttttcattacaaatcagtaccatgattccagctgctggggagaaaacagaatttagctataatacccagaggcgctgtccaggtttattacacctaaatacgcacagaagcacactcatggctgtgctcttgagaaactattcattgtaagtttcactcttctaaaagatgaaagaccttcagctccatccgttacctctagcaaactaatgcaggaacagaaaaccaaataccacctgttttcacttataagcggcagctaaatgatgagaactcatggacgcaaagaagacaacagacaccagggcctacttgggggtggaaggtgggaggagggagaagagcagaaaaaataactactgggtactaggcttagtacctgagtgatgaaataatctgaaccacaaaccccatgacacgagtttacctatgtaacaaacctgcacatgcactcctgaaactaaaagttaaaaatgataagaccttgaaatatatccattactaatgtcaacaactaacatgccttcagttttcatatattactattcttggcaattcccttagttccaagaaaagcactgaaaaataatgctattatgttgaaatacaagtgactgggtaaactgaagtggtttttctacatcaaaatgtgaaactacatttcagtggccagtaaatattattaaacaaatacatttttagagagagtcacatttaacaagatgtactcgccaatacatatgattaaaaaaaatctgaaatgcagtttgacgaatacaggatgaaagtcattcaagagctagggtaggtcattatttttctttcctaaattcgttgctgtatatgattgagaaactggaaggataacaacgaagaatgaacactactcctgaacctccagaaccctgctttatgtcctcactgccacccacagtagcccagtctcactcaccgggtcatcccttcattgatgctggcaacaaatcctgcgattgacctccgcccagctgtcatgtcatggtaacaatcgatgccaacgatcatcacgagcttcagcttcaatacaaatatggtaattttagatacaatggagtaccagcaacatttaaaaagtaaatccatgttcttaaataccaattttaaaacggcatctaccaattaaatcaaactcacggggatgtccaccctccagagctctcctcccatcttgcagttcatctgtagggcaatctttgtagcaatggccatgacagtttgctgtttgcctaaggttcgggccaccacacactgacttggggtagggcaatctgtacacaggtattttttaatagcatcgtatttgtccttccgattacttgacaacagacagacaacctgaaaacaaagtgcccttgttacaaagaattaggagacagatgattaagagcaagggagaggacaggaaactaaactcacctgtgaagtatcaatgtcaagaacatgatcatttattttactattcatttcagccacacagctaatcagtaggacattaacaaatactgctcatcatgttcaactaaatgataattgcacgtgaaggaaataaatcatgttaagcaaactatgagtcaaaactgaatactgtttaaacttgagaacttaaatatgctctatgtaaccagcacagaaaaatttagtgacaagtgacaggtagacagattaaagatttcccacagtcttaatttactcatgattcatctacaattgtaacttgtaagctttaaagctctggattgagaatctgatcaaactatgaacttccacaggaggtccatggacaattctggggacaaaacagagcgcctgatctcaacatgcccctgccccaattctgggcatccaagtttaactttcgggagtttggtttgttttgtttttgagatggagttttgctcttgttgcccaggctggaatgcagtggtgcgatctcggctcactgcaacctccgcctcccaggttcaactgattctcctgcctcagcccccagagtagctgggactacaggttcgcaccaccatgcctggctaatttttgtatttttagtagagatggggtttcattgtgtcggccaagatgttctcaatctcctgacttgtgatccgcctgcctcggcctcccaaagtgctgggattacaggtgtgagccaccacgcctggcctgaatccagcttgtaactcattgccatgttctccaatttatattcccagattcttctcttccctttttatagtgcccagcaaaataattttcccaccttgggtgtttccattacccagataacataatagctatctgcctgtgggatctaaagtgtgacatgaagggctaaaataatgaacacattagaagaagccaattcatttcttaggcttatggcaacacagatgtattgtttatcactaaatctgtctttgccaactcattgcaatgtggctgtatgaaaactcaacggggcagaagaaactcatcctagcactcgataccccacaatgtgctgctgtcttcagaatgtttcctgtgaactagatatgtactttcaacttgtttttaaaatagccaaggatataaatgcctaataatcagtgaaatcgctgaactaattattgttcacatgcatgtcatttttcccttcctactttacaatcataatgacataatagtagaacctatcataattttccttaccacttacatcttaatctcatattgtcattctatcttttgcaagttccatgttccctcagcagatctctggcaattttatgctacaggtataaaaagcaataggaattgactgaacttctatgtatcacccactacagtcccaggctactatgacctttgtatgtcagttttctaacaataaccaaccaactctgctaaaaataaggagagctgaagtacttgtcttggagattttatcaggcagggccccaataaaatagatggaatattcaaactggacaagttgagagaacctgaataaaaggactacttgtgagacaccctccccaacacccaggggctcatggcagcaagagcagggcagggaatggttatgggaacagggcatgggggtgtagagtgcaaagaaagctcttcaggggtcatggtctttggctcggctgtgctttcacttctgcaaagtaaatgtctaagccctactttcttccactatggaccaggaagtcttgaggccacaattccaagttcttggacaaagactgaatgcaaaggagattctagaccaaatgtgattaagacttggacaactccggagttccctgacaatgagtctggctctattttgctacattaggctgggtgtgtggacttacaagaaaactatggcactgctatcatgtttataaaggctacactctagatacagaccaaaaacaaccatatcaatgttgatagaatttcaggggtgggaggagtgttagagaagaaatataacttagaaagctttcaagttgaaaactttgctggaaaacacaaaggcaagtttgagaaaagtgtgtcagaagtgtgtgcaggggtgtgtgcatgagagagaggatgagcaggatggcagcctgaccacgcctaaagcacaccatggtgaacaacgacaggccatagtcgtacaacatgctggtgcctggaatatagaaggccctgttctcagtgctggggacgcgacaggaacgaggcagatggccttgtactagagagcagtgtgcgagagtgacggacagtttctaaccaacaatttatagaaagctggacaaacagtgaagtcaagacatacctgacagcctaaaaaactagcttgagaaaaggggggtaattttcccctgaataattcaaaacactgatgggattgggaaaatgaagagttaactcagactcgctgagtttgaggagctgactggtggcggcagcagcaacagtgattaacatgtcctgggctactagggaggggccgggcatgacaccgccattaaacttcagaagtgctgtgagggttcactactattattactaccacctaaatctgttcagaaaaggaaataaagccagaagcacttgatgaagatcaggcaaatggctgagccgggatgtgaacccaggggtttgatttcagagtttaccctcttaataactgcgctacagattacaacaaaaatgaaaccacaacacacacttgctgcatgtccccacaatttcagatcaccaatgaaaaccacccgtcattaagtggctgccatcatctaacgtccctgtctccaattcctaaccctctgcacctcccacacacccacgctaggtagcgagactctggcaaacaggcatatgggctcttcgggactcagtcctcccctcctgagtcatcactcactcacctggatgggtgggtgaagcacacacaacaacaacacgtttgcaggtaaaaggggaaagagcttaggagagtggttgcatccctatcccgacccctcggggtgatgtggatgcatgcggaagctgacaagctgctgagtgtcactcagggctccctgctctctgcgaccctactcttcccatacctggcactaggctgtctggggagcttccatgtaattacgcaatcatacgtctacgtgtgccgaacaacagctgatttttacctctgtgcttttctgtattttccaaattttctagactaagtaaagcctttgggtctgaataaattgaagatggctttgtttttctccaccccttcctcaccttttgcagtatgtaaaccaaactcctaggtgcacaactaaagctagcattagcttagctactttatggttacaaaacatattttgtgcctagtttgagaacctattaacatttgaaaaaagaactccaagttccaaaatgtacacatgccccctttgaaaaagctctttcaccgaaaactgcctatatgtcaattagttacttactatctgggtgtctgctgtgaccttttgctgtaagactcttaagtaggcttcagttctgtcatccacttcaatcctagaatgaaagtacacaatccaacactcagacacagtagcgacaaatggaccgtgcataaacaccttcctgtgtaacacaggaaacgtttccgtataaaacatgaaatcaaacaccgagactagccattcatgccaagggctgtttctaatacaaacgagcaatattttaagcacgcaggtttcagaaactgtcttacttggttgcttctcccacccattcttagttattaaaatatgtttctgtttatctgcattacagggagccacatcaaacctttcaattaagataacgtagtttgtatgtttaatagttcccacccctccaaatgactgccaagcaattttcagagcagaaatgacttgattaacttacattattgcttttctcatttgcatgcccatggctggtgtaactttaaatagattttgtatcaatgaattggctgcttcataatttcttcgcgtatagatcaacagccagttatctagtggcttaacactaattaatggtgcacctcttgtttctttggaccaatctgcaaattgtggattgtaatcaaactagaagagagttcagacacactgtaaattccattgtaagttctcagtgatcaagccaaacagtcttcaataattctaccatggcatattttgaaacttagtgtactacttttatgcttgaattaaagggacagagaaaatgtcctcaatgggggtagactctaaaatatatccaaaggatgatggcaattttacttaaaatacactcatactgacagctgccacacaaatgcttacttggaccaggtacttccctaagtgctttagtcgcattctccttaatcttttaaaaaatcttacaagtatagctactctttcttcataatgaaaatattaaaaaataaggctttgagagtaaaacaacttgactgaggtgttatatgccgcaagcaagctacaaaaacatctgacagcaagacagaaagtgaaataaacgcgaggcacagcacccgagtgctggtcatcacagggagcagcccggtgtcttctgcgtgtcctggccacctccctgcctggcctcacgcaggggatagcgtaaacaatgcaaccagaatattaaattacattgtgagatcactgttcacaggacatttcaaaggcaggaaggacattttcttaaaaaaaaaaaaaaatgaaaatgttggcactttacagtgctttaattacactaaaaatatttttagaatacttttccttttctgaaaatgaaacataaaaggtatcataataattaatatattatctctataaacaaatgatccaggccaatcaaatcagggattttccatcattttagtggcagtcaaaatatcaacccaagcagatagttaggattctacactttagctcaagttattgaaaaaaaaaaaaatcgaaccactttttagctaagtcttacagatgatttttgaggacccagctacaggctccacattctctagggcttccacgttttctcctcctggggtgtacctatttctgaggtcccgggctgttcatgtgggttgatagagagtggatgtgcaaggggagaagagaaaggtgaggaaaagatcattctggcatggaactcagttcttcccacttgctttattgtgatctgacccaagcctcacttgattgtcaactttaaaaactgccttactcggagcttgcagtgagctgagattgcaccactgtactcctgcctgggggacagagcgagactccgtctcaaaaacaacaacaacaccaacgaaaaactgccttactgtttttccaccttggtgaatcttttctgtttgcaaaattcttcctgagaaggacagtaagttggaatcaaagctcaaaccccagtctcgaagctccctttgaacattatcgtttctgtaaatttaacacatttacatgcgactcaacaaagagacacagcaagaagacacagtcaaacagatatccactccagcctacaacacactccaatgtcgccgtcagggtgaaggcgctggtgagaatgccagctggcacaggagcacaatcatctttctctcatcaccttcaggcttctcttcatgacattctttaacttaaaattctgatgcccaaactttctccccgtcaaaggaaaccccttgatataacaaagatagaaaaaagatttgaccagaaacatcccctttttctgttgtcaccttttgctaatggaagagttagaaagactacgcactgcaaagtttaacttcattatttcctgaggaataagtgaggtataggtagccttgcttagaaacacgaagaacaagcccaccccaaatactacagataccaaaggagaaagttactttctgccactccctcaaaagatacccctcaaagccacataaaatactaaacacaaaactgaaaccctgccccagtgaaatcaatgacttacttatgaatgtaatcaatgagtcgtcccacttcacgctgcctttgctctggagttagtcttgtatgaacggctaagtctttcatcacgttaaaatcattacgcattttatcagttagacctttaaataagacatttaaaggcatatggttaaagaaataataatcaggtctaaataactggagtatagggtgatggtgagtgggaattcccaggagacaaagcagttttaataaaaggttttctggggggagggaaggggaagtaaaggaatgtctgaggactcctaggaaagaaagggtaaatccagtggcttccttccgagtaaatgaaatgcaacagtacctgtaagatagcagagctcaggaatgagcatggcaggccctggcagtgtccccccagggccccgccttctcttgggctggctgaccaagacaggctgcttcaagtcggtgatctcttggttgtattgctgctcaagagacgaaagggtcgctgttcacggcaaatgcctcgagtagcatctcagtgggcaaaaagggtttcattttttaaaaaaataaagagctgatgccaatagcaaggctgataatagcttcagagtaaagttttaaaaaggcattttttttaacattcttaaaacagaggttgtgacttctatgctctactgagtgccctatctttttcctaaaaactgtgatggtccaggacagtatggttctgagttcagactttgttagtcacagttctcattgcttaattttttatttcttggtttagaaacagtagtctgtgtaactctgcaacttcaccataggatgattcctctaaaactattctctgttactgagagaacttactaataaaagcagtctcaccgtgagaatacagaggggaaaggaagaagttcctacgctacagggcaggtttaatcagaaaaagttttttataaaatcttgatattttcaagaagtcaaatttcaattgagaagtgttaaggttccccagatgcaatcactgcccaaaataagcgttgacaatttgttaaacaataaaaaatgacattctttttttttttttttgaagatggagtctcgctctgtcacccaggctggagtgcagtggcatgatcttggctcactgcaacctccgcctcccgggttcaggtgattctcctgcctcagcctcctgcgtagctgggattacaggtgcacaccaccgtgcctggctaattttatatttttagtagagacagggtttcaacatgttggccaggctggtctccaattcctgacctcaggtgatctgcctgccttagcctcccaaagtgctaggattagaggcgtgagtcacggcacccagccaatattcatgatttaatgtcctcaaaagatgagctctctggcctccagctcagttcggcaattctagaaccatgacagactttgtttgagttctcttcagtacaggttctggctctgtgtctcaaagatcctctttcctaccatatcctgtatcttgccaaaaacagattttcttagcatcctgcttaaatcagatccagctttaaaaaaaaaaaacccacacaccttcactgagcacaccagaagaacaaaaaaaccacacacctccactgagcacaccagaagaacaaaccacacacctccactgagcacaccagaagaaaaaaccacacacctccactgagcacaccagaagaacaaaaaaccacacacacacctccactgagcataccaggagaacaaaaaaccacacacctccactgagcacaccagaagaacaaaaaaccacacacacatctccactgagcacaccagaagaacaaaccacacatttccctgagcacaccagaggaacatcatcacagcatgtccttaatctgtctctcatcagcagactaagggtgcttgcatatttcttattcctagcatatggcaaggtcctggccacctactacaagccctcgtgaattaagaaaccatgaattctagcccgttcttgacttgtttcaaataagaaaattttaagtagaacactcacatctgacctctgcttcacgtagctatactacctattttatcacattttaaaatgaggagtctgggaacagttaccctccacaccacatcactgacttgcaaacacaggtggtagaagtgtggtcgtaatttcagaaatgtgtcctctctcaccctatttcacccaaggccttaagggcatggttcctgatacagaacttgtactcgctacgccccctccacttttatattcttaggtgccaaacagcctgtcattcattcattcatttatttatttgagacagagtttcattctgtcgcccaggctggagtgctgtctcggctcactgcaacctccgtctcccgagttccagcgattcctcctgcctcagcctcgcgagtagctggaattacaggcatatgccaccacacccagctaatttttgtatttttagtagagacgaggtttcaccatgttggtcaggctggtctcaaactcctgaccttaggtgatccacccacctcggcctcccagagtgctgggattgcaggcatgacccatcgtgcctggccctgtcaaatatttttaaacattttcctctacacctgaaaaaacagcactctcatttttattagacattactgttaaaccttttattttaaaaaccaactatgaccttctctaccaaacacccttccttcttctactctgtttcctagatattatcttcaatcccaaaccatcacttactagtaaaactgcatttctaccagaaaatctaagaaggctttgattcttttaaatatcttaacgtcaacctctttcattaattatttctactaaagacatctgattatccctgatttccagagaaatcttccctagagaaagaagctgagctgagatctcaagcataagcatacaaggtgtgtccaacagaggggacacaaccctatgtttagtctaaaggcacagtgggggacacgccatgagaataaagcagcaagcagggtctcatggagaaagatcaccacacttcaccagacacagggccacgggtgccacatcacttctggggggaaggggaagaagaagaacagatgtgtatgagttgattgatcagaaggtagaggaaataaatactaagacttgttaaatgaattataaaaatagggcctggacaggagatgccatttagaaaaggagaaaaatgaaggcaattcagataacaaggtgagtgacagaaccggacaaaagagtactaggaggcaggggaaggtgcggagatctgacgtgtgactcatccaccatttgtttattcaaatacccaagaacctacttaggcatggggtatataaaccataaaatctcttgcctctgtccaagttaccttatctgcattgaccaaaagcaccgagtaggggccgtgttgagaagacagaacacattcaacactggcaacatgggagaggtatctttgagtcatccaaatacttaagaacaaccaggcagctaagcttagacaagtctaggctggaactggaagtctggggattcttaacatttcatgcctgaagcctgggcagaggagactggaaatcacccagggagtgaacatatagtaaaaggggtctgggcagagctcctaagtatgataacacgtaaaacaccacttacaggaggatgagctgccacaggacactcagtaccagtcagggaaggggagaggttccactgaccttgcttcaggtttaaatcacattttcagctaatgtttcctttatatttgctgttgatataccaacttctaccatccctgagagtgatcactaaaattaacgacagaaaaatgccacaactcattcctcacagtaacctctgacacccagagggatccaggttaggcatggttggagtcctcaaggagtaaagaggctgaaaacagtgggaggaaagacatgctgaaatgacccctggctgtttccatcttgccaggaataaggtcagcccttcatgcagcgtctcatagaatccctccctccgtagtggcttctcatctttttagtcacagcagagcagctggacagcagcacacagacctttccaaggccactgataagatgcatactttccatgcaaaatatgaatacttttcatatttaagctcatttatccaaatttttagaaacaggaaatactctattgaaagtagaagaaaatgtgaaatgttagcaattcaaagacaagttttgagattttaattgatagttttctagaaataatcttcctgcgcttttaacatatcaaatggaatgtgacgttctaaggatttgggggccagatctgctcatctgagtactgaaacaatgttagcatgcattcttacatgaacagttcagtttcttctagtcaatagctgctctttcctgctatttgcctttgatgatcttttcaaaactagaatcatctctttaaaaactgttttagatgatcgcccaaaagactgatctagcctgtgctaacaagcctgtctgcattttgttaacatgtaaatcaaaagttaagagttaacccacaggcagtagatttagcagaaatgatactgaaggttcaaagatctttaattcctacccgtctccaaggtgaaattaaatgaaatgttgattatggagggagagacagtatggcaagctcttaactcccactgctcgccacctgttatccaacctacttgtcctccataggcttcaattcaaacgtaagctttcattctactggaaaaagggaaccaggagagggcatttctcattatgtgaactgtaccaaataaaaagaggcattttaataatttggtaatgaataaaattatgctgtgattgccctaacaaatacatttacacacagctttaaacgcaacttgttccaaatgtgcaacaagtgttagagaattctaccaaagatattttggatttctcctgagatctaaccactggcatcttaccttcctgtagtattctaagaagctgacttcagagccgtcggctttcttaaaggtgctcttgggattctggtcccagtcaatatcatccactctgtatgtcttattgttatacctagggatcagttgagatttgactgcatttgatggaaatgtgaagaactaatattaaaaagagagactagacagcatgtattctctaaaatttcaaatcacctggttatatacaaggttggaaaaagaaggaacagggtttcttacagactatgccagatggatgggggaagtgactaaattacttacagaaaataaaataatttaaaaggataaaaatcactagctatttgtcctctccagatgagttatgtcatctccaaaactatgatcctgggaaagctgaaaaataccctcacccttgttttgtgctattcccaccactcaattttaaacactatttcttaacatggtagaactagaaagccacaatactttgactcacaaaaaattattgtgcactttaaaaagcagtcttacttggtaagaacaactaaacctattagttctttggaaacttgttcttgaaatttatgttcttctgtctgatgataaaagttgaacatgaaatccaaaacagtctcacttcgaaggactttatggctaacgtcagtgcagagcatgatgctgttttcatactgaaggatggaagtagtgaagccaggccaaatcaccaacctgtcagacgagatgggggtcatgaagaacctctccacattcaacacattctgcacacactaagttgcgttttcacttttattaactgggtctaaactataaagtttctgaatgaatcaatttccttatttctaggatttacatggttccagctttaagaccttcaacaacattataataattgtataagtttcattttaaatgaatgtactaactttattcagctattcattacactggcctaagacttttaaaaagttgccaatctaattgaaagcaccacaattattatgataaacttaaacctgttgggctgcaatattttgttttttatttatttattttcttagtgtctcgctctgtcacccaggctggagttggcacgatctcggctcactgcaacctccgcctcccgggttcaagcacttctctgcctcagcctcccgagtagctgggattacaggtgccagccaccacacccggctaatctttgtatttttagtagagacggggtttcatcatcttggccaggctggtctagaactcctgacctcgtgatccacccgccttggactcccaaagtgctgggactacaggcatgagccaccacgcccggccttttatttcttatttcaactttagattcaaggggcacacgtgcaggtttgtgacatgggcatactgcataatgctgaggtctgggggatgagtggtcccatcactgaggcacggagcacaatacccagcaggtggtttttcagttgggctgcaatcttgatacaccacattaactgattatttttattacctaagggcaaaaatacaaacagcactggacaactatgtattcttccctagtgacaggtaaattacgtgattttttaaaaatccaaatattctgggatgtctcctcattattcaagttaaatagtcacataatgtgatgggcggcattaacagtcactgtagtaaatttgaccatttcaaattaggttatcgtctcaaaagtctgtcattaagcctaaggaatattaaacgttctacttcatacaaacctgtgacttggaatatcaattgggtcatttgggttataataatttcgtccaatttgttgcaaattcatgattttcaaaagcctagaaatggaaaggtcagagagtgaatattgataagtatctctaatacgacaatcagaacagcatgtcgtttagagcaggggttggcaaattgtggtctgtagccaggccaaatccaacctacctgctgttttttatggcctatgagttaccaacggttttcaaatatctttgaggttggaaaaaataaaagattatttcatgatacatgaattatctgaaattcagacttcagcatccaccaatagttctactggcacacagccatgaccgctcactcacacgctgtgtctggctgtttcggcggtccagtagtagagctgaagagctgccaagagatgacatggctttcaaagcctacgatgtttactatctggccctttgcagagagaagtttgccaacccctcgtttagggaaaaatcaatttaccagttacattaactcaaaacaagtatttatcacaatgaattgtcctatcatcagtgacagttatcttatgactaacttaaagagggaaattacagatacaagtattatgccctactattctcacgaaaatttcagccttatccagattgtttctcatccccctcaaaaaacaaaaatttttgcagaacacgtgtcttgcttttggataggaaatatgtgatatgtacactgaaagcaaattatcaagcatgcagtatatctcctgtggtggaacaaacgacctgaactctgcacctcctcctgatcaaggacccaccgtggggagaaggaataccaagttcgcaatagctctcgaggatatgagtgttctgaacacaagctcagacagtatttgaagtcaacagaattagggaagtaaaggcaggatacttgcttaaagcaaatagatgaattttctatcagtaaaccacaccttaagttactgcaatacagagaaactcaataatcccaaccaatgctgaaaatctaggagaactgaatgcagatgttcaatgtacaattatttcaactttgctgttttcttaataaaatgttgaaataaaacacatacctcctgaaaataatattatagaactgcaaacaagttggtgatgtaggtggaagttcatttgttaaagtgatcgttatcctcacatcctctccattccgggtcttactaaaaacttcagtaacctgaagccagagaggtggaaaacccaaactttaaatccttaaaggacaattatgcccaatcacatactgcttgcttaataaggcaacattgaaaaccataaaatgttttaactggattttttttaaatggctctgagaaaaagagtggctaagtgtattataactcaattgtaatcatcaagttacccagacaaatctgacaatgctacaataatgccaaagtaccctatgtgtttattccaagtcatatcagacaggagactcctggggcctctctaaaagccatgtgagctatcttacattgtggtagttctgctttgaagtggaaatcccccatctcccttttcccaaataaccttttgctgtagtcttttaggtaaaaataatatcgttccatcaaaagcatgacactttccaattagatcttcgtgttgaaaaagaagagctgaacggagttttctggcttccatcagtgggttatagtcaatgtgatactgatataaggcccactggggacgggatgtcagccggaaatggttagtgcttaaccttactataatgcctgaagaacctggaaaaggaagttatagtcaattaacaaaatatcaagtttatttttccttgaaatctttcctaccatgacaaggcaggcacagttccgtaaacacaaggctaagagcagcagacaacatgaaagtcctcagacatctgactttggagaccactagtctctctctttaggtgaatttctaaagaagcatacatttagaaacaaatcttccttagactaagtaatttacaaataatttgcaacaaaaccaactaaatctcttcatggcaaagagttttaaaaatgatctattaatatttaatgagatgacgtttcaaaatgtgcagttaaagatatctataacctacttcatcaacgccaaaagaaagtgaggaaaatcgaaaagccatgcaggatccttggccaaataaacacctaaactaaagtgcctcaattcactgtcctgtgttcctgagatgtaatctcacaaaacttattcttaattaacctacctgtttttgattctttaacatggtctaggttctgccttgtattcacaccaagatcatgaaaatctctacgacgacctcctctctctgctaacgataactcctgaaatccagcagatatctggagtccttaaaaaaaaattgtgtacttgagcaacataaagcacgaaataaaggatgacaatattaactcccatagtgctattatgtgtaatccaaaggatactgaggtgtagaagacaaggcataaaacaatcctatcaacatgttttaggtatctgccagcctaacgagagaatggtttcctagttataacttcattcataaaggccttgtcactgtcctgggcaattgcagatgcaccctttcaagagatgtgcaccttgaatcaagagatcaagccaactggactgtggtgcaagagtgcaggagcatatgtttgctgactgggaaattatttttctgtattgtaagtctgataactacctaaaggtcttcatgtattttccacagtctgtcatgatgcaattacaactacagaagttgctggtttagagggtttaaatctgtaacctggattagaaaacttacatctaaaatgcaacttcctcactacctgactctcttcagaatcagaagaatggatttctgcacctgcacatattctatgaccatgacacgcatctcatactggtataggtaataaggtcgtgattaatcagttcatgcttagtgctacaagctgtggttataagaacctaaattattcaagtcatttgatttgctgaaattatacaattatctcagatcaacaatctgatgtgagccaaaaaacaaatatgaactttgtagtcaagcattaaaattccagctgtcaattaataggcatgttatcttgtgtaaaagagattaccagttgactatccaataactaacccctcattctttaaataaattctatttttggagtaatatacttaatagactaaaatttccaccctccccatggttagggatggcctaagatacttaagcagaaattgcaggatgacacttttggaaaaattccataagagagccaatagctgacatgtgacttttgtacttcctgaccctttgccctgcccatggagcctggaatctggatctggcagggagggctcaaatacagaagttctgaaccaaacagaggtcttaatgatggcagtcatgagcccaggacaaaagaacaaaaagatcagagtccagttctcttctgaccacaaacaccagaactgcctactctctagacttccttagagaaataacagtggcttaaaatatttcagtccttgctatactttggaaaccagttatttaatatgagtgtcaattccttcacctgaaaaattgagaataagcatcacaggcatgtcagaagttttaaatatcacgtctaaagcactttacaaggcacttccatgtttgtttctgtacctcatgatttggagggggctctacctaaaaatcctttaaacatgtaactgttcatacttgtctctctcagagagctttttatcccaaaggcttggtttgaagtattgatggcactgggtgagtaactacactaaatcacgcatactgaatccaacctgatgacactgaagggtcataaaggctgatatttttccttaaaaatttttaatttgtcttaaaaaaattcagttctggacgcaaaaatccaattgccagtttctgaatataaacaatgatgaaatcagttctgcttgagatatacagtactgctatgacacttagccaaagcttgattttgtcacttgatgaagaggacagatttcagaatggacaagactgggaaccttgctaattcccccttccatgcagctcctagagtgattttatttcaaacacacatcagacctcacaccactgtgctatttaagaatccttcaatgggccgggtgcggtggctcacgcctgtaatcccagcactttgggaggctaagccgggaggatcacgaggtcaggagatcgagaccgtcctggctaacacggtgaaaccccatctctactaaaaaatacaaaaaaattagctgggcgcagtggtgggcgcctgtagtcccagctactcgggaggctgaggcaggagaatggcaggaacccaggaggtggagtctgcagtgagcagagatcgcgccactgcactccagcctgggagacagagtgagactccgtctcaaaaaaaaaaaaaaaaaaaaaagaatccttcaatgcatccacatccctttacagaatgaaaatcaaggtccaaacaatgtctaattaacaataatctgttaaacttatattaatttctacaatacattaggtatttgagcatttaccgtgacaagcaattctcaggtataatccctaaagagcagtgagagatgacaaaacagggccttcatttgttatcccatgtattaatggtcacaatgatctttacctctacaggtagacactaccttgttacagatagggaactgttccatagagttaaatttgcaatcctgagtaaccatttttttaagtcatttattaatgaagactgatacatagaatgtttaagaaattatatttaagtattttccacaattgatttgtgtgttgtggcaacattataaggaaatgtttcttaaacagtttcagcacaaatttttgtaccaagttttaattcaataaaatttgctgtatatgttgaacagagttgttaagacttccttttactttctcttcaccttgtgacttggctgttcctcctgctgttcctctctgccgtccacggccaaataattccccctctgctggtggcggctgaggcctaggctgaatataaccaggttgctgactctgtagttacatgcaaataaagaacattcttttcgtcaagcggtcagacaccagagaaaatttctagtcttaagtctcaggaattcaaccaacacctatctaaattaataatcaaatattttattcttaaaaataaatttgagagaagagtcaccaaataaagtcacgaatcagcttctaatatcctgaggaaacagggcatgatctcccttgctcacttcctatatccttcccagcacagtttttagtttattttcaacagcctaggctgatcaagagtcaaagacattttctgtagtcagaaacggtgaagcactcacggcagtggagcccaccagctgcgctgtctcctgaccgcgggcccttcctctggctctggctcgggctctcccagtcattgttttctatttctggagaggaaacaatcttgaagacaatactcaatggaggcaatcgcatttgataatttctacaatgttactttaaacttctttgagtttcaaaagtaagctccccaggcaattattatgtatccttctaatctttaatgacagttttttttaatgtaacattcctacattcaacaaactcagttgcttaccttgcactgggcactgcagtagggccaaaggggaaaacctattttaatataagacttagtttttcatttggattatttattataaacagacttaggaggagaaagtgctgaaagaattaggatgctggtggctggttctttctttcccatttggagatacacatgtacacacacttaacacatactcccatacacagacacacacacacacacacacacacacacacacacacggaaacaggcacttgtggcaagtgtcccgccaggccccttagaaaatccttctgcatacataatgagtcatcctggatcttcccagagttccatgtgtggcttacactgaacatacccaaactagtatctcttctacctcatgtcccataatttcattcttggtgagtggcatcaccatatacgttatatctaaataaaaagaatggagtcattgatttcaaaaccactcctttatttctcctacatctgccaggaccgttctctccatttcttcaacatcatgatggtactaagtgcttcctgtgagctgggatcagctttgggctcagctgtaacaatctctcaccctcatcgtggtggtacacaatgtcatcaggctattaagggtagaggcctcagagctcaactgcctgaacccaactccttcacattttagacaacatgagaaaacaacatagcgtgtgactctttgtcgaatggttggaataacctactgcacaagtcaatggtgaagatcaaatgagaactcacactggcctctagtgagcagtcaacaaacattagccctaatggaaagggcaggtaaaattataactacacgtgttaatacacgttatttacacacagctttaaaagcaacttgaagtcagcttcttagaatactacacgaaggcaggatgctagtagtgttatctttttcatatgaagtagttagatcttaggataaatccaaaatatctttggtagaattctctaacacttgttgcaccttgttatccacctctaacaagatttaagctgaaacagagaattaggaattggaaggtagggtggtaccagtctttcacacaaacggtaacaacccacacataagtgcttgaactggatgcagaaccaaaagacgtccagtgggactggaaagagaaggggcaaggggagtggaggatttcatgtgggcagggagcagactgctcagggtcctgcagacagcttggatactcaacacatgagaaaccatccaaggttctacataggggcaggcgatgacatcatctaccatcactctgccttaaatcacattatctttttcatcctctgagttttaacagcttctaaaattcttggcttcatgatcttcacagaaagataaatctaatgccatttttcaattttaaaaacctccgacttcctattgtattttacaggattaaagcaaatattcattgtataagaccccttacaatatgactctaaatcagcaatttccaaaggagtttacacaggataatccgctgaggtgccagcatattacaactaattttaaatctcattttaaactgctttgtatttattttataatgtgcgcatcatgacaatgattacgtatgcatgctcggcttacacacggggcatactggcgcatgaaagtctcttactgataatctacaggcagcgtccccagcagcagcagcagcaccaccaccaccaccaccaacccccctcccccatggacctgttccggaaccaggcccaacagccaggaagggaccctgaacgagtgagcaggacagcctgagctcacctactgttagatcaggggaggcattagattctcctaggagtgagaaccctactgtgaagtcggcgtgccaagggtctgggctgcctgctccttatgagaatctaatgcctgataatccgaggtggaaccgtttcatcccgaaaccatccctcaccggtccgtggaaaaattgtcttccaggaaatcggtccctggtgccaaaaagactggggactgctgatctacaaatcaatctgaaagcatccgcttgagactccagcaaacacaacttgcttcctatcactatcaattccgtgactcaccctacaccgtggcacaccctctgctaacaaagcctcaccctcctctgaaaccacaagaatccagtgaaccgcttaaggaccagctcgcaggccatcccttgctcccttctccgaaagccgtttccccggcgtgaccacggtcaccctactacatggtaacctgttttctccctccccacatctctgcactccatagcttctccaactaggctgcgaatcacaattgatgcctttgcacccagtccgtcgcttgacaccttacaaacaacggtgtgaaacagtgattaaaaaacagtgacaagctgaactctcatctccagcaggaaatattcctaaagcagcacgtcagttctcaaagcctggtccctgacgggcagcatctggactggctgggaacagaaattacggggtggggagcggctctcagccctcccgagttagaagccgactggaagcagccctccagctgattctcatcatctccagggcctgaaacccacggcggcgcgctgtgctggtcactaaatacctggggggctcagcgctctacgtccaggtttcccagcacaactctggttttcagctttatctccttccagtttcaaaaccacctcagtctggatattgaattcttaaagtcagaaagcaagtgtgtgcttccaataaccacactcgctggaaatcacctctccgattcgctaccagctctgccaaagacgcttccacctaacgtccctccggcgctgagctcaggaccacgccgtgcacgtgggaaccaccaccgcgccacacgcctaaaaaccgttgagcggtacattctatgcgagcggggtctctctggccacaacttaaaaacgaaaagaaaagcgctcagagaacaggctgcgcaggggtgcagccggctttgccctggaggccgccggggctgaagacggcgagagcatccatcccaggacgccaccgccccgccgcccctttccctccacaggtgccaagggccgggccgccagcacccgcgaggacccccgggcctcgcagagcccggccgtcgcggtcgccgcctcacttggggtcctccggagttccgtcctcttcccaacgtccggctcccaaggctcccgggggcgcagcgcagcggcggcggacgcgggaaggggccctcgccctccgcagagatcgcgccccgcggccgcgtgggtagtgcgggaggtcccgaaggccctcctgcagagctctcaggtccccgcagtctcacgcacggccgccaatgcggagacctccgcccccgcacccccggcaactcaggcctcagcctctcaccccggcccctgcacctgggacctcgcccccgcaccccggcccctgcacccccgcaccccggccctacagccccggcaagtcgggcctcagcgcttccccccggccccgcaccccccacacctgatacatcgcccccgcaccccggcccctgcaccccaggctcctgcatctcccaaacctgggacctcgcccccgcacccggctcctgcatcccccgcacctgggacctcgcccccgcacccggctcctgcatctcccacacctgggacctcgcccccgcacccggctcctgcatcccccgcacctgggacctcgcccccgcacccggctcctgcatctcccacacctgggacctcgcccccgcacccggcttctgcatctcccgcacctgggacctcgcccccgcacccggctcctgcatctcccacacctgggacctcgcccccgcacccggctcctgcatctcccgcacctgggacctcgcccccgcacccggctcctgcatcccttgcacctgggacctcgcccccgcacccggctcctgcatctcccacacctgggacctcgcccccgcacccggctcctgcatctcccgcacctgggacctcgaccccgcacccggctcctgcatcccccgcacctgggacctcgcccccgcaacccggtccccgcacctcgagcctcacctccacatcccggacccccagccgccgcccccgcatcccggcccccgcacacctagcacctcagcctggccccgcaccttggaccgctgccctcgccctagtcctggtccttgcacctcagcccgaggccaacagccccaacggctcccgcggagatccctccgcgccgccgacctcccaggacctccttcggcccgcgcccacctcgccttcggcgctgggttcccgagagagccagggacacgcgggcagcgagcaacaggcgctcttttcccgggcggatgaacaccgcctcccgggcgccggcctcgtgtctgtacgccatacgcccagtaacggcggaaagcggcgcgcgccacgccctcattggctgccccgcaaacggcggtttctgatgtggccggggcgggaccagaggagccccgccccacaggccccggccccgcccctccaagaccccgtctggcccctcccggacacccggcacaggcccaacaagccaggcccgccccgccccacaggccctgcccctggccccccaagacaccgcctggccccggacagacaccccgcacatgccctggcccctccccataggccccgcccccatcccgccaagaccccgcctggccctgcctagacgccacgcccaggcccccacaggccccgcccccgccccacaggctccgcccctgtccccccaagaccccgcctggccccgcccagacacccaacacgtgccctgccccctccccacaggccccggccagccccacccaggccccgccctgttcctcttctgcttcgcccagacccccggccttccctggcttgactcctgcagttcccccagtgccagccccctgcaggcggacacggggtcgggccagttccctactagctcgtggaactgggcggcggcgcacgaagtagaccctccatagacttcgaaatggtgcccacgtgggcaccgagcgccctactgtagcagtggactcgatcttggtctggcctttaacgtcggaagctctttcactcagcacacagagatttgaactttgaccccaaagaaaataaaactgcaatgcaagtctaaggtgccaggaggccgttacctggaaatttagctttcaatgacttgtgccttgggtgcatgccaacgtggaccgcaggggttctcagccttcacctgcgggggatcacctgcagggctggttaggacacagaccagagattccggtctgcaggctccacaggtgggccccgccggctgcatttccaaggcatcgcaggtggtagcgaccgggtctacgccgagctaggtgccctccataggagttaatttcctcatggaggcaaagtcaacagccacaaaacaaccggaaatattgtaagatagaacaggtttatttgtcaaggtggaagtgggactgaggctcactaactgcctgacctgttatgttccataactataaacatgattgtaggaggtagtagaaatagggtcgcctctgcagacaggttttaaaactgcatttatacggtaaacatagtgcttttccttttttttttttgtgagacggagtctcactctgtcgcccaggctggagtgcagtggcaggatcttggctcactgcaacctccgtctcccagcctcctgagtagctgcgactacaggcacccaccaccatgcccacataattttgtgttctttgttttgttttgagacagggtctggctctgtcaggctggagtgcaatggtgggatcatggctccctgcagcctcgacctcctgggctcaggtgatcctcctgcctcagcctcccctgtagctggtactacaggtgtgtgccacctgtagtaatttttttgtatttcttgtagaaatacgagaaatacacccagctaatttttttgtatttcttgtagaaagaggtttcatcatgttgcccaggccggtctcaaacttctgggctcaagtgatccacccatcttggcctcccaatgtgcagggattacaggcataagccacagagcccggcctacatattgcttattattcatacttaaaagcgcatgcctgggaatcgggggctggagagggctgaaggctccccaagccaccttcccaaatcctacgtctcatctgtgccatgaaaggggcaggttagatgtcagcgtttcccacactagcctgagtgtaagcatccactgagggaacttccaaataatacagactcccagatcacgctgattccaggaggtctgggacgggtgcaaggaatttcaagaagtaacatcaagttattcttatgctcagagaaggctaataaatttggggcgaggccaaaaggcgttggaagccagtagtttgaaagaaaaatagctttccaaaggctttcgctttgtaaaaactaaatggtgccttttggaatacaatgtgaacataacttttccaaggatttaaggtgttgatgagaaagacattctgagacctgccagcagatggagccataaaacaagaaatagatgtttacagcctcaactcgggagaaaaataccgtgaatgcaccttacactatagaagtaacacttttccctctgctttattttctctatatgctaaactccttacttgcctctgctaaagaacatcgctggagtgtcttggtgtgtgaagtatgaaatagtttctaaagacataagttgtgatatagcaagacagaggcaaaacccctcattcttctgagagtgtaaacatcatgtcgcaagaagctcacctaaaatttgaaaaggaaaactcaacgaaaatttgaaaagaaattcaaggaaaaaaaaatgtgacctttaaaatttccatgttgacagcaccaccaggaccccttctgggatccgttgctaggtataacttcgtgcctgactctggaagttaaaaaatgaatagttacagattctttttccgggagccgcctctagaggggtgtacccaccagggaaggtgagcagagtgccaccaatcctgtgggtgctcagcgggaggttgctgagggatgcttcgtgactcaacgctgctgaagccctgaaggctgatttgggtttgcagggaacaggaggatcggcatggcggagcacgttggtctgagcacatgtgaggtgtttagaaaactgcaagtcatccagcacgggagcaacgccaggcacaggcaggggagtcgtaggggatgatgctgcagaagggacagaccgggttttagaagttggcgagcaaggaaatgtgagcatctggactgccgaacgcaccctgttaagtgctgtgagtaaaacacactctgtcctcccattgatgtgaataaaacacactctgccctcccgctgatggcccaacaagggaagcagggagtgtgacaattgggaacgtggatgctgacctgaagggccagtggctgcttagtcctagccagttaccaggagagaatgagggctcagatttgctgggcctcacatgatggctttggttgttgttgttgttgtttttttaantgaggtgaaattcacataacactacattaactattttacagtgaacaattccatgatatttaatgcgttcataatgttacgcaaccccccacctctagttccaaaacattttcatcatcccaaaataaaaccgtcactctccatctccctcttccccccactaccctggcaaccacgaatctgctttctgtctcctttcctgttcatttcatagaaacggggtcatacactaggtggccgtttgtgtctggcttctttcactcagcgccgtattctcaaggctcacctacgtcgtagcccgtcagagcttccgtcctccttacggctggatcttactctgctgtttggacggaccacattttgtttatccactcatccattggtggacagctcaaacgtttttaaaggggagcaggaaacttggacattttccggtgcgtttttaggaatggccaccagtgctctctagtgttgggcagaggagcatcccagggaagggaaacaatggaagatactcagagaacagaaaaatcccaagttacttcatgtaaagctgaaaatatgatctgggtagattatgctgggggtgacagggactagatggaaaagaaactcatcatgaaccctgcatgctgtgtccagagctttggactatattctgtaaccaatcagtttcccaagtttttaaagcagaaaaccacatactcagagcaagctttgacctagttcctttcattcaaggatctcaaagcccctttaaacccatgatccagattttgtttgtaaaggaagagatggagttgaaaaacaagatctaaggcagttcctatgaatcccttcaatgtaatttttcagagcatttcccttctcccttcaaactcatgtcgttctgattgggctgaattgaagagctgcccagcctctcccctggccctgagacccctgacctagagggactaactagagggacggcatggcaatggcaagtgtacccaagacagcatgcccggaggtttatccaggaatattcatccagagggaaagagcaatgggtgaggctgaagttcgtctgttctcttatatacaaaatgtgaacaaatcctgaatatcacagtctggccacaagggggatgttttggggtgggcagggtgacggaggcagggggtcctgacttggctccccaagaagtgggttctgttctgttcgcttaagctctctgcattcttttttccacgctagacgatgagcatgttggaccagatgggcacgtgtccaagtgcaccctatggaatgtatcagcatcggcctcgcctggaagcctgatagaaatgcagattcccaggccctgcccaggcctgctgtatccggatctcttggtggtggagcccagggatctgcatgtcacgagcttgctcagagtatctgtgaactgagttcaatccacagccctctactccaatgctagccagaccctggggccattgcctctccccccacatgcccctccatactgtcagcacctctgcattgtggcctttctgccacccccaaccgacttggggatcccaaccacccacacccaggggcctgcaccagactgcagagtgttgcctgaggggacacagtccacagtcatccttttctcctctccttcccagttaattccattttccacgcctctcatggcgattcctgatcttcacaggccccagagcctctgaccctggtgttccccctgagaaaatgaggccagggtttgtgagctgcccatgccacacctgtgcctgcctcatcatgtggagtccctttagctcagctctagggtcccccttcttgcttcctcaaagatcctcctctctcccaagttcctcttcttcttctcaatacttctctcttctggggcttcctccttgacacgtcaatgttgtctagctgtcttcatcaattttctttattattttatttgtatatattgtattttattttaagacagagtcttgctgtgtcagccagcctggagttcagtggtgcagtcatagctcactgcagccgcgacctcctgggctcctgtctcttgagtagctgggacaacaggcatgggctactacagctggctaatattttctttttactttttaagagacagggtcttactagtcatcctcgtctttaagaacgaagcaaaacaagggtctcgaagagatatttgtacccactgttcatagcagcattgttaaagagttaatatgtggacccaacccaagtgtgtttccattgatgaataatgagcagaacggggtcatccgtgcagtgggtattaccagccttagaaaggacgggaatcccgacgcaccctgcaacatggatgaacctagaggacattaagctcagcgaagtaagccagtgacgaacagacaaatatcattccacttctaagaggcacttagtgttgtcaaagtcaaggacagacagtaaagcagggttgctggggctgggggaggggaacggggttggtgtttgatggggacagtgtttcagttttgcaagatggaaggagctctggtgttggtggtggttgtctgacattacgacattatgaatgtatttcataccattgcgctgtacacataaaaaggattaaaatggcaaattttatgttctgtgtattttgccaccataaaaacagttgggggggagaaaaagaagtaaaacaaaaatgaatccctacggctcctcctttcctcttttccctccagagtccatctccttgaaagaatggtttcttaggccccacgtccacatcttgccctcccacagtgtggttttgattctcagaggcctccgtgggctccagaaccctcttggtttctaatcccagtggctcctttcagacaacctgtcttccctgggacacatgagtgttgctcagcctgccctatccatctcagcaccatcccccttgccctctgtgatacggctttcttcctccagctatagccagtcattgcagctacccacaggagtttgcccttctcccgcctcctcatgcatacgcactgacaaagcggctctccaagtccaagtgtggcttggagctccagcagcaccgagacctgttggacatgcaactccttgcctcccagccctgacctgctgaatccaaaaccctggggctgagccagccgtgtgtgttgccaaccacgttggttccagtccattcgggttcaccctgcagtcgagaaccactgggctaagcgagctcaccctcggagctcaggagtgacactcaacatcctcccgctgtcaggattctcaggcctctgcagctgagcggccctggacgactctggcccgtgttagcccctgcagtttatatgcgcatctcccagcggccctggccctcccctcctagcactaggcccggttgctttgccagtggcctctagagcaagacatggaaggtcaccgcaggaggcaaagggagagcttcttagaacaaagttgattctaaaaataagaaaataagttgagctgtaatatatgtaagatgcgggggacgcccgtaccctcctttggttcctgcgtcttgtgcataatggctgtgtccagggtggagggtgggagccccaccgcatggcggggttggtagcccccatctctgactcgtagccagcctctggtgacctgctgtggcctggtgggccccgtcagcagcggctgggattactaacccaactctctctagaccaaccttcacaaaaagaaatggttggaaaagattcctctgcaaagaaataacgggtggggggacatacggaaaatgcaaacatcagcaaaccccaagaaatggttagagctgatacctgcatttctttctactcctcctgcaagctttcggcagatggaaaggctgagttattttcatttcacacagttaaacggaaaagaaataagtatcactcataattatggtagtgagaaaaagttcttaccaaatgaaaatgtttatttaattcactgttattttatttttaatctttaattagtggtgtattttattatgtgcctaatactgtggcatgttgcaaataggtatagtggcatactgcaactaaatataaatatattggatgctcatgctcaaaactttctgttctggttgcatgatcagaagtatttggggattgctaggctgccaggtcaaacccacgttctgtggtgtggcttggcccccctccatcggcctgtccgactttgctcctttcccaggctctccccaaatctggattccaagctcctgccatagagagcttcgaaattcagctcctgggcgcttcctccatgaggttttctttccttcatttccctctctgtggatcagcatccctgcagtgagggcctctcctctgtggttttaccttaccagcctttctatgtctctccaatagcatttatcacaccacaattgtaagtaaacacgtacttaacccgtttccttcattattgggaaaacacgttgaggacagaatcctggtcttactcaacattgcgtctggttcctggcattccgagggtctcaggaaatatttcttgaatacttgaatgtacataatagtgttcagctttatgcaacacctttgcacgacaaagtattcacactttgtccatttccattcttgtgtacctctcagaactcaggccaagggcaaagtcactggcctttggcattcttaatttttatatacctgttgtgttcatttcttcttcaaatattgcatccttctctctgaccatttcctccccaagagctgtgtagttttgttttggagtggccataactactggctgttatgcccaaattagtttgaacacagtttcctggcaccagagacacccaaagactgtttactaccttttttttaaattgacatgtcatagttgtacacattttgggggtacttacaatatttcataggttcgtgcgatgtctacggatcaaatcggggtaactgggctgtccctcgcctcacacaatcgttcactgcctcctctgctctcagaactcagcatattgtggggtggctaccactgccttgagtaactcagggttgctttgaaattattctaaacaaatgtggcagctccaaaacctttgccagtaaatggtgtattttagacctcagcatgtgaaacaatcctggccaaagacatataagaggattttgtctggggtcattaaaggaaaaaaaaaaaaaaaaggaaaaaacaggacgtaacaaagagatggtctcttcctgcctctggactttgaagtatgtggtgcccagagctgctctagacctcctgggaccatgaccaaaattccaagagataaattttctttattggtcatgccagttacacttgggctttctgatggtgcaacccaggacaccttaacggaagacgcagcgggtcccacctcaggatgtgcagcagggctgcccgggagctaattaaatatgaggatctctggacccaagcccaaacaactgaaccagtccccagagacagccatctgaaggtttaagaggctctccggttgattctgatatcagttggtcaagatcaaactttgagaaacactgccaaattatgttttcagagtaatgtgtttcgaagcagaaatgaaattcggaattcagttggggacacattcagtttgggcaaatatgcagtttaccttggtgaacttcaggggtgactgttttgcggtaaacaaatgccttaaaatgagcaattctgttgtatttatccatccatcactcatcggcctctaatctgtacaaagccaaactctaccttgtccaaattactttaactgttagtagaaataatcacaaagtttcagtatctgcagcatgcagataattcacataagagattactttgaaaaattatcagattaagactcatattgcctcaattggtaatactgaaatcacatacatagaattaaaattgttgatatagatttccatttctccccatgtttagtcacacaggtaccctggattttgcactggtgtaaaatatatttcttctggaaattgttgagtgtatgaaccgaccggtagcagaggtggaactgatttgggatgtgatatgccaacctcatctacattactatttaattagtcacctattggtgcctttgaaatttcacccatcatcacttcaattctttaaacaccaagagctaaaggaaagtgcctgcagttttggttgctataaatcatgtggagctgtttgacaggatgcatcactgcacagggtatgggttttcttcctgcgcagatcagaagtgtcctagaaatttacactgaaaacggaactttgggatgacaggtacagtgtggtgagcagaggtcagactctagtgtgagacgaaacttggattgagtctgcgagatcagtaggatcatgaaaattaaatgagataaggtacataaagcgcccaaaactattcctagaatgtcgtgtgtacacaacacactttacaggtcaagctacgaatgggtttataagcctgcattataggtagagaaagtgacagttactttggctttattgatcacaatgaacacaaaacgttattcatgtgatgaacgatggtgcatggggaaattgtactatgttaaatttcgttaatgagaatgctggataatgcaatcttaattgagttgaagtttatctttgtacttcaaggagggtttcagatgcaaatcaatcctccaaacaagattgcagagacagatttaaccaacttaagagaacgactgttctcgaagaaacggcgtattggatcgcacaggaactgctcatcgtgagttacttttatctgtttcagcaggatctgtatttgcaaacccatcattagcagtttatccttgttgccacgtatatttaaaatcagtccaattgctttttagagaaaacattccaaaaggattaaaaaaaaaaaaatcagttgccctttcatttaatcctgattagttacactttatgccttttaaaatagtcaaaacaaataatgatactatacaaagtttgggaaatagaggaaaaagctcacctataatttccaaaagctgataatgccttcaagcttcatttatgtattcttatctgtgatttttccctatatttttacatattttcagtcttagcttatccatacaattttataacccacttttcctcttatcatatactaattgttatataactttcaaattaccattttgatgacttaactattaactgaatttacccaatgttgaaaaactgtctcctttcgattggatttttatattgattccagattttcaacattataatcgatgctatatttcacatgtgcttttttttttcttttgaaaatatcttgaggacaaattccccagagcatggtgctccatctcagcaaaatgttcattttcatgaccctttgcacattgtaaaattgcttttcagtaagagtggagctaatccacactgccactaaccaatatagcagttttactgcatcctgtctagctctaggtattaccgtttagcaagatgtgtaatcccactgaaggacacaagacaagatgcgaaccaagggaaggagatatcaagttcttggctgggaaggtgactatctgaaacgttatttcttctaaattaacttacaaattaaaagctattccaattaaattttgtactggacagatttttaaaattatatttatatggaaaataaattagaatacttatttaaaaaaaggaaaaagatgataagcactagctttcttatcgagtatgaacatcagattcaaaacaatacagaagtaacactggaatagatagaccagaagagaataatagggagataagaaatagacactggcataaatgggactttgatatagcaaaagccatgtttcaattcagtgggaacaagatagattttttgataaaggactggtgcaactaacatagcatctagagaaaaatcacattgtatttctagcttccactgtatacaaaatctaacttttggtggattaagatttacatgcaaggaataaacaacataagcatttgaagaaaagttgggagagtatcaattgcaacataggaattaaggaggtttttgtgacttagaaaacctagaaattataagagaaagtataaacacatttacaaatttaaaaattttgtatggcaccaggtaccatgaataaaatacatgaaaaaatgatgttttgaggcaaatacctgcagcacagaagacagacaaagggttcatgtctataatatacaaagagttcttgcagttcaataggacagccagacaaggatataaacagacatctcataaaggagcataagaaaacggccaatgtggagtcttgctctgttgcccaggctggagtgcagtggggcgatcttggctcactgaaacctccacctccaaggttgaagtgattctcctgtctcagcctcctgagtagctgggactacaggtgcccatcaccacacacagctaatttttgtatttttagtagagatggggtttcaccgtgttggccaagctggtctcaaactcctgacttcaggtgatccacccgccttggcatcccaaagtgttgggattatatgtgtgagccatgacacctggcctccaatatgatattaaacctctcaaatagtctgtaggatacaaaagacagtgacatcagggataaaacgaagactgcatgttagaaaagaggtcacaatcaaagactgccaatcaaaatgacattagactactcaacatcaacactgaaagctagaattcaggggaggatatattccacatcctgagggaaatgatttccaccacagattgccctaccaaaccccattcatcaatcaagcccagggtagaataaagacattttgaaacatgcaagtaattaatcacttacttccctttctcagaaagccattgcagggtgtgttttacataggctaatagataaaagaatttccaggaagatagttaaaagaagacttgagatgagagaaaccccatctctactaaacagtaaacagtcttagaaagccagtgattctgggaatagtagcaagcctcttctcatgtctcaatggccagaaatgtgtattgtatctttgtatgagctaatcactagcaagggagtgacatattcctaaaaccagtgagggccagcctcaggtccatggttgaatgggaaatggattcaataaagtcaggttctcctaggaaggaggaagaggatattggatgttggttgggccatggacaatactgcgacaagcactccaatcatatgttgatatgtacgtgtgtgtgtgtgtatttattttccagttattgattctcttgtaatgaactgtctatctagctttgtgtcagtgctacactgttttaattattattgttttataatgtgttttaatatctgatagaacttgtcatccactttaaaaatttttctttccagaatattgttttatattgttgttctttcttctagataagacatagaattatttcatcaagtgggtaaagctgcacatattggattcaaacagacctgagtttgagattggcataagataggactgtttattagctttattcctggggaaagtttcttatctgtgtaagcctaagttttttcatttataaaatgaaaataatactagctaaattagataaaatgaacaaattcatagaaagacaagaactactaaaactgattcaagaagaaatagaaaattgggtagacttataacaagtaaaaactttgagttaataatttaaaaactacctacaagaaaaaaactcaggtccagatggcttcacttgtaaatataactgcaaattaaaaagagaattaacataaactttcacaaatgtttaccaaaaaaagaataggaaggactatttcccaagttttttaatgaggctagtattaccatgacagtaaaaccagtcaaatattttacaagaaaactgtagaccaatattcctatgaatacaggtgcaaaaatcctcaacaaaatattagcaagctgaattcagaaacatataaaaaagatcacacaccatgaccaagtggaatttatccaaggaatgaaaggttgatttaacatctacaaatcgactaatgtaatacattgtatgaatagattaaagtacccaaatcacatggtcatttctatgaagaaaaagtatttgacaaaattcaacattctttcatgataaaaaacactcaacaaactagcattggaagggaacttcttcaatctcaaaaaggaaatctataaaaaaaatccacagctaatatcatactcagtggcaaaagactgaatgttctcttcttaagatctagaaggagagaaagttgtctgctctcaccattcctattcaacaatgtcctagaggttctagccaggctaattaggcaagaaagttgaacaaaaggcatccagattggaaagacagtagtaaaactatttctgcttgcagataatgtgatatatatggaaaatcctcaaaattacagtaaaaatctattagaactagaaacaagttcatcacacagtatacaacatcagttccgaaaatcaactatacttcttctaaacactagtaatgaacaaatcagaaatgaaattaagaacacaattttgtttatgagcacattagaaagcataaaataattaggaataaatttaccaaatgaaccacaaaacttatactctgaaaatgaagaaatatggttgaaagaaattaaggaagacctaaagaaatggaaggatattcaatattcatgagtcagaggcttactatagttaaaatggaaatatctgaaattgacctacacattcaataaatctctgttgaaatacaagctggcctcttggcataaactgacaagctgattctaaaatttataagaaaatgcaagagatcaagaagagccaaaacaatttttaaaaagtagatcaagttggcaggttcataattctcaatttcaaaatttaccacaaagcaacaataaccaaaacattgtagttctgccattaggatagatatagatcaataaaatttaattgaagattcaacagttaattctcacattcacagtcaaataacttttgacaagtgtgccaagaccatttagtggggaaagaataggtttttcaacaaacaatgatggaaaaactgaatatccacatgcaaaaggatgcagttgaatatctacctcacaccgcatacaaaaattcactcaaaatagatcaaaacctagaagcaagagctgaaactataaaactcttagaagaaaacataggattgtatcttcctgaccttggattaagaaatgattttctagatatgacaataaaaacacaaacaaaataaaaaaagataaattgaagttcatcaacattaaaaattgtgtgcttaaacaagaaagtgaaagaatgggagaaaatacttataaataatctgatgacggaatagcatctaaaagatataaagaattcatacaattcaataataaaaagacaatccaatgagcgaaggatctgaacagagaaagaaggtacacaaatgctgataagcacaccaaaaaatgctcagtatcattattatcaagaaaaataaaataaaaagtacaatgagataccacttcatatccattaacatgattatgataaaaagaacaagtgtgagtgaggacatggagaaactggttcttctgtacactgctagtgggaatgtaaaatgatgcagctattttggaaaatagtccagaagtttctcagtggttaaacatagcgataccacaggacccagcaattctgctcctggatttatatccaagagaaataaaaacatatatccaagcaaaaatgtttacattaatattcataacaatatcataaataatccacccaagtggaagcaacccaaacattcatcaactggatgatgaagaaagtgtggtggacccatacaatgcaatattattcagcagtacacaagatgaaggactgctatatgtcacatcacagatgcgtcttgaacacattatgccaggtgaaagaagccagtcacagagaaccacatattgaaagtttccagtgatatgaaatgtccagagtaggctaaccgatagggacaggaattagattagtgattgcttagggctaggcagattgagttgaaatgagaagtgacttttaatgtgtacgtggttccttttgagggtgatgaaaatgttctaaaatagtggtgatgattgcacaactctgaatatactaagtcatttgttttataccttaaattatacccttgatgagtgaattgtatgatatatataataaaactactataaaaatggaaataattgtccatagggttgttatgaagataaaatgagataaaatttaaagaaatgctgaacaccatatctgttgcaccctggacactctttaaagtatagctgttactgttaatgctactgtgacaccaccgttaagctccaagaaaagttctgttgtaattggtcatgtcagaaacctgtatgttgatttgggaaaaatggacatcttcatgaattttcattgttccatccaaaacgatggtgtttcattccaatatctgttttactttagctcatgtagatcatctacactggatcctggcactcgatagaaaatcctcctatgatctccgcatgggccccaaggctcagcctgtcctgggcgctgtcaccttccttacctttctccattgtccccagccacagcaaaccggactcggctcctttccccactatgagctctctctcatatcaggattgctgcaggtgccattccttctgcctggaacactcttcctgcctcccacttgccctcagatccaatgatatcattgatcagctataaactttgcttccatgtccagcattgttcatcatcattagcttcagcttaaacgatgcctttcttctttcatcattgccatcaccatcataaccaatgtgtactgaatatttgcaggtatcaggcaccgggctgagtggttaagaatgttactcctgggagctaagtgctgcactcatccttgcttcacagatgaagaaactgagacttgcatggattaaggaacttgttcaagggcaccacacacttagaatcaacagcttgtgagtccagttctctttggagcctcaatgcatgttcttaatagctaaatgattaataaatgattaagcccaaagaccccgtccacgtgtttgtatttctctacctaaatcaatacacatatatttcagtgcatagtaaattgatgcattgcaatcatgttgacacaattctctatagtcgatgagtctgtttgagtctatcaatataatgatatgatatttgtagattcatataaagtaattcatgtggctgacatgtattctttggttctaaagacagatggccagatttttggtttggtgtagtttaaaaatacacccttgatgagtgtaataccataatgaagaaggcacctcattgtttgaaagtcaaggttattaatgtatgcaaatataccaattttacagatatatatctaacttttttttttacatttacatttgggatcttagaatatttcccgaatgtagcctcattctcataattattcttttcatttggattaggtttatttcttctctatgccaatccgttttgttcctcaaggagatctgacatatttaaatcaagggaatattaatacattcctaaaaactgagttgataacagttgagagctagataactgataatactgttcaaatttggcttttattaatgcactctagggacagttgtgtttgagtcaacctccagctaaaatgatagaaaacagatgtccttaaaacaggctatgtgaaaacaacagaaatgtccattcggaggagaatgttggaataaattacagtatgtacagcagtaatatctgcagccactaaaaattatgtgtaggtctatgtttactggcatcaaaaaatacacaatttattgttattggtaaaagctagttgtgaacttgcttgtattatatgacctcttcttagaatatatgtcctctccccttccctcccctctcatcccctctcctctcctcccattcctgtccctctctggccctcccatttgctctccttccttcccctcctgtctcctgccttattcttggctcctctactttttctctcctgtatttcattctgtctctccacgtatttagaactactccccgtgtgtgtgtgtgtgtgtgtgtgtgtgtgtgtgcatgtggcatgcatgtgcatgcatattgcagtgaatctatagatctggaaggtcggatattctggagagtggcagtattcatgcttattttccactgaatgcgttttgtatcatttttttgtgaaaatacattccttttaaaatgataaaaataaaagaacaacagtttatttccattaaaagataatcaagcagtagctgttgatgtcagcttaggggatcagaggttttaattgtgttttcattttcattgtaaagggcgggaatccagccaccaaatcaaaatcacggtgaccctttgaaagaatgacatttaacatgtcgagactgagctcacaaagaggttacagagcttttcaaccataatttgattgctccaatatcaatatagatgaatatttcatcaaaacggagcacagttatgcacagcatggtccctcctgatagtactgaacttgccctgggcggtttccctacagtgagaattttattatatagtagcctgccgagctctcctgggggtcagggggttaaagctacagaaatatgatttgagaatcatctgagctcagctttgttggaaaggtaaagagagggattcacaaagcctttttacgatgttatttaaatgccctgcgatgggggtggggttgggggagcagggataggaagtctaatcacaaccaaacctgtcaacaccagtgttgtgttcacgaaatactcaggatgccacgtgcccaccccagccccaactccgcaaagttctatttccagatatggattgtttttagtttgaaatagttgaaggcctctccctggcctctcccacttcattaaatgctacaaattaaaacaaatgtccatgaatactgtcctcccttggtgtttcatttgtcacagcgttgggcaacggtgccagctccggagttttcacgataagaccggggtggccatggattttggggcagtggcgttacctctgtgcatatcaagaagctgtttatacttcaattttatgctcatctggggcgactctggtgggaactaagctatatcccatccccaggtgctctgtcttggagtccccttgctgcctgttccaaagagtggagcctgtatcttgagggcagtgctaggtgccagcaacaggcactggtgtttaggtatagctggtgacattccagagaagctggtgacgtgccattttttttttttttttgagacagggtcttgctctgtttcccagactggagtgcaatggcatgatcacggctcactgcagccccaacctcccgggttcaaccagttcttccacctcagccttccaagtagccgggactacaggtgcgcaccacccctcacaactaatttttttttttgagatggagtcttgctctgtcacccagggtagagtgcagtggtgcgatcttggttcactgcaacctctgcctcctgggttcaagcgattctcctgtctcagcctcccaagtagctgggattacacacacacaccgccacacctggctaatttttgtagttttactagagatggggttttgccacgttggccaggatggtcttgaactcctgaccttgggccccccttggcctcccaaagtgctgggattataggcataagccaccattcccagcctcctcccaactaatttttgtgctttttattgagatggggtttcaccatattgctcaggctgatctcaaactcctgggttcaagtgatcctcccatcttggcctcccaaagtgctgggattacaggcgtaaaccactgtgcccagcctacctgccattttatatacagttttccccaaacaaatccacagttcacctcactggatcctaccagatgagccgtggccggtggttacttgggaaggcttggctttgagatttactttcttgcagcctgtggttttctgtttctggcttgtgtgtgtgtgtgtgtgtgtgtgtgtgtgcatagtttggttcactttcctatcacttccctgttgctacaataagttgtttcccttatatgtcatctcaaaatagaaatagaacaaagaaaacaggacacaagaaatcagggaattttccaaaggcacatttgatgtgcaagtgtaaacaggaatgagatgccaggggagatcggaattgtcagcatagacagctgttagtgggtgttgtcggtggcactcagggagatggagctgtctgcgaacttgcaaaggaagaggacacaggaaaggagagggtgcaaggaaaattccgcctttccgttgctgcttcaagttacatttgtacttgcagacttgagtaaatgtctgatttattcaactttaccagtaggagttagttcaaatacatggggcaggacatttacaaaagtctggacacttcatctctgagtgattttcaaggtgtgaagacttggactcaactctaactgcaggcagaggagtgggagacgttcccaggccactgaggataaggttcaagtgttggaggttgcagtgtctttgcatgctgctgagtcaagctggattttgacacagcctggttttatttaagaaaagctggaataaataacagggtcaggggtgcattcgggtgtcaggagttatggataaacaaccacaatcctggtattcactcgatttttatcaggagaccacagcatctcctatgctgtgttaaatatactctagaagatcttgggccagaagccagaaacaaacatttctggtgagagcaaatggtgtaaaaatgggaggggaataaaggaaaaggaaagggaaattctcatgacacctttgaacttgaatttcctgctttattcagccgatgtaattgaaaccgatgtctcctttctccctaaaggttccacatgtgtggaaccagggcattttctttttctaagagggtaagactgcacgtcctcctctcctttctaaggaacatctaaggtaactttttaccttagtgacaataaagttagcagcagcacattgaagtatgaagcacgggggggggtctatggaatacaattcaataagtaagatcagggcgctagaggttgcaaatcacttgatatttaccatctcgctttgttttcacagcaagtctgccgagtccgtagtcttgtgactagttgacagatggaaacagtgaaggcccagagagattcagtcacttgctcaaggccacaggctggtaagttatggaaccgggattcacatccacacacgaatccacgctcatgaagattctgcctggcatcacgaagtacagtgtgagcgtcagcaccatttgctgggcttccctccatgcctgtatcattttaatgtctgtagtagagtcaaactaaggtgatatagatgaaaaccaaggaattcacaaagctaggcaaatccacaaagcagtatatcaaattaagacaaaagtggattcaattgagaaaaacagagttaggtgttcctggcatgcaaacttttttttttaagttaaatagttgacaagaaggatattacctgccacttctcttctaagttatttat

SEQ ID NO: 701 - DNA, 178520 bp, Homo sapiens
  misc_feature (1)...(178520): n = A,T,C or G
ccccgcccggctaatttttatatttttagtagagatggggtttcactatgtcggccaggctggtgtcgaactcccgacctcaggtgatctgcctgttttggcctcccaaagtgctaggattacagggatgagccactgcgtcaggctggaactgagtttttaatattacttaattttaggccaggcctggtggctcacgcctgtaatcccagcactttgggaggccaaggctgacggatcacctgaggtcgggaatttgagaccagcctgcccaacatggagaaaccctgtctctaccaaacatacaaaattagccgggcgtggtgatgcatgcctgtaatcccagatacttgggaggctgaggtaggagaataacttgaatccgtgaggcggagcttgcggtgacccaagatcatgccattgccctccagcctgggcagcaagagccaaactctgtctcaaaaaaaaaaaaaggtcgggtgcagtggctcccacctgtaatcccagcactttggaaggccgaggcgaacggatcacgaggtcaggagattgagaccatcctggctaacacggtgaaaccccgtttctactaaaaatacaaacaattagccgggcgtggtggtgggcacctgtagtcacggctacttgggaggctgaggcaggagaatggcgtgaacccgggaggcggagcttgcagtgagccgagatggcgccactgcactccagcctgggcgacagagcaagactccgtctcataaaaaaaaaaaaaaagaaagaaagaaagaaaagaaatagaaactcagttcctattcccgatttccagagctcagtggctgcatgcatattacagaatatttccatcacggtagaaagctctattggaagaggctggtctagactgaggcctacaaaagagcagttagccctaggaggaaggaagagcgtctccagggctccctgtaaggtggcctttgcagactatcgcagttatgactcttgctggagctgttgaggccagttcctgtagtgtcttgcctgccatcttgaattccctgctaaagacaacgagaaggcattggagtgttgcgcaaggtaagtgacatcatcagatttgagttttggagaatgagctggaggaggagcaagacaggaggcaggggaccaatcaggaggcagttgctttcctcccagaccttaggccagtcaaaatggtagaaatgtgcgtggagacatgcatgatgtacgatctgcagactgcagattctagttgggcctggaaggagcaggactaacggcaatggcttgaactatttggaggatggtgctaacagttcccttttaggcggaatctgaggacgagaatgagaaactgtttttttttttaacgtgttgctgcttaagggagtgggcttcagtgatctgcagggcctcattccctgataacatcaccgtgacagttcaccacggaaaactctagaaagacaaaacagcatacaaaggccctgaacctgcagaattcctacatgactacaatgggctttcctttgctctctttcagcctttcccccagtcctttacaatggcacctgcttctgtctccttctgccactgaattcaaggtcccctgcaaaacagccccactcttcgtggttggttgatatggactccaaattccgaactcctcaaatgttccttagacgccctccagtcttaacttctcccatgctcttccctttgtctggaaatgtctgttccttcttttattcctctagaaatttttcttttcttttttctttttttgagatgaagtctcactctgttgccagggctggagtgcagtggtgcaatcttggctcactgcaacctccgcctcccaggttcaagcaattctcatgcctttgcctcccgagtagctgggattataggcacccaccaccacacccagctgattttcctatttttagtagagatgtagagatggggtttcaccatgttgcccaggctggtctcgaactcctgagctcaggcaatactcccacctcgcattacctaagtgctggaattacaagcgtgagccaccacacctggcctaaaataaagttatacctatgaaattaaaatatgtggctgggtgtggtaactcacacctgtaatcgcagttctttgggagaccaaggtgggagtatcgcctgattccaggagtttgagaccagcctgggcaaagggcaagacctgtctctacaaaaaataattaaaaaaaccaattagccaagtctgctggcgcatgcctgtagttccagctactcgggaggaggaagtgggagaatcacctgaacccaggaggtcaaggctgcagtgagccaagatcacgccagtgaccccagcatgggcaacagagtgggaccgtgtctcataaaataaaataaaagccgggcgcactggctcacgcctgtaatcccagcactttgggaggctgaggcgggcggatcacttgaggtcgggagtttgagaccagcctgaccaacatggagaaaccccatctctactaaaaatacaaaattagccgggcgtggtggcacatgcctgtaatcccagctactagggaggctgaggcaggagaatcgcttgaacctgggaggcggaggttgcggtgagccgagatcgtgccattgcactccagcctgggcaacaagagtgaaactccgtctcaaaaaataaaataaaataaaataaaataaaaatatgtgtatacattactctgtatcacctaatatcatttcacatatcatctgtggtgtgtctaattcattgtggaaaatattactttaaaccacgtattctatttgttttactttattgttatgtatcctaggccttccttatctgtggttttgctttccggagctttcagttacctgtggtcagctatggcacaaaaatattcagtggaaaattccagaaacaaacacaagttttaaatggcatagcattctgagtagcatgatgaagtctctcgccatccctgctcgggatgtgaatcctctctttcccagcgtatctacactgtagacgctaccgacctggtagtcacttagtagctgttcccagatccaaaacccacagggcacatagatctcggtgccgtctgcagtttcagtcatccactggggtcttggaacatctttcccacagataaggggggactactgtgcttgtcttatttccccgactcaacactcagctccaggtgacagataaactcttcctcattttgggtgtcctgaagcatctagaaaacactttagaggtcgcttcaataaatatatatattttttgagacaggatctcattctgttgcccaggttggtgtgtggtggcacagtcttggctccctgcaacctccacctcccgggttcaagtgattctcctgcctcagcctccagagtagctgggattgcaggtgcctgcaaccacgcctggctaaattctgtattttttatagagacagggtttcaccatgttggccaggctggtctcaaactcctgatctcaaatgatctgcccacctcagcctcccaaagtgctgggatggcagccatgtatcaccacacccagctcatttttcttttttttctttcttttttttttttttggtagagttggggtttcgccatgttgtccaggctggtctctaactcctgggctcaagagatccacctgcctcagcctcccaagatgctgggattacaggcatgagccaccgcacccagccctttcctttctttttaagtcagaatagtgttccattgtgtgtatagaccacattctgtttatctgtttatcagctgatggactcctgggctgcttctgccttttggctattgtgaccatactgctatgaacatgagtgtacaaatacctgttcaagtccctgctttcaattctttcaggcatatatccagaagtagaattgctggatctcaatatttttagtaactgccgcattgttttccatattttgcattcccaccaacaatgcacaagggtttcagtttctccacaattttgccaatgcttattttctgtgtttttttgtttgtttgtttgttttgttttttagagagaatctcgctctgtcgcccaggctggagtgcagtggtgtgatctcggctcactgcaacctctgcctcccaggttcatgccattctcctgcctcagcctcccgagtagctgggactacagttgcccaccactatgcctggatcatttttttgtgtttttagtagagacagggtttcaccgtgttagctgggatggtctcgatctcctgacctcgtgatccgcctgcctcggcctcccaaagtgctgggattacaagcatgggccaccgcacccagccttttttctttttttttaaccaataaccatcctaatgtgtgtgaagtggtatcttgtggttttgatttagatttccctagtgaaatagtaatattgagtatcttagtggcaaatgtgtttattggccatttgtatatctttggagataggcctattcaagtcgtttgcctttttcttcttttcttttttttctttctcttttttttttttttttttttgtgatggagtctcactctgttgcccatgctggagtccagtggcacattcttagctcactgcagcctccgcctctggggttcaagcaattttcctgcctcagcctcctgagtagctgggactacaggtgtgtgccaccacatccagctaatttctttatttttatttttgttttattttatttatttatttttttgagacagagtctcactctgtcacccaggctagagtgcagtgactcaatttcggctcactgccagctctacctcccgggttcataccattctcctgcctcagcctcccgagtagctgggactataggcacctgccaccatgcctggctcattttttatatttttagtaaagacggagtttcaccatgttagccaggatggtctcaatctcctgaccttgtgatccactggtctcagcctcccaaagtgctgggattacaggcgtgagccactgtgcccggtctattttttaattaggttgttttttgttgatattgtacttgatttgtaagagctctttgtatatttcggatattaatcccttatcacatatatgtggtttgcaaatactttctcccatcccatggattgccttgtatattagtccactttcacactgctgataaagacatatccaagactgagcaatttacaaaagaaagaggtttaatgggctcacagttccacgtggctggggaggcctcacaatcatggtggaagctgaaaggcacatctcacatggcagcagacaagaaaaaggagcttgtgcagggaaactcccctttacaaaaccatcagatcttgtgagacttattcactatcacaagaatagcacagaaaagtcctgccccctggttcaattacctcccactgggtccctcccacatcatgtgggagttatgggggctacaattcaagatgagatttgggtggggacacagccaaaccatatcaccttgtctatttttttgtttgtttgttttgtttttatttttaatgtggagtctcagtcacccaggctggagtgctgtggtgcaatctcagcttactgcaacttctacctcccaagttcaagggattctcctgcctcagcctcccaagaagctgagactacagatgtgtgccaccagacccagctaatttttgtatttttagtagagatgaggtttcaccatgttagccaggctagcctcaaactcctgacctcaagtgatctgcctccctcggcctcccaaagtgctgggatgacaggcgtgagccactgcacctgacctcaccttgtctgttgatagtgagtgtcctttgaggcacaaaggttttacttttggtggagtccaatttatctattttttcttttgttccttgtgtttttggcatcatatccaaaaatcattgccttagtcaatgtcattaagcttttcccctatgttttctaagagttttatagttttagcttttacatctagatcttggatatattttgaattaatttttagatttatttatttatttttgagacggagtctcattctgtcaccgaggctggagtgctgtggctgcaatctcagctcactgcaacttctgcctccccagttcaagcaattctcctgcctcagcctcccaggtagctgggattacaggtgctcgccaccacacctggctaattttcatatttttaggagagatggggtgtcaccgtgttggtcaggctggtcttgaactcctgaccttgtgatccacccacctcacctctcaaagtgctgggattacaggcatgagccaccgcgcccagcctatttatttttttagatggagtcttgctcttgtcctccagactggagtgcaatggtgcgatctcggctcactgcaacctccgcctccaagcttctagcaattctcctgcctcactctcgcgagtagctgggactacaggtgcttgccaccacactggctaatttttatatttttaatagagatggagttttaccatgttggccagactggtcttgaactcctgattccaggtgatctgccctcctcggcctcccatagtgctgggattacaggtgtgagccactgcctggccagttttttttttttttttttttttctgagacagattctcactctgtggcccaggctggagtgcagtggtgcaatcttggctcactgcaacctccacctcctgggttcaagcgattcttgtgactcggcctctggaatagctgggactacaggcatgcaccaccatgactggctaattttttttttttttgagacaaagtctcactcttgtcccctaggctggagtgcaatggcgctatctcggcccactgcaacctccgcctcccaggttcaagcgattctcctgcctcagccccccaagtagctgggattacaggcacctgccaccacacccggctagttttggtatttttagtagagacagggttttcaccatgttggccaggctggtctcgaactcctgacctcaggtgatccacccacctccgcctcccaaagtgctgggattataggagtgagccaccactcccggccacgaccggctaatttttgtagttttagtagagttggggtttcaccatgttgggcaggctggtctcgaactcctgatcgcaagtgatctgcctcccaaagtactgggattacaggcatgagcctagatagatctaaatttggtgcacaaaggaatagggcaccacagcatgatcttgagcaggaagtccaagaagagagagacagcatcttcttgaagccctggggtagaataagatcagattgtacgtgaaaaaccagtaggcttttggggtgggtgcggtggctcacgcctgtaatcccagcactttgagaggctgaggcaggcagatcgcttgaacccaggagttcaggaccagcctgaccagtatggtgagaccttgtctctacaaaatatacaaaaattagccaggcatggtggcacgtgcctgtggtcccagcaacttgtgaggctgaggtgggaggatcacttgagcctgggaagcacaggctgaaaggagctacatttgtgccactgcactccagccttagcgacagagccagactctgtctcaaaacatacaaaccaaaaaaaccagtagactttcagaggaatagatgccatttttttcttccttaatcctctgccttacagctaattctacagccacaaaaagaaaaaaaaaaaagagagagaagaaggtgatttgacaagacaaaggatttagaaaagaaaggcaggtgttagtcatgtggaaaaaaaaggaagtatttgtgtttacaagaatcccgacagtatctgagaatgtagaatgaagaatattttccatttgttaaaaaatccaggctaagcatgtgaagtactcagggttacccctctgacctcatcttggggtgtttcaacctaccatggttacccctgttagttaacaccttatcacagaatcacaaaggcccacagagtgaaagtggttacaatgagctctcatgaaaagtaggagttaggcttggcatggtggcttacacctgtaatgtcagcacatttgagaggtcaaggtgggtggatcacttgagccccggagtttgagacctggacaacatggcaaaaccccgtctctacaaaaaatacaaaaattagctgggcatggtagcatgcacctgtagtcccagccactcaggaagctaaggtaagaggatggcttgagcctgggaggttgaggctacagtgagccaagacagagccactgcactccagcctggacaacagagccagactctgtctcaaaaaaaaaagaaagagagagagggagggaggcagagagggagagagagagagacagagagaaagagagagagagaaagaaagaaaagaaagaaagaaagaaagacggaaggaaagaaagaaggagaaaagtaggagttagtcatccaggccaagagtatgaagtttgtcttcaaagaactcctgaatttgtgggggaactagatatagacgtttgacgaacacgtttttatttattagaggttatgagactagcgagtagggtggaaggaggaaagtggcaggaaaatcatactggaaaggtaggttgggaaccaactgtgaaggaccttgtacgtcaatccaaggaatgtgaccttcaacctagagcaagaggtgacaaactcaaaatcccacagagactaggcttgccaatgaggaaagccaaccaggtgtaaggcaatagggagtggtggggactgtggcaaacagtaaagctcattctctgtctacaggggctcattctctgtctctactccatctactctaagctccagctgattgtttccatgtgggagtgtcggtccagtgtggccagatcttccagtgttctaagagacaacagaaatccaggtttttataggactgcaccaggttttaaaaacatatcggccaagccaggctggtttttaaaccagatatggtccacaggccatcattctagccccttggcagattgaagggagctagtgaagatttttaagtgaaaaaaggtatatgataatatctgtgcttcagaaaaatcagattattgtgtagaagatgacttacaggaaatagatgagaggaagggaaaccagttaggaaactgtttcaacagttcaggtgggaagtgactgcggtctgtgctagggcgaggcaggggagaatgtgggtggacagatttggagtccagcatccagtgggaagaatttagcttcagtgtgcatctagaagacagacacattctttcaatgcaccccctcttttccgccccattttttttttttgagacagagtttctttctgtcacccaggctggagttcattggcacgatctcggctcactgcaacctccacctcccgggttcaagtgattctcctgcctcagcctcctgagtaactgggattacagacacatgccacaacacctgactgatttttgtatatttttagtagagatggggtttcaccatgttggcaaggctggtcttgtactcctgacctcaagtcatccacctgcctcggcctcccaaagtgctgggattatagatgtgagccaccgcgactggcttccaccccattttcttctttctttcttttttctttttctttttcttgttgtttttttttttttttttgtttgtttgtttgttttagacggagtctggttctgtcacccagactggagtgcagtggcgcaatcttggctccctgcaagctctgcctcccgggttcacgccattctcctgcctcagcctcccgagtagctgggactacaggcgcccgccaccacgcctggctcatttttttgtatttttagtagagacggggttttaccgtgttagccaggatggtctccatctcctgacctggtgatccgcccgcctgggcctaccaaagtgcttggattacaagcgtgagccaccgcgcccggcctccaccccattttctaaactggaagctgaaaggcacagggcagattaataatccttaaagccaaaggacaggaaattttagcaaagactccaattttttgtgcagtctaatgttactcatgattgctttagagatggactccttaatcaactcctccaatcctcttccgcccccagggggcagttttaattgatgggctcagcacataattgaaattaaaaacgtacatctcatggtgtttggctcattcaagcagccaatggaaactcagggccaaatctttgtaaaagttctaggctctgcttcccagcagagggggaaaccggctcccaaagaggccgttttgtggagacagacatatgagaagtgggcttcggatctatttcatggtcttggtggttgtgcaactggccactttggttcacggaaggatgtaaagggcagggaggtgggaatagagcgggggaaaggtgactcccgtcaaagaatttttctaacatccatcaagtatcgtgattagaacttttctctccgcagactcctccaatttttgagcgcggtatttttcggcacaggaaatggcccggaggagctgcagagcaaagcctcccctctctggcaccgcatgggagtgccccgtgggatgagggagaggacaaggcagtcaggcaaaggttacgggaggaaagcaaaggcaggggcccagaaccactccaggaaatgtttggatttctccaccaggagggaggacaaacaagctttcttcttgccttctgggcagctttgtgtgctctccagcacggagtccgaggaggaacagcgaagctgaaaatgaaaattactctggcgctggacccaatcgctcctctacggcatcaatctcatcggacccccccaccctaccgcctctcagaaatgaccacttttgcaaaattgcatgcatttccaagcttcatccggctccaggcttggcctctcccagaggcaggcggcttgtgagacgggctccagagaaaggacctccctgggtctctcatttcctggctgaagtttctcttctcgctgctgtggcagcatccaacccacacacacaggacccgcatcctgggtgatgaagtcagacacgcagcagctgggtgagtgctaacgctcagataagcatctgtgccattgtggggactccctgggctgctctgcacccggacacttgctctgtccccgccatgtacaacgggtcgtgctgccgcatcgagggggacaccatctcccaggtgatgccgccgctgctcattgtggcctttgtgctgggcgcactaggcaatggggtcgccctgtgtggtttctgcttccacatgaagacctggaagcccagcactgtttaccttttcaatttggccgtggctgatttcctccttatgatctgcctgccttttcggacagactattacctcagacgtagacactgggcttttggggacattccctgccgagtggggctcttcacgttggccatgaacagggccgggagcatcgtgttccttacggtggtggctgcggacaggtatttcaaagtggtccacccccaccacgcggtgaacactatctccacccgggtggcggctggcatcgtctgcaccctgtgggccctggtcatcctgggaacagtgtatcttttgctggagaaccatctctgcgtgcaagagacggccgtctcctgtgagagcttcatcatggagtcggccaatggctggcatgacatcatgttccagctggagttctttatgcccctcggcatcatcttattttgctccttcaagattgtttggagcctgaggcggaggcagcagctggccagacaggctcggatgaagaaggcgacccggttcatcatggtggtggcaattgtgttcatcacatgctacctgcccagcgtgtctgctagactctatttcctctggacggtgccctcgagtgcctgcgatccctctgtccatggggccctgcacataaccctcagcttcacctacatgaacagcatgctggatcccctggtgtattatttttcaagcccctcctttcccaaattctacaacaagctcaaaatctgcagtctgaaacccaagcagccaggacactcaaaaacacaaaggccggaagagatgccaatttcgaacctcggtcgcaggagttgcatcagtgtggcaaatagtttccaaagccagtctgatgggcaatgggatccccacattgttgagtggcactgaacaagcagaccaacaacactgaggaagatagagtggtgacttagaattaactcgtgctaaggggtcgggggctttgaaaatgccacccccctttcttattgcaagacggcttctcgcacatgaactgcatccttctcattctgtcggaaatgaaattcacacaactataccttttggggaggttccagttgattgaagtgagttggctgcattttcttatctgatcacaatggcaggggacagaatgtgcatggagtggagcatgtgtgtgttgggaggggggctaggaactgcacagcccttgtgtaattttcgttgtttgtttttgttttgagacagagtctcactctgtgtcccaggctggagtgcagtggcacagtctcggctcactgcaacctctgcctcccgggttcaagcaattctcctgcctcagcctcccgagtagctgggattagaggcgccagccaacacacccggctaatttttgtatttttagtagagacagggttttgccatgttggccaggctggtctcgagctcctgacctcaggtgatccgcctgccttggcctcccaaagtggtgggatcacaggcgtgagccaccgtgcccggcctcccctgtgtcattttaaatggctaagtaaatgggtatatgtgtttgaatggggcatgttcactctcttaggggctatggggcagttagcagcatttcctatcctctgaccttaaatcattccttatctcagaaaacagaaaccgggctcagtcaatcaatgctttatttcaggccgaatgaggctctttagattgggatctattgatctatcaattttcatctttacatttctttgtacatctgtacattttgtccaaatgtacatctgtacgtctgtcatcattgtgacttcctggtagcccaagaagaacaacaacaaaacaatctgctctgaccttcttcaaatctttgtatttcaaagaaggtgctgagggatctgtttccttgccctggcttctccagtgggatgtgctgagtccaatacaattgcttttataattgcttttgacaacttgtcatgtgactgtgaattgaaattattcacttattttccaagtatttactgaattcgtatttggtggcaggcagtatactgtgtaatttttagtggagggtcattagtcaactcttatgtgacagtaaagttttttgggggggtggggacagagaagttaagagctttcatcctttcacggaatacagtttctagaccgattctgtgtgaacatcagttttgtcctcttattgcaagactccctcatacacatgagtttcccaaatgtgtacctggacccctcgaaacagaggactctacgaaatgacaagctgcccctgccctgaattagggggaaacattccaggccaactctagctcctttctcaagctacaaagtggtgaacatggttctcaactccttaatttatactctctcaaatgcccaggatactctacccacttaagaaccttgccaacttctgggggttgggcatggtggctcacgcttgtgatcccagcactttgggagactgaggcggatcacctgaggtcaggagttctagaccagcctgaccaacatggagaaacctcgtctctactaaaaattcaaaattagcctggtgtggtggcgcatgcctataatcccagctattcgggaggctgaggcaggagaatcacttgaaccgaggaggtggaggttgcggtgaggtgacatcgtgccattgcactccagactgggccacaggagtgaaacgccgtctcaaaaaaaaaaaagaactttgccaacttctagttctttggcctcaaaacacccctctaggctgtccctattattccttttttcagaggcactgtgcagcctagtgatgaaaagtacgagctatagagcattagaagcatcgaagtttgaatctcagctcaagcatttactaggcctgtgatcttagggcagcttgtgtttttagacactgaatctcgctctgttgcccaggctggagtgcagtgagtggcatgatcatagctcactgcagcctcaaactcctgggctcaagtgttcctcccacctcagcctcctgaatagctgggagtacaggcataagccaccacactcagctaatttttaaattttttttatagagacgaggtctcactcactgtgttgcccaagctggtctcaaactcctggcctccagcaatcctcccaccttggcctcccaaagtattgcgattgccagcatgagccactgctcccagcctggcatatatatagatatatatagagatatatagatatctatctatctatatatatatatatatattttttttttttttgagacagagtcttgctctatcacccaggctggagtacagtggcccaatctcagctcactgcaagctctgcctcctgggtccacgccattctcctgcctcagcctccagagtagctgggactacgggcgccccaccaccacgcccggctaattttttgtatttttagtacagacggggtttcattgtgttagccgggatggtcttgatctcctgacttgtgatccgcctgcctcggcctcccaaagtgcttggattacaggtgtaagccaccgcaccccgcccagcctggcagattttatttaatcatttgtagcttcattttcctcgtctgtcaaacagggatactgtaatacaacctcagtgtgtcattgggcagtttaaatgaatgtacattcctgaggcatcagaactttgttcactgttatatacccaatgcctagaagaggacctgcacatagcaggtgctcagtaaatgtttgttgaatgaatgattaagtgcatgtaaagcattaagcatagcgcctggcagtaagtgctcaatattatgacttcttatattaacacgttttacatataaagaaatggaggcaagaaagcatttcctttggggtttagagcgcttaagttgttcctctgttatcatgcctgaattcccccgcccctcagttacctggggaagagtaaaggcaagaattcttaccagcattagtcatacatcctcctgataggaatctgcaaaaacacacacttctgcttttagttctattcttagaattctctcctgggctgttgctcctttgttccttcattgtaataaaaatggattctgaaagcaaatctgtgtcctgtgtgtgactctaggtcaaaggacccctaggattttgccctccaaggaaaaaaagctaaaatatctagaactgcatggcaggcaggcaggcagaggttctcaccaaaaaaacagcaagcacaaacaaaaagaaaaatcaaatccaaactgaaatacagtcttgattctaaatttgcttccctttttacgttcgcagaatgtgacgaaaaatacatcttagcaagaagtttctttggacattgtaaagaagtggagtatagctttgttgacaacactttgtttaaactatctgaaacaggaaaatgattgttttagaggaaaatgtgttctccctctttttttttttttttttggtgagatggggtctcactgtgttgcccaggctggagtgcagtggtgtgatcatggctcactgcaacctcgacttccaggctcaagcgatcctcccacctcagcctccctagtagctggggccacaggtacactccaccatgtccagctaatttttctgtaatttttgtagagatggggtctcattatgttgccgaggctcctctcaaactcctgggttcaagtgatccttcctccttgttcctccttttagagtctttcaggaaaagtcacatgaaagctggaagagctataagtctatagggatgatgtggaaaaaacaagaggtgtcttttattcgtgctaaccatggtaaaactttcagttttggtctattctcggaatggatttccttaccctttattaaaaccaaaatgtttaacatggcatctgaaggttactaaagtgcagcagctccttggaggggattagaactctgaggcacaagggcttgagccagttgttctcaaggtggagacttggctgcactgtgaggcgtggtctctacctgttggcttcccaggccttctgattcacagaggtttctgatacgattcaagaaagactccatcatcacaacgagtgcataaatggcttcaagatcagcgacctactttgcaggccccagtgaaaaatgaaaatgtggggtcccttgttcaaaaggtgttaatggctgagcgaggtggctcatgcctgtaattccagagctttgggaggtcgaggcgggaggatcacttgaggccaagagtttgacaccactctggccaacatggtgagactccatctctacaaaaattttaaaaattagccaggtgtggtggtgcgtgactgtagtcctagctacttgagaggctgaggtgacaggatcccttgagaccaagaagtagaggcttcagtgagctacgatcatgccactaaattaaaaaaaatttttttttcagacagtctcgctctgttgtcccaggctggagtgcagtggggcgcatcttggcccactgcaacctccccctccctggttcaggcgattctcctgcctcagcctcttgagtaactgggacaacaggcacatgccaccgcagcaggctaatatttttatatttttagtagacacaagttttcaccatattggccaggctggtcttgaactcctaacctcgtgatccacccacctcagcctcacaaagtgctgggattacaggtgagagccactgcgccaggccaaaattttttttaaataataaaaagtattaagaattttgaagatggtagcacagggcccttctgagctcatccacgaagcagaggctgtaagtttacacacatttatttatttattatatatatttctgctatataatttttacatatgacatgttgtttatcgtcatatttaccatattatatgtcatatttatatatgtacattatataatataaatatataattatttatatattagagagagatggaatagaataaacagatgaaacagatgggctcacatatgagccaaatctgtattcgggtttctgtgtattggactataaaatgacatagagggaggggggtaaatattttattccttataaggattcattcattcatttcctatttcaaggtacattaatgaagcactagctctatactggacacagtagaaacataaatgaaaaacatagccacggggcccattgtagaaaccaagggaaaaaataaaattagaaaataaaaaattataaaatatggccaggggtggtggctcacatctgtaatcccagctgtttgggaggccgaggtgggcagatcacttgaggtcaggagttcaagaccagcctggccaacatggtgaaaccccgtctctactaaaaatacgaaaattagctgggtgtggtggtgtgtgcctataatcccagctactcagggggctgaggcaggagaatcgcttgagcctgggaggcagaggttgtagtgagctgagatcacaccactgcactccagcctgggcgaccaagcaagactctgtctcaaaaataaaataaaataatacaattatcctgtgggaccctgtgtttggcactttcacacagggtcctgcaggagaatccagggcccttactcctgtcttagtcgtctcagaggaagtagcttgcaaactcggctctgaaggatggacaggaagccaccggggacacagtggggaagggtattccaggcagatgtagaaaggtgaaaaagagccaagtgtttgggaaatgcaggaagaccaatagggcaggaacgaaaagtccaggctggggctgcgaccactcggtaagacgtgaagccatgaggtcagccgaggagggaagggtctgttgtctgttctaacccttagcgtgacagaagattcatgaatagactttcagattcctctctatcttgtttttctttttgttgttgagacagggtgttgctctgtcacccaggctggggtgcagtggcatgatctcagctcattgtaaccttgaacccctggactccagcaatctgcctccctcagcctcccaagtagctgggaccacaggcatgtgccaccatgcccagctaattttggtattttttgtagagaccaggtcttgctgtgttgcccaggctggtcttgaactcctgagttcaacggatccacccaccttggcctcccaaagtgctgggattacaggtgtgagccaccatgcctggcctcttacatttccttctaagagttttttagatttagctcttacatttaggtcgtaacccaagttgagttaatttctgtgtaccgtgtagcaaaggggtccagttcttttgcttgtggtgacctagttgtcccaacatcatttattacaaagactcttctttcccccattgtcttggcacccttgttgaaaatcagctgatcatgaatataagggtttatttctggactctcagtcctgctctcttgagctgtaatatctatccttatgccagaatcacactggactactgtagctttacagtaaagggagagttctccaacttagttcttctttttcaagattatttggttattctggtttgcccttaggttttttacaataaacccaaacttttcaaaaccatgaagtgctcttctcctttttcaaaagaaatgtgtgtgtgtatctatgtgtctctgctagtcagtatgatcagcttcctctctacccccttacttcccagcttctacaactacatctccttcgttgggggcccaggggccccttatttcctgctagccaagggtcctgactcagtgtcatctatattctgtagtggtgagtctgaatagccccaatgtgctgtacctcctggcactcccacccttaggtggcacctcccagtggaatatggactggctctgtgatttgttttgcctgattgaatgtggtggaggtgatgttctggggtttccaagcccagggatggagaaggtctgcctgtgtgccttcagaagccctaagtatgtccatgtacaaagtccagactatgtcgtggaaagaagatgtgaagaggctgtgtgtagatgccacatagaggggccacacagagaggccacagggacgccatgtagagaggcatcaaggttctgtggagacagagagaagcctgagtgtcccagtgtccttcttaagcatccgtatgactctagcccggctgccatctgagaatccccaaatgagaagcacccagctgaggccagccaacacagagaaccatgagagatgacacaatggaggttgtgttaagccgctatgttttgtggcaatttttaatgcagcaatagataattaaaacagaaatccgatggcctggcatggtggctcacacctgtaatgccagcgctttgggaggccgaggctggaagatcacctgggcctacggttcgagaccagcctgggcaatgcagtgagaccctatctctatttaaataataaataaaaccaaaaatcccaggttagttcaaagacacgaaatagttacttaacctcctgatgcctcggtttctcaatctgtaaaatggagatgataatgacaataataatacatctgtcacagggtttttgtgaagattaaaggagatcacatatgcaaatctctcagtacaatgcagtcgtgtcactattaatttttacaataattcaatccagtttagtggtacacattcaagttgtcataagataaccaggcatggagattcaactgggtgagtgataaattttaagtggagtttctacgaaatgcggagggatcactgccttcactcttgaaatgattcattaaacaagtttctgtacaactcatacacttgtaagaaaaaaataataaatgcatgaaagaaggaaacaagcaagacaaaacatgctcactgtgcagtgggaagaccggaaattccatcggaggcaccagaatccagcgaggctgccctttagaatctgcccgagtagccgcggactttggtttagaatcatgtagtgtgagagctgggaggaagttcgaagatcatctaattcctcatgagcgggtgaggggttaaggggtttcacagctagttaatgagagagccagaacatacatccaggctccaggttcttttgcaaacttaacatgtgtggttgttcttttatttatttttattttaatattattattattttttgacatggattctcactctgttgcccaggctggagtgcagtggtgtgatcttggctcacggcaacctccgcctcccgggttcaagcgattctacctgcctcagcctcctgagtagctgggactacaggtgcctgccaccacacccggctaatttttgtatttttagtagagactaggtttcaccatattggccaggctggtcctgaactcctgacctcatgatctgcctgcctcggcctcccgaagtgctgggattacaagggtgagtcaccaggcctggcctgtggttgtttttttctaattttatccatgactattgtttaaaaaaaaacacacacacaaaatattatgaaattgtgaaacttagaaagggagagtcccttgcaaatttcagcttctagaaataaatactgctgacttctctgactcttagttaataaaggcccttaggattactttatgaatgttgttgacaagtgtccacatacatccaagaaggaagcatggtattcacaggcagcaagaacaagaaacaaataccaattatttcactaaagcctgaacagcatgacctccatccccaccatgccctgagcaagatcttcaaccttacagacaaggcaataacatagtaagaggcagtgagcatgatggttagggacacaggctttgaagtcactgccagattcaaatccaagctcagctgttttttttcttttagttttgagacaggatctcactctgtcacccaggctggagtgcattggcacgatctaggctcactgcaagctccgcctccctggttcatgccattcccctgcctcagcctcccaagtagctgggactacaggtgcccgccacgacgcctggctaattttttgtttttgtatttttagtagagacagggtttcaccgtgttagccaggatggtctcgatctcctgacctcgtgatccgcccgcctcagcctcccaaagtgcttggattacaggcgtgagccacggcgcctggcctctgtttttttttttttttctaaacagagtttcactcttgttgcccaggctgtagtgcaatggcgtcatctcagctcaccgcaacctccgcatcctgggtcccagttcaagcagttctcctgcctccgctactgagtagctgggattacaggcacgcgccaccacacccagctaaattttgtatttttagtagagatctgatttcaccatgttaaccaggctggtatcaaactcctgacctcgtgatccgcccacctcagcctcccaaagtgctgggattacaggcgtgagccactgtgcccgggtttttttgtttgtttgtttgtttgtttggtggagtctcgctctgtcacccaggctgcagtgcagtggcacaatcttggttcactgcaacctccaactccctggttcaagcgattctcctgcctcagcctcccaagtggctgggattacaggcgcccgccaccacgcccagctaatttttgtatactttagtagagacggggtttcaccatattggccaagatggtctggatctcctgaccttgtgatcctcccgtctcggcctcccaaagtgttgggattacaggcgtgagccaccgcgcccggccatgctctgctcttatgagctgggtggccctgaatattttatcctctctgagcttcactttcctcatttgaaatcagaatcaataataataccttccacatgggctacagtcagagtgaaacaagcaactataaaagcactgagctcctggctaacatggtgaaaccccgtctctactaaaaatacaaaaaattagctaggcgtggtggcgggtgcctgtagtcccagctactcgggaggctgaggcagcatggcgtgaacccaggaggcggggcttgcagtgaggcgagagcgagactttgtctcaaaaaaaaaaaagcactgagtatgggttccagcacatgggaagctctctataatgtaggtgccaccatcatcttcatcattgtcttcatctcacctggatcatcatcaagtacttgtagttctatgggaacctaatattaggtcatcctaactctagtttacttgaagactctataagctcctattattgaacctgcgtttgcagctaaagaaataaattgacatcttatggccggcagtgatggttcacacctgtaagcccagcactttgggatgccaaggcgggaggatcacttgaagtcaggagttcaagaccagcctggccaaaatggtgaactccatctctattaaaaaatacaaaaattagccaggcacggtggcgggcacctgtagtctcagctacttgggaggctgaggcaggagaatgactggaacccaggaggcagaggttgcagtgagccactgcactccagcctgggcgatagagtgaaactccatctcaaaagaaaaaaaaaaaaaaaggaagaaatttacattatataactcaaagtagaagcaacatagtttagaagtctcctgcatggaagaattcataagaccaaaatattaaagggagaaaacattctataggatgacacccaatcgcactgacaagcagagaaacaatgtgtgcaatggtgtcccgctacaaggcagggttccatgtcctcttaggtcctgtcactctaagtttaattttacaaaaatgggggctttaaaaatatcacatacttagtgggggaggttttgcgtgtgtggagacagagtgcacaggaccgtccgtactttctgctcaattttgctgtgaatctaaaactgccctaaaaaataaagttcattaaaaaaaaaaaatcacggccaggcgcagtggctcacgcctgtaatcacagcactttgggagaccgaggcgggtggatcacaaggtcaggagttcgagaccagcctggccaacacagtgaaacctcgtctttactaaaaatacaaaaaattagctgggcgtggtggcgcacgcctgtagtcccagatactcaggaggctgaggcagaagaactgcttgaacctgggaggcagaggttgcagtgagctgagattgttccaccgttctccagcctgggtgacagggtgagactctgtctcaaaaaaaaaaaatcacatcctaaggtcccaaggacataaaacaagttagagacctcatccagttttttgtttgtttcagggacctgcaaccaactttcttactgaccagtttcctgggctgtctagaacagacagcttatggggtactaaccccatgctctatcctaaggtacccctcttcatgcagagcgacacagaaaaacaaatttgtagcacaaagtacacccgatttgctacagcttacaactagcctcatgaatccttttctcattaattcaaagtttgcaaaaaaaagaaatcacatacttaaatcacttgagcacagaagcatatcaaaatctaatataaacaaacaaaaaacccaacttatgttaacatgccactgaaactgggctcaagttttcaaacatcttatgaaatattacactctccagcaggcttttttttttttcctaactggagatgaatggcagagttctgatatggaaaagcaatccatgtttgtacagaaaggtagcataggaaaagtggtcaaattcaaccagtctgtcctcatcaaacaggcaactactgtcttctcagcatttccaaaagaaatcatatgcctgctactgtttatgtcatatgcctgttaatttttcatgctaattcttagtgtttctggaaaacctcactgtttggcaccaaaaattgttattgctattgttgttgttttgttaattatgtcagccaagcagatgacggtgaattaattctgcaacgttgagtactcagttggcatacaagcacccagccttccaaagggatgtccttcatgtttcactgattttcgaatgacagtcggcttgcctaaacttatcctttacatttaagacatttcgtgggttcctgtatgcccaggggatttttactatttgtttatgcaaacagcaggttgcataagagccttgctggcttttttttttttttttagagatttcgtagtttcctgataaccattcagtcatctatttcaacaccctgacatgacataaaggcaggcacggaaccacacgttcaccatacagacacacgccactttgctggagcattcactaggcgaggcgctccatcggactcactagctgcactcatgaatcggcaccatctgcaggatcactttctggaaatagacaagaagaactgctgtgtgttccgagatgacttcattgccaaggtgttgccgccggtgttggggctggagtttatctttgggcttctgggcaatggccttgccctgtggattttctgtttccacctcaagtcctggaaatccagccggattttcctgttcaacctggcagtagctgactttctactgatcatctgcctgccgttcgtgatggactactatgtgcggcgttcagactggaagtttggggacatcccttgccggctggtgctcttcatgtttgccatgaaccgccagggcagcatcatcttcctcacggtggtggcggtagacaggtatttccgggtggtccatccccaccacgccctgaacaagatctccaattggacagcagccatcatctcttgccttctgtggggcatcactgttggcctaacagtccacctcctgaagaagaagttgctgatccagaatggccctgcaaatgtgtgcatcagcttcagcatctgccataccttccggtggcacgaagctatgttcctcctggagttcctcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctcaaataaccattccaagaagggacattgtcaccaagaaccagcatctctggagaaacagttgggctgttgcatcgagtaatgtcactggactcggcctaaggtttcctggaacttccagattcagagaatctgatttagggaaactgtggcagatgagtgggagactggttgcaaggtgtgaccgcaggaatcctggaggaacagagagtaaagcttctaggcatctgaaacttgcttcatctctgacgctcgcaggactgaagatgggcaaattgtaggcgtttctgctgagcagagttggagccagagatctacttgtgacttgttggccttcttcccacatctgcctcagactggggggggctcagctcctcgggtgatatctagcctgcttgtgagctctagcagggataaggagagctgagattggagggaattgtgttgctcctggagggagcccaggcatcattaaacaagccagtaggtcacctggcttccgtggaccaattcatctttcagacaatctttagcagaaatggactcagggaagagactcacatgctttggttagtatctgtgtttccggtgggtgtaataggggattagccccagaagggactgagctaaacagtgttattatgggaaaggaaatggcattgctgctttcaaccagcgactaatgcaatccattcctctcttgtttatagtaatctaagggttgagcagttaaaacggcttcaggatagaaagctgtttcccacctgtttgcttttaccattaaaagggaaacgtgcctctgccccacgggtagaggggtgcacgttcctcctggttccttcgcttgtgtttctgtacttaccaaaaatctaccacttcaataaattttgataggagacagtctggcgttgctatatctgggttatggttcacagaaatggacttcttacttaagcagagacctttatgggttgttaactttgtcctggtagaaaactactccacactgcaaagtaagaaagagacacagacactgagctacatcatgaaacaactaagcagaaattacacctgtgtctaaacaaagatagaaagagctgggattaaaaataatttggaaggatagtacagataggattgcaagagcacttacattttattagagtttggtgaatattgctcttcatatttgtgcattaaaaagggaatcaaggccaggtgcaatggttcatgcctgtaatcccagcactttgggggagccaaggcaggcagatcacctgacgtaaggagtttgagaccagcctggacaaaatggtgaaaccccacttctactaaaaatacaagaaaaattagccaggcatggtggcggccgcttgtagtcccagctactgggaaggctgggagaagaagaattgcttgaacccgggaggcggaggttgcagtgagccgaggtggtgtgcctgcactccagcctgggggacagagcaagacttcatctcaaataataataataaataatataaaaagggaatcaagccaggcagatatttttccataggagggggaagagcgagcttcctatggaatggtttcagttcccaattcggagaaggaaaggagatgtactggtttgagtctgtgatcagtccaagtttctgttacgctttcatttctaactctgtcagtccttgattatttggcaagacgaggcttgcttcaacctcctgacatgaacacagataaggaatttagagacaggctcccagctctgggtgaatgacagtaaatgaagaaaggtggatgctctggaattacctctgtgctttcagagcagttggcttgtctgtatcaccaagcaatgtacaggtaaaaagccaaaagcaaggatcaccttaaagaggaagagatgtcagggatgagctcagaggaaaatagggattccccagcctcggaggcatgagtcagtggggagcctcgttgtgaaacgcggattcgttcaagggatgaggtggtttggggtgtttggacctccacagctcacattcattcactgattcaggcattccatcagtttttttttttttttttgagaccgagtctcactctgtcatctaggctggagtgcagtggtgtgatctgggttcactgcagcctctgcctcctgggttcaagtgattctcctgcctcagcccccccagtagctgggattacaggtgtgcaccaccatgcctggctaatttttgtatttttagtagagatgggctttcgctgtgttgcccaggctggtctcaaactcctgacctcaggtgatccacctgcctcagcctcccaaagtgctgggattacaggtgtgagccactgtgcccagcctcattccatcagttttatgtattaagcgccaactgtgtgccaggcgctgttctgggtggtggagatagaacaagaaacaaggcagccacagtcctcttctcatcgagctgacttttggagtggggaggcaggcaggaataaaaaggagccttggggtggctatgggtgtcatgactatggtggagtgggacaatggggataaaaagtaaccggggctggggtgactgggatggcttctatgaggcattgaccctgagctgagccatgaatgactaaacagaaaagcaatgcaaaagtctgggggaaagacacgccaagcagagggaatggtaagtgcaaaggccctgaggtgagaattaggttggtgactgcgtgttcatttcctgtggctgggtggcttggaacaatagaaatgtattctcccacagatctagaagctagaagtgcagaatcaaggtgttggcagggttggttccatctggaggctaagggaaaatgtttcatgcctcactccgagctttcggagactgctggcactcttggactttccttggcttgtagacgcttcactccaatctctgcccctgtcaccacatggtggtcccctctgtgtcctctcctcttcttacagacacctgtcttttcttttcttttcttttcttttcttttttttttttttttggtctgtatttgagacagagtctcgctctgtcacccaggctggaatgcagtggcttcatctcggctcactgcaactctgcctcctgggctcaaccgattctcctgtctcagcctctcacgtagctgggattataggcatgcacccccacacctgtctaatttttctatttttagtagagacagggttttgccatgttggctaggctggtcttgaactcctgacctcaggtgatccacctgcctcagcctcccaaagtgttgggattacaggtgtgatccagcaggcccggccataaatatgcctgtctttataacccaccctaatccaggatgctctcatcttgagatctttaccttagttatacctacaaagacccttattccaaataaggttgtattctaaggtttggggtgaacatagctgttgggaaccagaactcaaccgactatagtgaggaacaatgtggccagcacgatgagcgtggggcctgccatatagtgaggtcgtgatcccctttcagacaaaagtaatgaaagacttgagatgaagatcatactatatttaaatgaagaagtttctaaacagaatatgatatccattttcttttaaaatacgtgtatctgtgtacttgtgtgtggaacaacagactacaggaacacacaccaggccgggcacagtggctcacccctgtaatctcagcacttttggaggccaaagcgggtggatcatgtgagcccaggagttcaagaccagcctgggcaacatagcaagactccatctgtacaaaaaatataaatatttagccaggcatggtggcacacacatgcagtcctagctacttgggaggctgtggtgggaggatcacttgagcccaggagtttgaggctgccgtgagctatgatcaggccactgcactccagccagggcgacagagtgagaccttgtctcaaaaaaaaaaaagaaaaaagaaagaaagaaggaaggaagggaaggaaaagaaaaaagaaagaaagaaggacggaagggaaggaaaagaaagaaagagagagagaaggaaggaaggaagaaaaggaaagaaagaaagaaggaaagaaaggaagaaagaaagaaagaaagaaagagacagaaagacattctgatactcaggctgagccattggaaagtatcttctacatttgctctgtgtgtgtgtgtgtgtgtgggtgtgtgtgtgaaaggagaaagaggaagaggaagacagaatttatgtatgtagatctgtctatgtgtctatatattggaaaaggtggttataatcatatatgcatctattttgcattactgcctttaaacctgtcttgcagctgtttattttgggggcttagttcttggggtcaccagattcatgagttcactctctgctatgtagaccagaacttcctcacagctcttcccaacaatctctttccagcatcaagagattatccctaagtctagatccataaaatcagaggagcaagatcatgttcatttctgattctttgagctcccttccctttcgaggttcattctcttatttgccccacaatgccttacctgaagtgagggtgaaaccgcctttgcaaaaattataacggagaaaattatgatggtgaaatagatctaacctcactccatctttcttctaacctccaagctgtccttgttcagtactgggcataggccatactaactttgggaggaacttgtttatagtttaactttgaaacaaagacaataacagccctttcccaaaacgaacccccttcctgcctgagggctagactgcctttgcaggactaacaaattagctataagattagaaattacggtttaccagccatgcagcctctggctgcaagattctgaaccttcccaaattgctcctgggaataacatcactgttgcaaaacctaaaatcagtgcttgaggtattttgcagaccctgcactctgatgcaccccctgacaccacccagtccagtaatctggctcaaccagttctgccatcccacccaggaacagaagacagtaagaaaactcactttgacccctatgatttcatctctaacccagacaatcagcattccccacttcccaagcccctacccgccaaattagccttaaaaacgctgatcccggattctctgatttgaataatgataaaactctggtctcttgtacagatggccctgcaggaattaaactttattgcaattcccctgtcttgttttttttttttttttttttcttttgagacagagtttcacaggctggagtgcaatgtcgtgatctcagctcactgtaacctctacctccccggttcaagctattctcctgcctcaccctcccaagtagtagggattacaagcatgcaccaccatgtccggctaattttgtatttttagtagagatgggttttcatcatgttggccaggctggtctcaaacttctgacctcaggtgatctgcctgccttggcttcccagaatgttatgattacaggcgtgagccacctggcctggccccgtcttgataaattggctttgtctaggcagtggacaaggagaactccactgggtggttgcaaatctggggagtcatccgggaccatccttgtggatacctgcctgacgtttgttagccctccaccagcgatggatctggaggcccgcccaagtggcaatttagttcttggactgggggctaactgtagcaccgtctctaccagcagggtgttgccaactcatggtgcatggattcaaatgcaataaacagtcctggggagatgtcccgctcctgtagccccatcatgggtgtctgatttggtgagtattctaggtgcttccaacaacctcatccttctgacctgctggcctctctgaagggggtgtctgctctaactggatcaagaataggggacttgtttggaggaacattcttggtttgtgatttggtctggagtctctgtctgcaagtccttctgcttgtctttttcacttgagtgtttgtgtatgtacaggaattgctgatggaagtccaacaggctctcctagtttgtctggtctgtcacatttgctgaaccctgaaggaactgttagcggaagcgcaacaggcgtgactcgtggtgattttccattgttctggaagctgcagggaaagggaacccagaaatctggtatgccagcaaagagagtaagaacttctgacaagccaggcttctggtctctctctctctgtctctctctcactctctctctctgtgaatggtaaacatcattgtttgtctcctctgcaagggtttgattaattgaaaaaaggatttataactgggcacagtggctgtaattccagcactttgggaggtcgaggtgggcagatcacctgaggtcgggaagttcaagaccagcctggccaacatggtgaagccccgtttctactaaaaatacaaaaattagccaggcgtggtggcgggtgcctgtaatcccagctactcaggagcctgaggcaggagaatcgcttgaacccaggaggcagaggttgcagtgatccgagatcatgccattgcactccagcctgtgcgacaagagtgagatgctatctcaaaaaaaaaaaaaaaaaaaaaagctcttcaagaatactggccttgcctggccagccgccccgtccgggaggtgaggggcgcctctgcccggccgcccctcctgggaagtgaggagcccctctgcccggccaccaccccgtctgggaggtgtacccaaccgctcattgagaacgggccatgatgacaatggcggttttgtggaatagaaaggcgggaaaggtggggaaaagattgagaaatcggatgattgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcacgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaaagaaaaaaagaaaactgggcttataccttgtatatgcagtctctgtacagggttcctgacttgtcataagtaaagaatgtcactttctgacaggcccagaagcccaaattatcttgggaccttgagaggaggaaaattctcccaactcatacaggtatttgcaggcatagataaatccatggctgggctaaaggctttaaaaagtataaggtgagattccttagggaatgaaatttcagcaaagctaattttgtttttatttatttatttatttttgggccatggccttgctctgtcatccaggctcaggcgattctcccacctcagcctcccaagtagctgagactacaggcacacgtcaccacacctggctaatttttgtagagacggggatctcgctatgttgcccaggctggtcttgaactcctgggctcaagtgtttctcccaccttggcctcccaaagtgctgggattacaggtgtaagccaccatgcctgaccagcaaagccaattttaaagagcctatatggcaaataattattcttgctgtacgttatacaaataatcaggccaagtataataagactaagacttatttcgcaattacatttgtcctactactatttgtttttaataaaaatggggactaaagagagaaaaactatgtttcaaaagctatagtacacccattgttagattctagtcttgtccactgttcttgagtttttgttattttctgcaatttggactaaatcctgaattctttgtggctgcagtgagctgtgatcacaccactgcactccagcctgcgtgacagagtgagaccctgtttcaaaaaaattaaaccagattttaaaaattgtgtgtcacagagataaccagtttttcttgttgactacacctttaactatggctgtcctgaagcttacctaactaatgctccaaactaatgttttccaaactaatgctttcacatttttcttccacttttctgacttggactcaataaaattgctactaccttttttcctgaggccctgtaagctgaagcttattcttttaatataggtggcaaaaacatgtcagattaccactgccttcctgctctataactaaaggtattttgagtttcacatctggataaattgtgcccaacattaacttttgtttttcttatatttccatagaaatgcctcgtattaaaaatctgtttgtcttcatcatgtatagaggcctagcccgtgtgcaatgccacctcctgatatgggaaacagctgtttaactgaactgatctagtcccaggactaggaaactgattaataatatatgggacagtgtatttaaacttgctccttcctggctgactataggtgcattgcctatgagttagccctgatccacaaggagcagtaccaaataaaataaagtaaaatagaatgaaattcactcactcttgtctatcccaatatgtttgtccaaaaacctttgacccaactctctctgctagtgacccatgtctgactgattcttggagctattcacctggatccctcagagcttaagatcaattctacaaaggcttcttcttcttttttttttttttccatagacaaagtctcactttattgcctagactagtcttgaactcctgggctcaagcaatcctcctgccttggtctcccaaagtgctgggattataggcatgaaccaccacgcctgtgtttgttgttgtttttttttttttgagacagagtttccctcttgttgcccaggctgtagtgcaatggtgtgatctcggctcaccgcaacctccgcctcctgggtcccagttcaagcagttctcctgcctcagcctcctgagtagctgggattacaggcatgtgccaccacacccagctaaattttgtattttagtagagatggggtttcaccatgttgaccaggctggtatcaaactcctgacctcgtgatccacccacctcagcctccaaaagtgctgggattacaggcgtgagccaccgtgcccggcttttttttttttttttttttttttggtggagtctcactctgtcacccaggctgcagtgcagtggcacaatctcggttcactgcaacctccaactccctggttcaagcgattctcctgcctcagcctcccaagtagttgggattataggcgcccgccaccacacccagctaatttttgtaaattttagtagagacggggtttcaccatattggccaagatggtctggatctcctgaccttgtgatcctcccgtctcggcctcccaaagtgttgggattacaggcgtgagccaccatgcccggccatgctctgctcttatgagctgggtggccctgaatattttatcctctctgagcttcactttcctcattttgaaatcagaatcagtaataataccttccacatgggctacagtcagggtgaaacaagcaactataaaagcactgagctcctggctaacacggtgaaatcccgtctctactaaaaatataaaaaattagctgggcatggtggtgggtgcctgtagtcccagctactcgggaggctgaggcagcatggcgtgaacccgggaggcggagcttgcagtgaggcaagagcgagactttgtctcaaaaaaaaaaaagcactgagtatgggttccagcacatgggaagctctctataatgtaggtgccaccatcatcttcttcatcatcgtcttcatctcacctggatcatcatcaagtacttgtagttctatgggaatctaatattaggtcatcctgactctagtttactgtgaagagtctataagctcctattattgaacctgcgtttgcagctaaagaaataaattgacatcttatggtggcagcgatggttcacacctgcaatcccagcattttgggatgccaaggcgggaggatcacttgaagtcaggagttcaagaccagcctggccaaaatggtgaaatccatctctactaaaaatacaaaaattagccaggcatggtggcttgcacctgtagtctcagctacttgggaggctgaggcaggagaatggcatgaacccgggaggcagaggttgcagtgagccaagatcatgccactgcactccagcctggacgacagagcgaaactccatctcaaaagaaaaaacagaaaaaaaaaaaaaaggaagaaatttacattttataactcaaagtagaaggaacacaatttagaaacctcctgcatggaagaattcataagaccaaaatattaaagggagaaaacattctataggatgacacccaatcgcaccgacaagcagagaaacaatgtgtgcaatggtgtcccgctacaaggcggggttccatgtcctcttaggtcctgtcactctaagtttaattttacaaaaatgggggctttgaaaatatcacatacttagtgggggaggttttgcgtgtgtggagacagagtgcacaggaccgtccgtactttctgctccattttgctgtgaatctaacactgccccaaaaaataaagttcattaaaaaaaatcacggccaggcgcggtggctcacgcctgtaatcccagcactttgggaggccgaggcagacggatcacaaggtcaggagtttgagaccagcctggccaacacagtgaaacctcgtctttactaaaaatacaaaaaattagctgggcgtggtggcgcacgcctgtagtcccagatactcaggaggctgaggcagaagaattgcttgaacctgggaggcggaggttgcagtgagctgagattgttccaccgttctccagcctgggtgacagagtgagactctgtctcaaaaaaaaaaaaaaaaaaaaaaaaaaaaaatcacatcctaaggtcccaaggacataaaacaagttagagacctcatccagttttttgtttgtttcagggacctgcaaccaactttcttactgaccagtttcctgggctgtctagaacagacagcttatggggtactaaccccatgctctatcctaaggtacccctcttcatgcagagcgacacagaaaaacaaatttgtagcacaaagtacacccgatttgctacagcttacgactagcctcatgaatcctttttctcattaattcaaagtttgcaaaaaaaagaaatcacatacttaaaaataaatcacttgagcacagaagcatatcaaaatctaatataaacaaacaaaaaacccaacttatgttaacatgccactgaaactgggctcaagttttcaaatgtcttatgaaatattacactctccagcaggctattttttttttcctaactggagatgaatggcagagttctgatatggaaaagcaatccatgtttgtacagaaaggtagcataggaaaagtggtcaaattcaaccagtctgtcctcatcaaacaggcaactactgtcttctcagcatttccaaaagaaatcatatgcctgctactgtttatgtcatatgcctgttaatttttcatgctaattcttagtgtttctggaaaacctcactgtttggcaccaaaaattgttattgctattgttgttgttttgttaattatgtcagccaagcagatgacggtgaattaattctgcaacgttgagtactcagttggcatacaagcacccagccttccaaagggatgtccttcatgtttcactgattttcgaatgacagtcggcttgcctaaacttatcctttacatttaagacatttcgtgggttcctgtatgcccaggggattcttattacttgtttatgcaaacagcaggttgcataagagccttgctggctttttttttttttttttttttttttagagatttcgtagtttcctggtaaccattcagtcatctatttcaacaccctgacatgacataaaggcaggcgtggaaccacacgttcaccacacagacacacacctccttgctggagcattcactaggcgaggcgctccatcggactcactagccgcactcatgaatcggcaccatctgcaggatcactttctggaaatagacaagaagaactgctgtgtgttccgagatgacttcattgtcaaggtgttgccgccggtgttggggctggagtttatcttcgggcttctgggcaatggccttgccctgtggattttctgtttccacctcaagtcctggaaatccagccggattttcctgttcaacctggcagtggctgactttctactgatcatctgcctgcccttcctgatggacaactatgtgaggcgttgggactggaagtttggggacatcccttgccggctgatgctcttcatgttggctatgaaccgccagggcagcatcatcttcctcacggtggtggcggtagacaggtatttccgggtggtccatccccaccacgccctgaacaagatctccaatcggacagcagccatcatctcttgccttctgtggggcatcactattggcctgacagtccacctcctgaagaagaagatgccgatccagaatggcggtgcaaatttgtgcagcagcttcagcatctgccataccttccagtggcacgaagccatgttcctcctggagttcttcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctctccttaaataaccatgccaagaagggacattgtcaccaagaaccaggatctctggagaaacagttgggctgttgcatcgagtaatgtcactggactcggcctaaggtttcctggaacttccagattcagagaatctgatttagggaaactgtggcagatgagtgggagactggttgcaaggtgtgaccgcaggaatcctggaggaacagagagtaaagcttctaggcatctgaaacttttgcttcatctctgacgctcgcaggactgaagatgggcaaattgtaggcgtttctgctgagcagagttggagccagagatctacttgtgacttgttggccttcttcccacatctgcctcagactggggggggctcagctcctggggtgatatctagcctgcttgtgagctctagcagggataaggagagctgagattggagggaattgtgttgctcctggagggagcccaggcatcattaaacaagccagtaggtcacctggcttccgtggaccaattcatctttcagacaagctttagcagaaatggactcagggaagagactcacacgctttggttaatatctgtgtttccggtgggtgtaataggggattagccccagaagggactgagctaaacagtgttattatgggaaaggaaatggcattgctgctttcaaccagcgactaatgcaatccattcctctcttgtttatagtaatctaagggttgggcagttaaaacggcttcaggatagaaagctgtttcccacctctgtttgcttttaacattaaaagggaaatgtgcctctgccccacagttagaggggtgcacgttcctcctggttccttcgcttgtgtttctgtacttaccaaaaatctaccatttcaataaattttgataggagacagtctggcgttgctatatctgggttatggttcacagaaatggacttcttacttaagcagagacctttatgggttgttaactatgtcctggtagaaaactactccacactgcaaagtaagaaagagacacagacactgagctacatcatgaaacaactaagcagaaattacacctgtgtctaaacaaagatagaaagagctgggattaaaaataatttggaaggatagtacagataggattgcaagagcacttacattttattagagtttggtgaatattgctcttcatatttgtgcattaaaaagggaatcaaggccaggtgcaatggttcatgcctgtaatcccagcactttgaggggaccgaggtgggcagatcaccctgaggtcaggagtttgagaccagcctggacaacatggcgaaaccccacttctactaaaaatacaagaaaaattagccaggcatggtggcggccgcttgtagtcccagctactgggaaggctgggggaagaagaattgcttgaacccgggaggcggaggttgcagtgagccgaggtggtgtgcctgcactccagcctgggggacagagcaagacttcatctcaaataataataataaataatataaaaagggaatcaagccaggcagatatttttccataggagggggaagagcgagcttcctatggaatggtttcagttcccaattcggagaaggaaaggagatgtactggtttgagtctgtgatcagtccaagtttctgttacgctttcatttctaactctgtcagtccttgattatttggcaagacgaggcttgcttcaacctcctgacatgaacacagataaggaatttagagacaggctcccagctctgggtgaatgacagtaaatgaagaaaggtggatgctctggaattacctctgtgctttcagagcagttggcttgtctgtatcaccaagcaatgtacaggtaaaaagccaaaagcaaggatcaccttaaagaggaagagatgtcagggatgagctcagaggaaaatagggattccccagcctcggaggcatgagtcagtggggagcctcgttgtgaaacgcggattcgttcaagggatgaggtggtttggggtgtttggacctccacagctcacattcattcactgattcaggcattccatcagtttttttttttttttttgagaccgagtctcactctgtcatctaggctggagtgcagtggtgtgatctgggttcactgcagcctctgcctcctgggttcaagtgattctcctgcctcagcccccccagtagctgggattacaggtgtgcaccaccatgcctggctaatttttgtatttttagtagaggtggggtctcgccatgttgcccaggctggtcttgaactcctgacctcaggtgatccacctgcctcagcctcccaaagtgctgggattacaggtgtgagccactgtgcccagcctcattccatcagttttatgtattaagcaccaactgtgtgccaggcgctgttctgggtggtggagatagaacaagaaacaaggcagccacagtcctcttctcatcgagctgacttttggagtggggaggcaggcaggaataaaaaggagccttggggtggctatgggtgtcatgactatggtggagtgggacaatggggataaaaagtaaccggggctggggtgactgggatggcttctatgaggcattgaccctgagctgagccatgaatgactaaacagaaaagcaatgcaaaagtctgggggaaagacacgccaagcagagggaatggtaagtgcaaaggccctgaggtgagaattaggttggtgactgcgtgttcatttcctgtggctgggtggcttggaacaatagaaatgtattctcccacagatctagaagctagaagtgcagaatcaaggtgttggcagggttggttccatctggaggctaagggaaaatgtttcatgcctcactccgagctttcggagactgctggcactcttggactttccttggcttgtagacgcttcactccaatctctgcccctgtcaccacatggtggtcccctctgtgtcctctcttcttacagacacctgtcttttcttctctttttttttggtctgtatttgagacagagtctcgctctgtcacccaggctggaatgcagtggcttcatctcggctcactgcaactctgcctcccgggctcaagcggttctccttcctcagcctctcacacagctgggattataggcatgcacccccacacctgtctaatttttctatttttagtagagacagggttttgccatgttggctaggctggtcttgaactcctgacctcaggtgatccacctgcctcagcctcccaaagtgttgggattacaggtgtgatccagcaggcctggccataaatatgcctgtctttataacccaccctaatccaggatgctctcatcttgagatctttaccttagttatacctacaaagacccttattccaaataaggttgtattctaaggtttggggtgaacatagctgttgggaaccagaactcaaccgactatagtgaggaacaatgtggccagcatgatgagcgtggggcctgccatatagtgaggttgtgatcctctttcagacaaaagtaatgaaagacttgagatgaagatcatactatatttaaatgaaaaagtttctaaacagaatatgatatccattttcttttaaaatatgtgtatctgtgtacttgtgtgtggaacaaccaactacaagaatatacaccaggccgggcacagtggctcacccctgtaacctcagcacttttggaggccaaagcgggtggatcatgtgagcccaggagttcaagaccagcctgggcaacatagcaagactccatctgtacaaaaaatgtaaatatttagccaggcatggtggcacacacatgcagtcctagctacttgggaggctgtggtgggaggatcacttgagcccaggagtttgaggctgccatgagctatgatcaggccactgcactccagccagggtgacagagtaagaacttgtctcaaaaaaaaaaaaaaaagaaagaaagagagagagagagagatgaaagaaagaaagaaagaaagaaagaaagaaagaaagaaagaaagaaagaaagaaaggaaggaagaaaagaaagtaagaaagaaaggaagaaaggaagaaaagaagaaaaaagcaagcaagcaagcaagcaagcaagcaagcaagagacactctgatactcaggctgagccattggaaagtatcttctacatttcctgtgtgtgtgtttgtgtgtgtgtgtgaaacgagagagaggaagaggaagacagaatttatgtatgtagatctgtctatgtgtctatatattggaaaaggtggttataatcatatatgcatctattttgcattactgcctttaaacctgtcttgcagctgtttattttgggggcttagttcttagggtcacaagattcatgagttcactctctgctatgtagaccagaacttcctcacagctcttcccaacaatctctttccagcatcaagagattatctctaagtctagatccataaagtcaggggagcaagatcatgttcatttctgattctttgagctcccttccctttcgaggttcattctcttatttgtcccacaatgccttacctgaagtgagtgcgaaatcgcctttgcaaaaattataactgagaaaattatgatggtgaaatagatctaacctcactccatctttcttctaacctccaagctgtcctcgttcagtactgggcataggccaaactaactttgggaggaacttgtttataggttaactttgaaacaaagacaataacagccctttcccaaaacgaacccccttcctgcctgagggctagactgcctttgcaggactaacaaattagctataagattagaaattacggtttactagccacgcaacctctggctgcaagattctgaaccttcccaaattgctcctgggaataacatcactgttgcaaaacctaaaatcagtgcttgaggtattttgcagaccctgcactctgatgcaccccctgacaccacccagtccagtaatctggctcaaccagttctgccatcccacccaggaacagaagacagtaagaaaattcactttgacccctatgatttcatttctaacccagccaaccagcattccccacttcccaagcccctacccgccaaattagccttaaaaacgctgatcccggattctctgatttgaataatgataaaactctggtctcttgtacagatggccctgcaggaattaaactttattgcaattcccctgtcttgtttttttttttttttcttttgagacagagtttcacaggctggagtgcaatgtcgtgatctcagctcactgcaacctctacctccccggttcaagctattctcctgcctcaccctcccaagtagtagggattacaagcatgcaccaccatgtccggctaattttgtatttttagtagagacgggtgttcatcatgttggccaggctggtctcaaacttctgacctcaggtgatctgcctgccttggcttcccaaaatgttatgattacaggtgtgagccatcggcccggccccctgtcttgataaattggctttgtctaggcagtggacaaggagaactccactgggtggttgcaaatctggggagtcatccgggaccatccttgtggatacctgcctgacgtttgttagccctccaccagcgatggatctggaggcccgcccaagtggcaatttagttcttggactgggggctaactgtagcaccgtctctaccagcagggtgttgccaactcatggtgcatggattcaaatgcaataaacagtcctggggagatgtcccgctcctgtagccccatcatgggtgtctgatttggtgagtattctaggtgcttccaacaacctcatccttctgacctgctggcctctctgaagggggtgtctgctctaactggatcaagaataggggacttgtttggaggaacattcttggtttgtgatttggtctggagtctctgtctgcaagtccttctgcttgtctttttcacttgagtgtttgtgtatgtacaggaattgctgatggaagtccaacaggctctcctagtttgtctggtctgtcacatttgctgaaccctgaaggaactgttagcggaagcgcaacaggcctgactcgtggtgattttccattgttctggaagctgcagggaaagggaacccagaaatctggtatgccagcaaagagagtaagaacttctgacaagccaggcttctggtctctctctctctgtctctctctcactctctctctctgtgaatggtaaacatcattgtttgtctcctctgcaagggtttgattaattgaaaaaaggatttataactgggcacagtggctcatgcctgtaattccagcactttgggaggtcgaggtgggcagatcacctgaggtcgggaagttcaagaccagcctggccaacatgttgaagccccatttctgctaaaaatacaaaagttagccaggcgtggtggcagctgcctgtaatcccagctactcaggagcctgaggcaggagaatcgcttgaacccaggaggcagaggttgcagtgatccgagatcatgccattgcactccagcctgggcgacaagagtaagactccatctcaaaaaaaaaaaaagctcttcaagaaaactggccgtataccttgtatatgcagtctctatacagggttcctgacttgtcgtaagtaaagaatgtcactttctgacaggcccagaagcccaaattatcttgggaccttgagaggaggaaaattctcccaactcatacaggtatttgcaggcatagataaatccatggctgggctaaaggctttaaaaagtataaggtgagattccttagggaatgaaatttcagcaaagctaattttgtttttatttatttatttatttttgggccacggccttgctctgtcatccgggctcaggtgattctcccacctcagcctcccaagtagctgggactacaggcacgcgtcaccacacctggctaatttttgtagagacggggatctcgctatgttgcccaggctggtcttgaactcctgggctcaagtgtttctcccaccttggcctcccaaagtgctgggattgcaggtgtaagccaccatgcctgaccagcaaagccaattttaaagagcctatatggcaaataattattcttgctgtacgttatacaaataatcaggccaagtataataagactaagacttattttgcaattacatgtgtcctactactatttgtttttaataaaaatggggactaaagagagaaaaactatgtttcaaaagctatagtacacccattgttagattctagtccactgttcttgagtttttgttattttctgcaatttggactaaatcctgaattctttgtggctgcagtgagctgtgatcacaccactgcactccagcctgcgtgacagagtgagaccctgtttcaaaaaaattaaactaaattttaaaaattgttgtgtgtcacagagataaccagtttttcttgttgactgcacctttaactatggctgtcctgaagctaatgaactaatgctccaaactaatgttttccaaactaatgctttcacatttttcttccacttttctgacttggactcaataaaattgctactaccttttttcctgagaccctgtaagctgaagtttattcttttaatataggaggcaaaaacatgtcagattacgactgccttcctgctctataactaaaggtattttgagtttcacatctggataaattgtgcccaacattaacttttgtttttcctgtatttcctccattttaatacaagaaatgcctcgtattaaaaatctgtttgtcttcatcacatatagaggcctagcccatgtgcaatgccacttcctgatatgggaaacagctgtttaactgaactgatctagtcccaggactaggaaactgactaataatatatgggacagtgtatttaaatttgctccttcctggctgactataggtgcattgccaatgagttagtcctgatccacaaggagcagtaccaaataaaataaagtaaaataaaatgaaattcactcattcttgtctatcccgatatgtttgtccaacaacctctgacccaactctctctgctaatgacccatgtctgattggttcttggagctattcacctggatccctcagagcttaagatcaattctacaaaggcttcttttttttttttcttcttttttttcatagacaaagtctcactttattgcctagactagtcttgaactcctgggctcaagcaatcctcctgccttggtctcccaaagtgctgggattacaggcatgaaccaccacgcccgggctctacaaaggcttctgaagctaggactttcactccttaacctaggactcattatataccttatagttaactactcatttaaacactatgttaaaactctaggtaagaatactaacaccttactcctgcaagcctcaaaaccccaaccaggcaccatgagtccaggcagacagctgcaaagcaattccactcctcttaccttggggtcaacacccgccctaactacactcctgtcaggaaaaaggagctaaagcagtctttgccctttttccatctcacagctcacacctgaagaataaggttgttacagtccaggtgcagtggctcacacctgtaatcccagcactttgggaggccgaggcgggtggatcatgaggtcaggagatcaagaccatcctggccaacatggtgaaaaccagtctctactaaaaatacacaaattagccgggcgtggtggcacatgcctgtaatcccagctactcgggaggctgaggcaggagaaacgcttgaaccaggaattggaggttgcggtgagctgagcttgtgccactgcacttcagcctggcagcagagcgagactctgtctaaaaaaaaaaaaagggaataaggttgttatgaaacccaaagtgagggattgaaacaacctttgcaaaaattataactgagaaaattatgatagtgaaacagatctgacctgactgactccatcttgcttctgaactccaagctgtccttgttccttgctggggcataggccgaactcactttgggaggaaattgtttaactttgaaacaaaagacattaacagccctttcccaaaacaaacccccttcctgccgggggactagactgccttagcaggactaacacattggacagattagcaattatggtttaagagtcatgcagcctctggctgcaagattccgaacctcctcaaactgctcctgaggataatgtcactattgttagatgtaagatcagtgcttgagatattttgcagaccctgtactcgatggatcagctggcaccacccggatcgataaactggctcatctggtcttgtggccctcacccaggaactgattcaggacaagaggacatctttgactccctgtgatttcatctccaacctgaccaatcagcactccccactttctgaaccgctatcggccaagttatccttaaaaacccagatccaggccgggcacagtggttcatgcctgtaatcccagcactttgggaggccgaggcgggtggatcacctgaggtgagaagttcgagaccagcctggccaacatagcgaaactccatctctacaaaaatacaaaaattagccaggcgtggtggcacaagcctgtagtccaaactacttgggaggctaaggtaggagaatcacttgaacctgggaggcagaggttccagtgagctgagattgtgccactgcactccagcttaggcgacaaagcaaggctctatctcaaaaaaaaaccaaaaaacaaaacagatccagctgggcacagtggctcatgtctataattccagcactttgggaggccaagacaggcagattgcttgagtccaggagtttgagaccagcctggaaacatggcaaaaccccgtctctacaaaaatgcaaaaattagctaggcacagtggtgtgcacctgtagtcccagctactcaggaggttgaggtgggaggatcacttgagcccaggaagtcaaggttgcagtgagctgtgaacatgccactgcactccagcctgggtgacagaaaccttgtctcaaatcctcccctctagtccttgagtttttgaggagactgatttgagtaataataaaatgtcagtctcccatacagctagctctgcatgaattaaactttctctattgcaattcccttgtcttcacaaatcagctctaggtagtgggcaaggagacctattgggtggttatagaaggatctaaatggtatcccatattcaggcacagacacattgcagatccttcaaatgacgtttggtttcattttcaaaatgcttcctgattacaatctatcgatccgctggccttgctgctaactataacagttttctctgcagatggtctgtcagccacctgaccccttccccactttacttctgtaatcagagattgagctgaggaattgatcatctgaggagccttggacaggggtggtgtttggtggagccatcaataactagaaattgaccatttaccagccaagggctatgggttgccgtctgcacacccatcttttggttcagattggcaatgtcttcaaattggaactgaaattctgatgaaattctttttttttttttttttttttttttttgagatggagtctcgctctgccacccaggctggagtgcagtggcgtggtcttggctcactgccagctccatctcccaggttcacaccattctcctgcctcagtctcccgagtagcttggactacatgcgcccggctaattttttgtatttttagtagagacggggtttcaccttgttagccaggattgtctcaatctcctgacctcgtgatccacctgcctcggcctccctaagagctgggattacaggcgtgagccaccgcgccgggcatttctgatgaaattctttgttgactgaggctggggctgtttgtgttactgacaaacttcctgagaaggaaattccacttttttccctcattatagtgacacgatgtcttagtatggttgcttaactcaaggtcctgagggatgcaagtacttgaaacatacttcagatgagcttgagcaaaaaataacaagcagaaagaggaaggaactggagagggggcagcatttcttatggaaaaggaggattaagccaggcttgggcttaaggaccagaacccagcccttcccccagctcctaaccatgaatgagtctcaagctctgaatgcctgcgcctcccagattctcacctgagagaacccattgatccatatcactttcattagaaggatcatgaaggcgatagtcgcgctgcagctgcttaaagggttttttttattttttttttgagatggagtcttggtctgtcacccaggctggaggccagtggcacaattttagctcactgcaacctctgcctccggggttcaagcaattctcctgcttcagcctcctgagtagctgggactatgggtgcccaccaccacgcctagctaattttcgtatttttagtacagatggagttttgccatgttggccaggctggtctcgaactcctgacctcaggtgatctgcctgcctcagcctcccaaagtgattacagccatgagccactgtgcccggccataaagggattacaggcatgagccactgtgcccggccataaaggatattttatttgtcgtttgttttcatgctattattgggagccacaggcaaagggacctcctccctaacaacagaggggctcacagtttctgcagccactccaagcttgggcccagggggtcctggggtggctgggcaggtgtgaatgtccctatccttttgcaggagcactgggtggctgtggggtggggcctggtgaaccatgatgacaggggggtgcaggagtaggtccacaaaaccacaggaggccccagaaggtgcagggcacgggtggcttggctccttggtctgggcattcctagaaaggcagagtctcaaggccatcttggccttggtggccacgccaagggtatttttttcacctactatttgtgcgaagacgtgctatctgtcaggtgctccttggataatgttttagatcaccctctatttcacgagcacatttgggctttcagtggagcctatctcagttcttttgctttcaaaattactggtggctcatatgtgtaatcccagcactttgggaggctgaggcaggaggatcacttgaggccaggagttcggcactttttttttttcttcttgagatgcagttttactctgacacccaggctggagtgcagtagcatgatcttagctcactgtaacctccgcctcccaggctcaagcgatcctctcaccacagcctcccaagtagctgggactacaggtgcataccactgtgctaggctaatttttgtattttttatagaaacgggattctgctttgctgcccaggctggtcttgaactcctgggctcaaaagatctgactgccttggcttcccaaagttctgagattacaggcatgagccactgagtctggcccggagtttgggagtagcttgggcaacagaacaagatccctccactaccaaaaaaaaaaaaaaattagccaagcgtggtgggaggcacctgtggttccagctgcttgggatgctgaggtgggaggattgcttgagcctgggaggttgaggcttcagtgagctgtgatcaagccaccgcactttagcctgggtgacagagccagaccctgtctcaaaaattaaaataaataaataaataaataatctgccatgctacaaaactgtggtctccaaagaacagagaggcaatcaatcaactttcaggaaacgatggggttcactctgcctcaggcccattcatctgtggacctccaaatgtgtgttctggagccctttggaaggccttcctggagaattaaagtctctgttactttatttatttgtttatttatttatttttgagatggagtcttcctctgtcgccaggctggagtgcagtggcgcgatctctactcactgcaccttccgcctcctgggttcaaatgattctcctgcctcagtctactgagtagctggtactacaggcacgcgccaccatgcccagctaatttttgtattttttagtagagatggggtttcaccatgttggccaggatggtctcgatctcttgacctcgtgatccaatcaccttggcctcccatagtgctgggatttacaggtgtgagccaccgcgcccagccctctgttacttatatattgcttaataagctcagggcaaaggaatactccttgggaggcttggttgaagctcataccgggccatgaagttctgttcactgtttcttgtcttctgtgagacaaaagagacaggggtattttgcaaccagtgctggattctctttgggctcaaatttaacatttggctaccctctgtgtcttcagggacaaggagtttgtgtgtggcatttcaaacatcagggcctggcctatagtccacaatcccacggccctgtcccatgaaagccaagtgcttctgagctgttaacaaatattgatacacctggagctctggccacacctagacaaggatttacatctatcaacaggtgctaggaacagtacaggatgttctcaatgcaactccgaaaagaagagaaagtgaactgaccaactgatgtcctcaggttgaaaaagttggtttcttttcagcatgctaacaaaatacatcataggctgtgcacagtggctcacgcctataatcccagcactctgggaggccaaggcaggtgaattacgtgaggtcaggagtgcaagaccagcctgaccaacatggtaaaaccccgtctatactaaaaaaattcaaacttagccgggtgtggtggcacatgcttgtaatcccagctactcaggaggctgaagcggtagaattgcttgaacccaggaggcagaggttgcagtgagccaagatcgtgccactgcactccaggctgggcaacaagggcaaaactccatctcaaaaaaaaaaaaaaaattaaagttaaaaaaaaaagttatatgatgctggagtacgaaaatgatattgcctggtttggattttggtaaagcaacatgaatgcaaagatgtacacacggttggagagaggctgtattcaacatgatcatcatttgatcaccatcaattattattatatattttttaatgtttaatttcatttcattgattttgttgttgttgttgttattgtatgtttttttttttagagatgggatctcactgtgttgcccaggctggtctcaaactcctgggctcaagcaatcctcctgccttggccgctcaaagtgctgggattacaggtgtgagccactgcacccagcgatcatcaattattatatctaagatttgcactatggtgtgtaagacacagctctaagtgttttacatagatgatctcatttaatcatttcaataacattatgggctaggtgctatttctgacttcacagataagggaattgaagcccagaaagtttgagtaacttgtccaagttcatacaactggtaagtgatgaactgaacccggtgaataaatgcaggcagtctgactccagtctttgcttttaaagttctgagaacatgcaaagtgagagatatgcaacttgaactggaaaaagtagagcaaataccttgacctgcttggagtcagtatttccagaacttcccaggatgtcctaggctgtaccaggctgtaccaggctgttcattaggccctcaggcccctcccaagccgaggctgtgatcatatacttaagccgcctggcacgaagcctagagttgagtggatgtcctgcaaatgctgtttcccttctccaaatctcgctgcaggttggcccttttcttccttgttaaacgttcttctctttctaaagaaggtacaacttcataaggaggcaggtcaaagatagtcactgtggctgggtgcagtggctcatgcctgtaatcccagcactttgggaggccgaggtgggtggatcacctgaggtcaggaattcaagaccagacagcctggccaacatggcgaaaccccctctctactaaaaatacaaaaattagctgggcgtggtggcaccgcctataatcccagctgctcaggaggctgaggcaggagactcacttgaatccaggaggtggaggctgcagtgagccgagatgtgtcactacactccagcctgggtgacaagagcaaaactccgaagaaagaaagagagagagagagagagagaacattgttatagtaaaaaaacaagaaacaacctaaatatccattagtaggggaacagattcagttgctcaatggaatacactatagcagtgaagaaaaatgaaccacagttacttgtatcaacagtactaaaacttgagcataacatctagagcaaaaagcaagttgctggaagatacatacaatctggtaacatctctataaatacttaaaacttgtgaaacaaagccatacattgtttccggaaacatcaatatgtaataacacatacaaatcatgggtaagaagaatgtttactaacttcaagatagaaattaattctgcagaggaatcccagggagcgaaatggaatggagggaggcttcagctgtatctataacactttcactttagtttttgtttttgtttgtttgtttgtttgttttgagacagggtctggctctgtcaccgaggctggactgcagtggcaagatcacagctcacttcagcctcaatctcccaggctcaggccatcctcccacctcagcctcccgagtagctgggactacaggtgcacaccaccaagcctggcaaattttgtagatttttagtagagaaggggttttgccatgttgcccacactggtctggaactcctgggctcaagcaatccacaaaggcaggcagatcacttgtaagtgagcaattgcacacagcatcgcttagttttaaaagaagattctgcaaatgtccttcagtgggtgaatagttaaactagtacgttcataccatgggatcctatttagcaataaaaaagaaataaatgattgatacgggcaacaacttggatggattttctttttttttttttttgagatggagtcttgctcttgtcatccaggctggagggcaatggcacaatctcagctcactactaactctgcctcccgggctcaagtgattctccttcctcagcctccagagtaactgggattacaggcatccaccaccatgcccggctatttttctgtatttttagtagacagggtttcaccacattggccaggctggttgcgaacttctgacccgggtgatctgcccgtctaacccttccaaagtgctgggattacaccaccatgcccggccatacttggatggatcttaaagcattaaattatgctgagtggatgccaggtgtggtggctcacgcctgtaatcccagtactttgggaggctgaggcaggcggatcaccaaaggtcaggagtttgagaccagcctgtccaacatagtgaaaccccatctctactaaaaataccaaaaaaattagctgggtggggtggcaggtgcctgtaatcccagccacttgggaggcagaggcaggagaatcgcttgaacctgggaggcagaggttgcagtgatctgatattgcaccactgccttctagcctgggtgacagagtgagatcttgtctcaaaaaataaataaataaataaataaataaataaataaataaataaataaaaataaaaattatgctgagtgggggaagaaaaacaggctttttttttttttttttttttttgagacaaggtctcactctgtcacccaggctggagtgcagtggcaccatcatagcatttttgtagagatggggtttcgccatattgcccaggctggaaaaaaggtcaatttcaagaagttatatactatataattgtacttacataatattcttagaaagataaaattacagagatgaagaagaaccccagcatctcagaatgtgactgtatttggaggcagggactttaaaggggaactgaattaaactgaggtcattagggtgggccctaatccagaatggctgatgtccttatgagaagagagggtcaggacacagacacacccagagggatgaccaagtgaggacacagggagaagacggccatctacaagccaaggagagaggcctcagaagaaaccacgctgccaacaacttattgcagacttggagccttcagaactgtgggaaactccgtttctgtggattaagcccctcagtctgtagaactgtgctatggcctgggctggctcttacagcatctcaccatctttcttaaatgcatccatcagccagaggtttcagagctcagttggaacaccctatgtgtttatttaaaaaccacttatcgcctataaatttgaatagaattttacataaagcctgctgtgctgcacagcagagaaattcaactttagaataaagtagaataacattaaggacagataaggacagatggacttttaataggcaaacattgcccaaccgctgcttctctctccactgaccttttgtttaatgatgggaacaaatcacaaaatccactaaaaaaaaaatctttttggccaggcgagatggctcatgctcgtaatcccagcattttgggaggccaaggcaggaggatcccttgagctcaggcatttgaaaccagcctgagcaatatagtgagatcttgtctcttctgaaaataaaacaaaattagctgggcatagtggtgcacatctgtggtcccaactacttgaggggttgagatgggaggatcgcttgaggtgatggtggggaggtaggtcaaggctgcagttagctatgattgcactccagcctgggtgacagtgagaccctgtctcaatgaaatgaaatgaaataaaataattaaaaaatttaaaaagtgaatgagataaaaaaaaaaaatcgcactggtctctagggttcccatagaggctgaacactgatattttagtcaagatttcaggccaggctcacgcctgtaatctcgacactttgagagactgaggtgggaggattgcttgagcccaggaggtcaaggatacagtgagctatgattgcaccactgcactccggcctgggagacagagtgagaccctatctcccctgcaaaaaaaagttgaactttttttaaaaattattttttattttgccttgctgttcgtgagctgtatcaaaaaaaattttttttttcttttgagacagagtcttgctctgtcaccagcctggagtgcagtggtgccatcttggttggctcactgcatcccaggttcaagcgattctcctgcctcagcctcccgagtagctgggattacaggtatgcgccaccacacccagctaattttgtatttttagtagaaatcgggtttatccatgttggtcaggctggtctcgaactcctgacctcaggtaatctgcccacctcggcctcccaaaatcctgggattacaggcgtgagacactgcacccggccataatttttgtgtttttagtagagatacctggggtttcatcacgttagccaggatggtcttgatctcttgatctcgtgatctgctcgcctcggcctcccaaagtgctgggattacaggcgtgagccaccgcgcccagccaaaaaacattttttttagacggagtcttgctttgtcacccaggctggagtgcagtggcatgatcccggctcactgcaacctccgcctcctaggttcaagtgattctcctgcttcagcctcccgagtagctgggattacaggcactggtctcaaactcctgacctcaagtgatccacctgcctcggcttcccaaagtgctgggattacaggtgtgagccactgtgcccagcctgtatcaaaaaatttttaaacaaaactgcaaaaattattgtagccaacccagaaaaaaactctcctcaatattatctgttattatgtctaataaagaatattcacataaagctcctaagaattatctttctttgctttttttattttttctaagagatgggatctcccggtattgcccaggctggtctcatgctcctggcttcaagtgatcctccctgtcctgggctcccaaagttctgggattacaggcatgagctaccatgcccagctccatctttctaaaacaaaaactgaattatgtttcttttctgcctcaaaacccttcaatcatcaacgacaacaaaaagttcaaaccccccagcatggctttcactcccaggctacatgaccattcactctctggctggcagaggtgaagaaaaatggcctttggaatcagatgtctctgggttgaaattttagcttgaccactctttgggtgggttctgagaacccaaagaaagtgagagaggcctatgactatttcagctcttggaacttctggtattttttttccattgagatattaattcacctactataaaattcctccttaagcaaaattggggctgggcatggtggctcacgcctgtaatcccagcactttgggagactgaggcaggtggatcgcttgaggtcaggatttcaagaccagcctggccaacatggcgaaactctgtctctactaaaaatacaaaaattagccaggagtggtggtgcacgcctgtaatcccagccacgtaggaagctgagcacaagaattgcttgaacccaggaggcagaggttgcagtgagccaagattgcaccactgcactccagcctgggtgacagagtgagactctgtctcaaaatgaaaaacaaaacaaaacaaaacaaaacaaaacaaaacaaaaggtcatgtttgcctgtagaatactttcttacatgcaggagactttctcttagacacacgcctggaggcgtctgagagggacaggctgggctcaccaattcgaacttctgccaatgccctgcatgtctctctcactaagagctaagccaagacttcccctgtcatcaccactgcctgtggtcagtcctctattaccaacagagggaaacagaatgcaattgaggagaaccaactaattgcgaaagcaaagcctgagaaaccccatgagtgatggatccaccaattctggtggccacagggaggtccctggtgtctggctgcatgctggccatggtgaccaggtgtccttgggcaggagatggcttcaaatgcagaccggagtcctagcgatccaagtggttctttgagaaaccaaaacaccacaaagctccccctggactgtaccattgagctctcaatcacaattcagccgaggacattgtcttagtccaccagggctgccatgacacggtaccatgggctgcatggcttacaaacaacagttcatttcccacggttgtggaggctggaagtccaagatcaaggcggcagcagattcagcgtccgaggaggatggtgaggacctgccacctgatgcatagatttcctctctgtgtccccacacagcacaagggagaagggagctctctgggggcctctttgattagggcatgactcccattcctaagggctgcaccctgatgacccgatcgcctctcaaagtccctgcctcctaatcctatcatttaaggggttaggatttcaaatttgggaggaagaggggacagattcagaccatagcagacaactactaaaagcaaatactacacttcatcttagccaagaggccaagaagcaatacattcacttttttttttttgaaacagggtcatgctctgtcacccaggctggagtgcagtggtgcaatcacggctcattgcagcctctgcctcccgggctcaagtgattctcctgcctcagcctcctgagtagctgggattacaggcacacgccaccacgcctgactaatttttgtaattttgttgagacagcctcctgagtagctgggattacaggcacacgccaccatgcccaactaatttttgtaattttgttgagacagggtctcgctatgttgcccagtctggtctcaaactcctaggcttaagcaatcttcccacctcagcctcccaaagtgctgggattaccggtgtgagccactgtgcccagccaaattcactcttttaaagtatactattcactcatttttattatatccacaagcttgtacaatcaccacgactatctaatttcagaactttttcatcaccccaaaaagaaacgctgtgcccactggcaatcattcattccccattcatcccttccctgcccccagcaaacaccagtagatctatctctggaatcatgatttatttttttaaatgaagaaatgccacaaaaggattagaaaaattatggaagtggggccaggtgtggtggctcacgcctgtaatcccagcactttgggaggccgaggcaggcggatcacaaggtcaggagatcgagaccatcctggctaacacagtgaaaccccgtctctactaaaaatacaaaaaattagccgggtgtggtggcagatgcctgtagtcccagctactcgggaggctgaagcaggagaatggcgtgaacccgggaggtggagcttgcagtgagccgagattggtgccactgcactccagcctgggcgacagagcgagactctgtctcaaaaaaaaaaaaaaaaaaaaaaaaaatacagaaggggaatttagaggggagggaaaaaagcctgaaacaagacttccttccccaactggttttagcctgcttgttcttccagagttggttcccacagtgtaaatgcagccttggtttctgttggggcctggcaagaaaattcacatggggctttgtctcctatgtgctaggcaggagaccatgaaacatcacttagcctagatatgaaggccaatttggtagtttcaaatatatcaataatttctttgaaactcctctcttcaaaagacagagtctgatttccttcccccttgaatgcaggccagacttagtgactttcttttaatgagtagaatgtggtggaagtgatgttatgtgcctttaaaagctgggcataaaaggggtaggggaccagacactggggctcacgcctggaatcccagcactttgggaggccaaggtgggaggatcacttgagcccagaagttcaagaccagcctggcccacacagggagaccctgcctctatgaaaagtaaaaattaaaaaattagccgggcgtggtggtgagtgcctgtggtcccagctactcaggaggctgaggtgggaggatcgcttgagcccaggagttcaaggctacagtgagtcatgatcataccattgtactccagcctgggtgacagagtgagaccctgtttcaaaaaaaaagatactggcttctctgtctctctctctctgttttggcccgccatgctgggcggaagcccagatctcatggggagaccccgtggggctgctctggttgagactttgaactaggccctcagctgagagcagtgggcaagcttcacagacgtgtggcctggtatcaggcacagagccgtgtgctaagaagagcccctggcccttttaaatactctgccatcaccattttgaaattcttcataatctgtaaacagctttattgagatataacgcatatgttataaaattcacccattgcaagtgaaccattcaatggtttgcagcatattcacagaattgtgcaaacatcactacattccatttccattactaatcactctccatctctacccccaatacattctttatcgtttctcaaccagaaccctgtgtttcactgttcactgaaaaccacaaattatgaagccatcctgacagctgacctgtacatgactgtgccttcagatggtcccagccccagcctttgggactccagctgaggtcccagatatgtatagcagagacctgaattcctgactcctagaaaccatcagagatggcttaggctattacatcttgagctaatttgttatgtaccaatagataagtaaagcaagcaaaaaaccatggggccgggtgcagtggctcatacctgtaatcccagctctttcagaggccaagtcaagaagatcccttgagcccagaagttctaatctagactagcctgggcaacacagggagatctcatctctacaaagaaacaaaaataaaattagccaggcacggtggcacacggctgtagtcccagctacttgggaggctgaggcaggaggattgcttgagctcaggattttgaggctgcagtgagctgtgatcacaccaattcagcctggtgacagagtgagacctcgactctaaaaaaaagaaaaagaaaaggcacaccaggctgagcacggtggctcacgcctgtaatcccaacactttggggggccaaggtgggcagctcactggaggccaggagttttgagaccagcctggaccacatagcgaaatcctgcctctactaaaaatacaaaaaaaaaaaaaaaaaattagctgtgcatggtggcatgagcctgtaatcccagctaccctggaggctgaggcatgagaattgcttgagcctgggaggggaggttgcagagagcggagattgtgccactgcactccagcctgggcaacacagcaagactctgaaaataaaaaaagaaaaggaaggaaggaaggaaggaaggaagggagggagggagggagggatcaagggaggaaggaagggaaaggcacaccagatatcaagactagccacccagaaatattttactcccattaatcaaaaccttgcagaagcgataaacagtgagttttaccattcacccaatgatactgcacagagagagaggctgggaccctaactggtaagaaattcttacctttttgccagctgatctggttcctgggttcccttttctgtggcttccggaagagcagagcagctttggtgaccctgctcgccacaccaaaatgtaggtcctctgaaaagtcaactcacaaaaggcaaattaataggaaaaaaggcatataaatttatttagcgtatagatagagaagccttttgaacaaagaccaaaagacacaggggaaattgtctatttttatgcttacatttaacaaactatggacagctgtgtagaaatataactggacaaaaagagtatgacctaggtcgggcgtggtggctcacgcctgtaatcccagcactttgggaggcagaggtgggcggatcacctgaggtcaggagttcgagaccagcctggccaacatggtgaaactctgtgtctaacaaaaatacaaaaattagccggtcatggtggtgcacacctgtaatcccagctactcaggaggctgaggcagcagaatctcttgaacccgggaggtggaggttgcagtgagcagaggttacgccactgcactccagactgggcaacagagcaagactccgtctaaaaaaaaaatcacctaacgtggctggactcagtagcaatcagtgtaaagagatggcaaggcctgtccacctggattcttcttggcctctctgaacagcattccttccttcagggtatggggcaggacctgctgtggaatgggggtcttatgagctacagtgaaacaaggtgggccatttttcaatggccagttttgatacagaaagatggaggggaaattagaatcatatttttaggttttatggctggcgttgggaaagaggaattctagtttctacggctggcctcgggggaaaagcgggacttccaggcaggaggacacgggagagtcagggaaaagcttttgcttctgaggctgcagatcaaggcttcattttgaggtactgttttctgagccccaggggaattctaccagcttctactgagaggtgacagcgtgctggcagtcctcacagcccttgctcgctctcggcgcctcctctgcctgggctccctctttggccgcacttgaggagcccttcagcccgccgctgcactgtgggagcccctttctgggctggccaaggccggagcccactccctcagcttgcggggaggtgtggagggaggggcgcgggcgggaaccggggctgcgcgcggtgcttgcgggccagcgcgagttccaggtgggcgtgggctcagcgggcccccgcactcggagcggccggtcggccgctcaggccccgggcagtgagggccttagcacctgggccagcagctgctgtgctcaatttctcgccgggccttagctgccttcctgcggggcagggctggggacctgcagcccgtcatgcctgagcctcccccaaccccctccgtgggctcctgcgtggcccgagcctccctgaggagcacggccccctgctccatggcgcccagtcccactgaccacccaagggctgaggagtgcaggcgcacagcacggactggcaggcagctccacctgcggctccagggcaggatccactgggtgaagccagctgggctcctgagtctggtggggacttggagaacctttatgtctagctaagggattgtaaatacaccaatcggcactctgtatctagctcaaggtttgtaaacacaccagtcagcaccctgtgtctagctcatggtttgtgaatgcaccaatggacactctctatctagctactctgggcggggacttggagaacctttgtgtggacactctgtatctagctactccggtggggatgtggagaacctttgtgtctagctcagggattgtaaacgcaccaatcagcaccctgtcaaaacagaccactcggctctctgtaaaatggaccaatcagtaggatgtgggtggggccagataagagaataaaagcaggctgccagcggaagcaaaggcaacccgctagggtcctcttccaccttgtggaagctttgttcttttgctctttgcaataaatgttgctactgctcactctttgggtccacactgcctatataagctgtaacactcaccacgaaggtctgcagtttcactcctgaagccagagagaccacgagcccaccgggaggaacgaacaactccagacatgcaccttaagagctgtaacaccacgaaggtctgctgcttcactcctgagccagcgagaccacgaacccaccagaaggaagaaactccaaagacatccgaacatcagaaggaacaaactccgcacacgctgcctttaagaactgtaacactcaccgcgagggtccgcggcttcattcttgaagtcagtaagaccaagaacccaccaattccggacacactatgtcccaagcccatggcagcagaggctgttccacctacttctacctggggatttacccatgtaggaaagcatcaacaaccggatttgactgaccgagtgactgaccaagaggattaacgacccactgaaggggccccagcacccagacacaggagcccacagagaaatgagaacccacagtgctgaagcagacaggggcatctctgaattaaaaacagtaataaacaagagaccttcaggaaatccaaatacagcataggaatgacctttcatgctgggcacagtggctcatgcctgtaatcccaacactttgggaggccgaggcgggcagatcacctgaggtcaagaccagcctggccaacatggtgacacccagtctctactaaaaatacaaaaattagctgggcatggtggcgcatgcctgtaatcccagctacctgggaggctgaggcaagagaatagcttgaacccgggaggcggaggttgcagcaagctgagattgcaccattgcactccagcctgggctgtaagagtgaaactccgtctcaaaaaaaaaagaaaagaaaaaaaagaaagaaatgaccttttagagctaaaatacatgattattttagctctaagaaattccattaagaattaaaagccagtagggcctcaactgagactcaaattagtctgggagataaagtacaagaaagatctcaaaacagagcaacattacaaagagatggagatcttgtgagaaaatataagagtgggaggataggccgggcgcagtggctcacacttgtaatcccagcactttgggaggccgaggcgggcggatcacgaggtcaggagtttgagaccacggtgaaaccccgtctctactaaaaaatacagaacattagccgggcgtggtggggggcgcctgtagtcccagctacttggagaggctgaggcaggagaatggcgtgaacccgggaggcagagcttgcagtgagctgagatcgagccactgcactccagcctgggtgacagaacaagactccgtctcaaaaaaaaaaaaaaaaaaaaaaaaaaaaaagggtgggaggatatccttcctcccgaagaactaatatgtacataataggagttctaaaatgagaagatgcaacagataaatcacagaagtaaagttcctcaaaactaataaagacctgagactgcagattaaaagagctcactgagttcctggctgcactgagaagactcttctggaggcctattctggtaaaaattcagaaagattaaaaaaaaaaacaacagtttacaagtgtcaagcagagaaagaagatacgaaagaaaaatctcagactagaatcagacttcatctgcattactgaaagatgagagtaatctacacttcttatctacagagaagggagagaaaggacagcaatccaagaatcctctattctgttctcaaaacattttttttggccaggcgcaatggctcacgcctgtaaccccagcactttgggaggccgaggcagatggatcacttgaaatcaggaattcgagaccagcctggccaacatggtgaaatgccgtctctactaaaaatacgaaaattagctgggagtggtggcaggtgcctgtaatctcagctgttcaggagaccgaggcaggagaatcacttgaacccgggaggtggaggtcgcagtgagccgagattgcaccactgcactccagcctgggcaatagaaccagactccatctcaaaaaaaaagaaaaaaaatttttttttcatcaattgaagcaacaggtagattttcaaagatactcaagaaatcaggcaggcgtagtggctctcgtctgtaatcccaacaccctgggaggctgaggtgggagggatcacttgagtgcaggagtttgagaccagcctggacaacatggtgagaccctgtctctacaaaaaataccaaaaaatttgccaggcgtggtagtatgtgcctgtagtcccagctacttgggggctgaagtgagaggattgcttgagtccaggaggtcaaggctgcagtgagccatgattgcgccattacactcctgcctgggcaacagagcaagaccctggtctcaaaaaaaaagaaaattcagagacaaccctggggcaccctccatctgatggcactacttggaaaagacctgatcaagctgcaaatagccctgaaaagaagacttaacaaagggaaaaagaaagagagcgaaaaccatgttcaaaacataggcagggctgggcgcggtggctcacacccgtaatcccagcactttgggaggctgaggcaggcaaatcacttgaggtcaggagtttgagaccagcctggccaacatggcgaaacctgtctctaccaaaaatacaaaaattagttgggtgtggtggtgcacacgtgtaatcccagctacttgggaggctgaggcaggagaatttcttgaacctgggaggcagagattgcaatgagccaagatcatgccactgcactccagcctgggtgacagagtgagactccatctcaaaaaaaaaaaaaaaaaaaaaaaagaacataggcagatgacattttaactcaaaatggaacaggatagactggggatttgtgtaatagagaaggacccttagaaaagaggattattgaaaccaaacggatatcccataagggaaattataagaaatgctagattatctcagccaaacctcagaaagtggggtggggaatagatgtgtttcatgagtctctcagggaacagggggcaggggaaatggaagagaggggaagcgaaagcgctctaaaggtgtcatctcactggggtgagggagaaggggagtgcgacaggagaaatgtatatttgatctctgcccttggtttctaacacagagcctctaaaacccttgcaatttcctgaggataggtgaacatcctttgcgattatttttattcttagtctctggttcctgacacaagagcttttaagacccttgaaatccccagagtgtggtgattgtcttttaatatgctgatgagatgactggtagctggagtccccagacagctttagcacaggggctgctccctgcaaagaccaaggcatggccacaggattggagctatcagctccaccccttgacctctgggaggggagaggggctggagattgacttaatcatcaatggccaatggttttgttttattttgaggcaaggtgttgctctgtcacccaggctggagtgcagtggcatgatcacgggtcactgcagcctcaacttctccaggttgaagcaatcctcccacctcagcctcccatgtagctaggactatagctgcacaccaccagctaatttttgtattttttgtagagacacagtttcaccatgttgcccaggctggtcttgaactcctgggctcaagcgatccatctgtctcaacctcccaaagtgctgggattacaggcgtgagccactgggcccagtggccagtgatttaatcagtcacacctccataatgaagtctccacaaagtccctagaggacagagttcagagagcttctgagttggtgaactcaatgaagtgctagagggacacatcggagggcgcatggaagctctgcacactcccgccccatactatatcctccatgcatctctttccacgtagctgtttcttagttgcattctttatgacaaaccaataaatataagtaaagtgttttcccgagttttgtgagctattctagcaaattactgaacctgaggattgggctgtgggaacttttgatttatatccggtcagttggaagtacaggtgtattgggtaaacaaagtctggtacatatacaccatggaatactacacagccataaaaaacacaatcggccagacatggtggctcacgcttgtaatcttagcacttcggaaagctgaggtggaaggattacttgagcccaggagttctagaccagcttgggcaaaaatagtgagaccccccgtctctacaaaaaaaaaaatgaaaaacaaaaaattagtcaagcatggtggtgcacgcagtagtcccagctactcggaaagctgaggtgggaggattgcttcagcccagggaggtcgaggctgaagtgagctgtgattgagctattgcactcctgcctgggtaacaagagaccccatctcaaaaaaaaaaaaaaaaaaaaaaaaaaaaagactgaataaaacatgtcctttgcagcaatgtggatggagctggaggccattatcctaagtgaactaacacaggaacagaaaaacaaacaccacctgctctcacttataagtgggagctaaaccttgagttcgcgtggacacaaagaaaaacacagacaccagggcctattggagggtggagcggaggcagagggagaagattggaaaactacctatgagatactatgctcattacccctgtgacaaaacaatctgtacaccaaacatcagcaacacgcgattcacccatggaacaaacctgcacatgtaccctctgaatctaaaataaaagttggaaaggaaaaaaaaaagtacctgtgggaagctgggacttgtgattggggtctggagtggatggaagccgtcttgtgaactgggccctttagcttgtgggatctgatgctaactccaggctgaacagtgtcagatttgaactgtaggacacccagtcagtgtccaaagagaactggagcactgcttggtgtggaaaccccagtgggtgtcaggagtgttgtgagtgtagagaaaaatagtttattttttttcttttagggatgaaatagatcaaggagggttgggtgcggtggctcacgcctgtaatcccagcactttgggaggccgaggcaggtggattgtttgagcgcaggaatttgaaaccagcctggacaacatggcgaaaccctgtctctacaaaaaaaaaaaaaaaaaatacaaaaattagccaggcgtggtggtgcgcacctgtggtctcagctacttgggaggctgaggcaggaaagttgcttgagtgtgggaggttgaggctgcagtgagctgagatcgtgccactgcactctggcctcgacaacagagagaaaccctgctaaggaaaggaggggaggggaggggagatcaaggagctgagaggacagggtacttcagtgaggaaaatagtaggtcctatgtttctcattttaagagtgaggaaattagtcatgaaggaaacaaggagaccttctttttttttttcttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccaaggagaccttcttaccaagcctgggaactcagaagctaggggaaaaaaagacggatatatttgaccgtataaacactgaaacattttgtgtgacaagggataccagaaataaaaccaattcaaatgatggagctgaaaaaatatttgtaatacaaataatagtcaccaacttctattgatgaacttagtgtgtgccaggctgaattctacgtacctgacacacattaactcatcatctctaacagcactatgaaggaggaattaccgtgatgatgatgatgatgatcactattttatagttgagtacagaggttaaataatgaaggtaaataatttgctgaggtcatgtggccagtcagggctcagtcaagatgtaacctttggcagcctgccccagcaccaaacctcttaatcactttgtagatgaaagccaaaagtcaaatggacactatataaagagcttttacaaattgttctgaaaaagagaatcaaccaatacagaaatggacttagactataaatagaccatttgcggaggagcaaaaccaaatgggtaaccaacagtatgaagagaccctcaaacttacaggggtcagacacttgcgaatgaaagcagcaatgagacatctctctacattcctcagaataaactgattcatcaagctaaaacgagaaaaaaaatctcaaatgctggcaggaatatggagaaaagggcatgctcagatatgaagttttgtagtcatttgggaaagcaatttggcaacatctgttaaaatggaaactaaacataccctttgatcttctaatcccactcttgagaatctatccaaagaaataaaaacaccaacacttaaggacaagaatgtgtattggagcactgtttttgtgtgtgtgcatgtggcagaaaactgaccacaaagtgaacgcccatcaaaaagaaaaggcataacgaataatgctacttccaccctatggaatatcatatagctatataaaaggaatcaatgccggccgggcgtggtggctcccgcctgtaatcccagcactttgggaggccaagacaggtggatcatgaggtcaagagatcgagaccatcctggccaacatggtgaaaccccgtctctactaaaaatacaaaaaaattagctgggcgtggtggtgcatgcctgtagtctcagctactcaggaggctgaggcaggagaattgcttgaacccaggaggcggaggttgcagtgagctgagatcacgccactgcactctagcctggcaactgagcaagagactgtctcaaaaaaaaaaaaaaaaaaaaaaaggaaatcaatgcctctgactggcaaagtttccgcaaattattgtgaagtgtgaaaagcatgatacaaaaaatgtgtacattgtctcccatttttatgaaacaaaaaatatctatatgtagaggactttatgcagacacaggaaagcatagagaacgcctatgggttaatatctgttacttgtagggaggggttgggagacttatgtgggttgagctggaaaaccaggagtcagatgagaaaaagctttaccaggggtggcaaaccacagcccacaggccaaactagcctgccaccttttataaataaagttttaaaaaaataaataaagtcttttataaataaagttttattggaacatagctattcacagggccaggactagggagaggctgaaccactcgctcactctcagcatcacccctgcactttcaggacctgagatgagtgtctccttagagtgtgcaccccaggggcctctgtcctctcaccctagagtatttgcattcatttacgtatgatctgtggcttctttgtcactacaaggcagagttgagtagttgggacagagactgcatgacttgcaagcctgaaatatttacagcacaggtaaagtttgcaggactaagtttgcctggagtagtctaaaataaaattgggtatatgggccaggtgcagtggctcgagcctgtaatcctagtactttaggagttcgaggtgggcaaatagcttgaatccaggagttcaagatcagcctgggaaacatggtgaaacccatctttacaaaaaaaaaaaaaaaaaaaaaagattaccccaggtgtggtggtgtgtgcttgtggtaccagctactcaggaggctgaggtgggaggatcgcttgagcctgggaggtgggcagtgagctgagattgagccactgcactctagcctgggtaacaaagtgagaccttatctcacaaaaaaaaaaaaaaaaaaggccaggagcagtggctcacgcctgtaatcccagcactttaggaggctgaggcgggcagatcacaaggtcaggagtttgagaccagcatggccaacatagtgaaacactgtctctactaaaaatacaaaaattagccgggcatggtggcgcgtgcctgtggtctcagctactcgggaggctgaggcaggagaatcacttgaactgggaggtggaggttgcagtgagcagagatcgtgccactgccctccagcctgggcaacagagtgagacttcgtctcaaaaaaaaaaatagatatatgaacacattaacatacccaataaaagattctgtatttgtctgtctatatataaattttaacaaaataagatgaatcagagtctttaatctggtagcctactggcccgaagggttggctattgtgtttttggtgagccagcagtgattttataaattcctatagtcttctgagtctgtgtcccctgcacgtgtttccattagacacaaggtttgccctcccaaggaccacagtatataaacaaatacacagtctatctgtggaatttttttttttttttgagtcgagtctcactctgtctcccaagctggagcacagtggcatgatcttggctcactgcaacctctgcctcccatgttcaagtgattctcctgcctcagtccccctagtagctgggattacaggtgaacaccaacacgtccggctaatttttgttatttttagtagagacggggtttcaccatgttggccaggctggtctcaaactcctgaccttaggtgatctgcctgccttgacctcccaaagtactcggattacatgtgtgagccaccgaacctggcctgtggaattaaaatttgggtgcggtggctcgtggctacaatctcagaactttgggaggccgaggtgggcagatcactcgaggtcaggcattccagaccagctggccaacattacaaaaccccgtctctattacaaatacaaaaattagcccggcgtggtggcacatgcctataatcccagctactttgggaggctgaggcatgagaatcccttgaacctgggaggttgcagtaagccaagatcatgccactgcactccagcctaggcgacagagtgagactctgtcacaaaaaaaaaaaaaaaaaaaaaaaaaaaaaaaaattccatggggccaagtatagtggggaggctaaggtgggaggactgcttgaacctaggagtttgaaaccaacctgggcaacatagcaagaccccatctctacaaaaataaaaataaaaaataacttggagggctgaggtgggaggattgcttgagcttgggaatttgaggctgcagtgagttttgatcataccactacactccagcctgagcaacagagtgagaccctgtctcaaataaataaataaataaaaattaaaaatcagctgggtgtggtcatacatacctgttttcccatactcaggaggccgacataggaggatggcttgagccaggagtttgaggctacagtgagccatgattacaccattgcactccaaactgggcaacagagagagaccctgtctcgaaataaaaccaaataaataaaataaaataaaataaaatcaagctgcatgggaggaagggtgttggcgaggatatcgggaaactggaacctcgtgcattgctggcaggaatatacaatgatgcagccactgtggaaaatagtttggcagcttctcagtaagctaaacacagaatcgccatgttacccggcaattctactcctaggaaaatattcaaaagattgaaaacaagtgttcaaacaaaaatttgaatacatatattcacagaagtactattctcaatagccagaaagtaacccaaccccaaatgtccatcaaccgatgaatggataaacaaaaggcagtctatccacacaaaggaatactattcagacatgaaaaggaatgcagtactgaagacaaggaatgctgcatcatggttgaatcttgaaacattatgctgactgaaagacacgagccaggtgcagtggctcatgcctgcaatcccaacactttgggaggctgaggcaggtggatcgcttgagcccagtagtttgagaccagtctgggctacatagcgagaccccatctctataaaaaaaaaaaacgaaacttagccgggcgtggcgacgcatgcctgtagtcccagcttctcaggaggctaaggtgggaggatcacttgagcctggggaggtcgaggcttcgctgagctatgctgacgccactgcactgaaaaaaagagagagagacagagagagagagacaaagaaagaaaagaaaagaaaagaaaagaaaagagaaaagaaaaagagaaaagagaagaaaagaggaaagaaggaagggagtgagggaatgagggaaggaaggaaggaaggaacgaaaggccacattttatatgactctatttacatgaaatgtccagaataggcaaaatctgtagacagtaaccttagtggttactagggactggcggggaggggagaatgggaagtgacagcttaatggtttctgtttagagtgaagacaacgctctagaacgggaaagtggagtgagaattgcaccaaattataaatgtacttaacaccactttaaaatggtgacttttatgttatatatatatatatgtcttttcacaataaaaaaattcatggtgggaaatctaaggaaaaaaatctaaaaaggcaaagtggggaggggcaataatgagaaagaaaggtcgagaaacactgagctaaagaccagtctgtaatctctctcttttttttttttgagacaaggtctcgttctgtcaccccagctgcagtgtggtggcgtgatcacagctcactgcagcctcgatggcctgagctcaagtgatcctcccacctcagcctcctgagaagctgggaccacaggcatgtaccaccatgcccagctaatttttaattatttatagtgttgaagtctcatgttgcccacccaggctggtcttgaactcctgggctcaagcaatcctcccactttgacctcccaaagtgctgggattacaggtatgagccactgcacccggccttagtctgtatctcaacactgtaaagattgttacctttaaagcaaatacctcaataattcaagtctttaaaacagtgaggggtccagccacagtggctcacatctgtaatcccagcactctgggagaccgaggtgggcggatcacttgaggccaggggttcgagaccaatctgagtttaggagtttgagaccaacttggccaacatagtgaaaccccgttgctactaaaaatacaaaaaattagctgggcacagtggcgtgtgcctgtaatcctagctacttgcgggcctgaggcacaagaattgcttgaacccgggaggtggaggttgcagtgagtcgagattacgcccctccactctagcctgagtgacagagcaagactctatctcaaaaaaaatgaaaataaaaaaaaaagagttcgagaccagcctggccaacacgttgaaaccctgtctctactaaaaatacaaaaattaaggccgggcccagtggctcacgcctgtaatgccagcactttgggaagccaaggtgggcggatcgcctgaggtcaggagttcgagaccagcctggccaacatggtgaaaccccatctgtactaaaaatcaaaaacttagctgggtatagtggcacatgcctgtagtcccagctacttgggaggctgaggcaggagaatcgcttgaacccaggaggcagaggttgcagtgagccaagatcacgccactgcactccagcctgggcgacagagcgagacgccgtctcaaaaataaataaatgaataaataaatataaataaataaataaaaacggtaaggaagggatcttggcccttgaggtaaattgcccccttgtctctctctaatccagggtttgggggaatggtgttcactcacggcctgcaaagctttgggtttaattactgtttcttgtccaacatttgtctgattttgtgggttacttggggccctcagggatgcaagaagccaagtgcacactcaggtgaccaaggtgatggaagttatagaagcaatcgtgggcaagcaagaatgctctggaaactgtggagcctcatgaagaactggaaccggtctttaatcaagtctcagataccatctcttagaagctgtgtatcattatttcataaactatgaagaaagaaaaacaggccgggcgcggtggctcacgcctgtaatcccagcactttgggaggctgaggggggtgggtcacctgtggtcagaagtttgagaccagcctggctaacatggtgaaaccccatctctactaaaaatacaaaaattaggcgggcatggtggcacgcgcctgtaatcccagctactcaggaagctgagacaggagaattgcttgaacccgggaggcagaagttgcagtgagtcaggactgtgccattgcactccagcctgggtgacagagggagacaaaggaaggaaggaaggaaggaaggaaggagggagggagggagggagggagggaagggagggnanggnnggngggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatactataaatatgaaaactcagcggagagagggaggggagaggaggagggatgggggcggggacggcgctgctcaggctctctgcttccccagtgtctttgaaatgctgatatgcttaccttgaaaagatccgaaatgcctgtacgctttagcttatcaaactgggttctgaggaaaccgcatatgaaatgcaggtttgatagaagtaaacacaaatccagaaagtgcttactgggtcaatacacgtttttatgaagattttactcgatgtaaaactttttttttttttttttttgagacagaatgtcactcttgtcaccaagctggagtgcagtgtcgtgatcttggctcactacaacctccacctcccaggttcaagcgattctcctgcctttcagcctcccaagtcgctgggactacaggcgcgtgccaccacgcccagctaattttcgtctttttagtagagacagggtttcaccatgttggccaggatggtctcgagctcttgaccttgtgatccgcccgcctcggcctcccaaagtgctgggattacaggcgtgagccactgcacctggccaatacattattattaaccatagtcatggtgctgtgcaatagatcactaaaacttttcctcctgtctaattgaaactttgtacctttgaccaatagctcccctttccccatccactccctccccaagcctctggtattcactattctactctctgcttctatgagttccacattttttttttttttttttgagatggagtctcggtctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcgagttccacactttttagatttcaaatataagtgagatcaggcagtatttgtctttctgtgcctggcttctttcacgcagtctaatgtcctccaggttcatccacgctgttgcaaattacagaattttgtttgtttttatggctaaatattactccattgtgcgtatatactacgttttcctgatccactcatctgctgacaggcacttatgttgcttccgcatcttggctgcagtgaacatggagtggagtgcagatatctcttcatctaacgtctttttttcttttttctttttttgagacagggtctcactctgtcgcccaggctggagtgcagtggcgtgatcttggcttactgcaacctccacctcctgggttcaagcaattctcccacctcagcttcccaagtagctggaattacaggcgggcgccacgatgtccagctcatttttgtatttttggtagagatggggttttgccatactggccaggctgctcttgaattccttatctcaagtgatccgcccgccctggcctcccaaagtgctgggattataggcatgagccaccacgcccagcctcatctaacatctcttaaaggcatttctgctatatttgtgtttagtcttcttaagaattttttagtttctctatcctgaatactaatctgggagttgttttctagaagtcagaggtcccagaagagtcagctcaaaaaaatacctttgtcagttattgaaggaaacaaaaggcaacttcagtattcatcgtgatcacgagtaagtcacctttgcttatctcaccttatatctcaattaatatttaataagtaacttgggaacatcgataacgttgagtcaaggccatgcatttgtttgacttgtaatactttctcttttgctcgaccaatttatgcatacttctaaatttaatcagagtaaaatgtcaattacttgcaaagaaatgcagatcaaaaagttctcctgcactccagcctgggaacacagtgagaccttgtctcttaaaaaaaaaaaaaaaaggccgggcgtggtggctcacacgtgtaatcccatcactttgggaggctgaggcggctggatcacgaggtcaggagttcgagaccagcctggtctgtcactactaaaaatacaaaaattagccaggcgcggtagtgggcgcctgtaatcccagctacttgggaggctgaggcaggagaatcacttgaacccaggaggcagaagttgcagtgagccaagatggcaccactgcactctagcctgggcaacagagcaagactccgtctcaaaaaaaaaaagttattattctcaatacctagaattttaaatctagggaagtgaatacatagacacagctttaaaaatcagaatctaatatgaaaagatgttcaacatcactaattatcaggggaatgcaaatcaaaaccacaatgcgggccgggcgcagtggctcatgcccataatcatagcactttgggaggccaaggcgggtggatcacttgaggccaggagtttgagacaagcctggccaacatggtgaaaccgcgtttctactaaaaatacaaaaattagccaagcatggtggcgggcacctgtaatcccagctactcgggaggctgaggtaggagaatttctggaacctgggaggcggaggttgcaattagccaagattgcaccattgcactccagccgggcgacaataatgagactctgtctctaaacaaacaaacaaaaaaccaaacaaacagaaaaaccacaatgcagtaccaccttactcatgcaagaatggccataatttaaaaatcaagaaataatagatgttggcatggatgtggtaaaaagggaacacttttacactgctggtgggaatgtaaactagtacaacccctatggaaaacagtgtggaggttatccataaagaactaaaagtagaactctgatttgatccaacaatcccactactgggtatctacgtggaggaaaagtatatgaaaaagacacttgtacacacatgtttatagcagcacaattcgcaattgcaaaaatacggaaccagcgcagatgcccatcaatcaactaatggataaagaaaatgtggtatatgggccaggcatggtggctcatgcctataatcccagcactttgggaggccgaggcaggcagatcacctgaggtcgggagtttgagaccagcctggccaacatggtgaaaccctgtctctactaaaaatacaaaaaattagctgggtttggtggtgcatgcctgtaatcccagctactcaggaggctgaggcaagagaatcgcttgaacccaggaggcggaggttgcagtgagccgagatcgtgccattgcacaccagcctgggcaacaagagtgaaactcagtctcaaaaaaaaaaagaaaagaaaaaaaaaatacacacacacacacacacacacacacacactataatttaattttggttaacttaaaatgcaccagcttgggcaacaaagtgagaccccatctctataacaactaggaaaatttagctgggtgtggtggcacacacctgtagtcccagctacttggaaggctgagctgggaggatcacttgagcctgagaggccgaggctgcagtgagccgtaattgcgccactacactccaacctgggtgacacagaaagaccttgtctcaaaaaactttttttaataaaataaaataaataaataaataaaatgtaaaagccacagatggtttgtggctaccatatcagaagtttggtagacctcacttccccacagctctgaagccttctgtgattctctttctttagtctgggtcaagcccgcttctctgggccatttcggccatcctcacacttaccatgcagcattgtaatgatttacatgtgtttctccagtacgtagcccaatgcctggcaccaaagggctactcgataagtatgtgtcagataaataaatgaaccacccaagaaatgattacagactctttttttgttttgtttcattttttttgttttgttttgagacagactctcactctgtcacccaggctggagtgcagtggtgcggtctctgctcactgcaacctccacttcccgggttcaagcagttctcctggctcagcctcccgagtagctgggactacaggcacccgccaccatgcctggctaattgttgtatttttagtagagatggggtttcaccatgttggccaggcttgtctccaattcctgacctcacgatccacctgcctcggcctcccaaagtgctgggattacaggcgtgagtcacagtgcccagctgtgattccagacttctggtagcttccttcttctcctggctgtgaggtgacactactgcacagaaagggtgaattgaaagaacttggcgacacacctgccgggctgatctggcatgagcttggggaccttaggctctgttgtgccccctactctgatgctttataaagaaagcagtttggtttatacgtgaccagggcaggaagtgaatattcctgcctgggttcacccaacaggtggttgggggaaaaactgtctatgtggtataaattcgagggctctgtttccccaaaactccttccccagccaggaccctgattttctcattgtattagcttcctgtttctcagggtgctggaggccagaagtctgtaatcacagtgtcagcaggactgtgcattctctagggggactagtgaagactttgtcctttcccttccagcctctgattggctgtcagcattcctcggcttgcgaccacatccctccagtatctgcctctgtgttcacatggacttctctcccatgtgtctctcctaaggacatttgtcattggatttagggcacagtaatcatgaatcatctcatcgatctagggatctttaacttaattagatctgcaaagaccctttctccaaatacggtcatattcatagtttctgggggacaggatatgaacacagattttcaagggaggccactatttaacccactacagtgatttttttttttttttttagacagagtctcactctgtctccaaggtgctggagtgcagtggtacgatcacggctcactgcagcctctaactcctgggctcaagcaatcctcccgcctcagcctcccgaatagctgggactacaggtgcgtgacaccacacctggctagtttttgtagatatgggagctggctatgttgccagggctagtcttgaactcctgggcttgaactcctgggctcaagtgatcctcccacctcagcatcacaaaatgctgagattacaggcgtgagccactgtgcctggcctacaattacttttatttatttatttacttatttttgagacagtctcgttctgctgcccaggctggagtgcagtggtgcaatctcggctcactgcagcctccacctcccgggttcaagcaattctcctgcctcagcctcctgagtactaggagtacaggcatgtgccagcacacctggctaattttttttttttttttttttagtagagacagggtttcactgtgttagccaggcaggtctcaaacccctgacctcaagtgatccacctgccttggcctcccacactgctgggattacagatgtgatccactgcgcccggcctacaatgacttttcaacgtcagtttttgagttctagagttcctctctacccagcaatttcaacatgccttctctggaagtgaggaggaattactgaccaaatttaatgttgaagtgattcattgtatttgtttgtttgtttgattctgcctgaaggggctacagcccaggagaaggctgggaccgaaaggttgaggggagagatgaggattgcctcacacagtgacccaggtgtcacgcggaccagacacgggctctgatggggaagttcttgctatttcaaaatgactttaaaattgcagtctgggcatagtggctcatgcctgtaacccctgccctctgggaggccaaggtgggtgaatgactttaggtcaggagttggagaccagcctgaccaacatggtgaaaccctttctctcctaaaaacacaaaaatcagctagatatggtggtgcatgcctgtaggcccagctacgtgggaggctgaggtgagaggattgcttgaatcggggaggcagaggttgcagtgagccaagatcacgccattgcactccagccttggtgacggagggagaccttgtctcaaaaaaaaaaaaaaaaaagagagaagaaaattgcaaataatagtttcttctatatataaaatgcaagaaaaattaaaaagggggagctatagattcaaagagattgaagagatagatcaaccaattgtccatactgtgactcagttaactccaaatgttaaaaagttggagacatcggccaggtgtggtggctcacgcctgtaatcccagcactttgggaggccaagatgggtggatcacgaggtcaagagatccagaccatcctggccaacatggtagaatcccatctctactaaaaatacaaaaattagctggatgtggtggtacgcatctgtagtcccagctactcaagagactgaggcaggagaatcacttgaatctgggaggcagaggctacagtgagctgaaattgtgccactgcactccagcctgggtgacagagcgagactccgtctcaaagaaaaaaaaaaaagttggagacattcgtggaaatgtgaacactgactggctaattgtatacattaaggaattactgttacttatgttaggtgtgatactgatattttggttatgtttaaagaaagagtccttatcttttacaaataaatactgaatatatgtagatgaaattatataacatttcaaacttacttcaaagtagtctggcagggaaggggagtagaaatagaaaaagagaggttacaagtttttgattgttgtagttggatggagggaacatgggcattcgttgtcctgttctctccgcttgtatatatttctcataataaaaagttaaggccgggcacggtggctcacgcctgtaatctcagcacttcaggagaccaaggcgggtggatcagctgcaatcaggagttcaaaaccagcctgaccaacatggtgaaacaccatctctattaaaattacaaaaaattagccaggcgtgatggcgcacgcctgtaatcccagttacttgggaggctaaggaaggagaattgcttgaatccaggaggtggaggttgcagtgagccaagatcgtgccactgcaatccagcctgggagatggagcaagactccgtctcaaaaaaaaaaaaaaaaaaagttaagtaggccaggcacagtggctcatgcctgtaatcccagcactttgggaggccgaggcaggtggatcacctgaggtcagaagttcaagaccagcctggccaacatggtgaaaccccatctctacacaaatacaaaaattagccaggcatgatggcaggttcctttaatcccagctacttgggaggctgaggtaggagaatggcttgaacccgggaggtggaggttccagtgagacaagattgtgccactgctctctagcctgggagacacagcgagaccccatctcaaaaaaagttaaataaagtctcggtgtggtggcacatgcctgtagtgccagctactcaggaggctggagtaggaggatcttttgagccaagcaattcaggtccaatctagacaacatattgagactctatctctaaaaataacgttttttttggtggggcctggtggcttgcacctgtaatcccagcaggctgaggtgggaggattgctaaagcccaaaaatttgagaccggcctgggcattagagtaagaccttgcctctaaaagaaaaaaaattattaatttcaataaaaataaaaataaaattttaaaaagaatgcctgtaatagtattttttttttttttgagatggagtttcactcttgttgcccaggctgaagtgcagtggtgcgatctcagctcactgcatcctcctcctcctgggttcaagtgattcttaggtctcagcctcccagatatccagaattgcaggcgtccaccaccaccacgctgggctaattttttgtatttttagtagagatggggtttcataatgttaacggctggtcttgaactcctgacctcaggtgatccacccacctcaacctcccaaagtgctgggattacaggcatgagccaccacgggcccagccactagaatagtattttttaagtgaaagaaaattgagagtaacttgaaatgtttaccagtggggaatgagataaataaattatagtgacttcattcaaaaaaaaatttacacttgttaaataaaatacatacttgttagccaggctcagtggctcatgcctgtaatcccagcactttgggataccaaggcaggtggatcacctgaggtcaggagttcgagaccagcctggccaacatggcgaaaccctgtctctactaaaaatacaaaaaatagccgggcgtggcggcaagcacctgtaattccacctactttggaggctgaggctggagaattgcttgaacccaggaggcagaggttgcagtgagccgatatcgtgccactgcactccagcctgggcgatgagagcgaaactccgtctcaaaaaaaaagaagctatacttattaaaaagaataatagcattcacttgtataacatttgcctttggaaaggccctgttctaagcatttctgctatgagatgcagaattaaatgtactaacccagaaagatgtccaagatatgtccttaagtgaataaaaacgaactaccaccttgcagcttgtgtggtataattcgatttttataaattaaaatatgatgttttttatttccttgtacgttgttggtgggagaataaaaagttcatttgctgtgggaaacagtctggcagttcctcaaaaagttcaacatagaattgccacacgactcagcaattccactcctaggtatacacccaagagaactgaaaacagagactcaaatactcgtacatggatattcataacagcagtcttcctatagccaaaaggtgatgtgttggtttagtttatgtgttaacttggctgggccatggtgcccagatatttgattgaatactattctagatgagggtgtgttttagatgagattaacatttaaatgtgtggcctttgagtaaagtaggttgcactccacagtgtgggtgtgcctcacctgatcagttgaaggccttagaagaacaaagactgagctcgtctgagcaagaaagaattctgccagcaacatcagttcttcccagggcgtccagcctgctggcctacccttcagatttgggacttgccatcctccatgattgtgtgaatcagttcctcaaaataaatgtctttatagaaacagaaaattctatggtcctgtttctctggaggatcttgactaggacaagtagaaacaagacaaatggtcacctgtgaatgaatggatgaacacatttgtggtatataaatacaatggaaaatattattcagccattaaaatgctgaagggatgaagtgcttttaatggtttaatgaatccttttataaaaaggatgcgtcatgctacaaagtgtatcagtctcagtctcaaaatcattattctggttgggcacgttggcccacacctgtaatcccagcactttgagaggctgaggcgggtggatcacctgaggccaggagtttgagaccagcctgcccaacgtggtgaaaccctgtctctactaaaaatacaaaaaattagccggttgtggtggcgggcacctgtaattctaactacttgggagactgaggcaggagagtcacttgaacctgggaggcagaggttgcagtgagctgagatcacgccattgtaatccagcctggacaacatgagcgaaactgtgtctcaaaaaaaaaaattattattgtaagtaaaagaagccagacacaaaaggtcacatacagtatgatttcatttatataaaatacccagaatagatagatcataaagacaggactcaggttagcgtttgccaggggagaatgaggaatgactgcttaatgattttggggtttgcttttggggtgatggaaatgttttggaagtagatagaggtggtgtttgcacaccagatggagatactaaatgtcattgaattgctcactttaaatggttaattttgtgttattgtgctattgtgttatgtgaattgcaactcaattttaaaaattatatatacattttaaaatctggaatacattttaaaatttgtactctggagttaagctgcctggtttaaagttaattctctcgctgagtagctgtgagatcttaggcaagctatttcacctctttgtttcctcctgtgtaaaacaggaacaatattacatcactctaatatgaaggaaaaatgagttaatctgtgtaaagtgcttataacagtgtataacacagaggaggtgctatgtaagttgtagctactattattattatttttttatttttatttttattttttgagacggagtcttgctctgtcgcccaggctggagtgcagtggcgtgatctcggctcactgcaagctccgcctccctggttcatgccgttctcctgcctcagcctcccgagtagctgggactacaggcgcccgccactacgcccggctcattttttgtatttttattagagacggggtttcaccgtgttagccaggatggtctggatctcccgaccttgtgatccgcctgcctcggcctcccatggtgctgggattacaggcttcagccaccgcgcccgccctattactattattattataattatatgaccaaactgtcacagtactctggggagagagaaaccttcattttttactgtatatgcttctgtatggtttgaatattttgcaagaagcatgtaatatttttacaataaaagactaaaatgcattgtagtaagactctcagagtgtctgggagcacagaattagagtcaagctgatcctctgccagtgcttttagtccactgagaatcgacctgtggcgggtcatcccagcttcaaccagtgagatgcgtttatgctgatacttctgatactctgggtccctcatatgagggggtccttggtttgactaagcaaagacaggttttgctgcctgacttaacaaagtgcttatctcatcccgataaaattgtatcatcttttaaaattagtcctcctctacattgaatgtttatgggcctcttgtgacagaactggttgtgtcccttgtcagtcctgtgctgcaagagcaaatgaccttattaaacgtctactttttggagaagcagaacaggttgctttttattaactgctgtggtgccgctcctccctcttcatctcagtcccctaatccttctccctttgagcagggcttctgggatcaagagtgcagatgatggcctatttatgtgttgtttttgtcttcccagcatccaggcactctacttgggcattagcatcctgattttccttgggcaacagattccgccctctccatccatctccgaggtttggaggattggggatttggttccaccccttgcctctaaaaataggcatgtgaccaggtctggccaatcagatcattccatccctgtggccactgtgactggcccagggatgagcacatgactcaaaatgctaatgagacattcacctgagttgttccctggaactgttggaaaagataaatatctctttcttctgggatggttaaactaatagaaaataacgtaagtaagcagtaggaagaaaacatagggatagagccaacagatgaaaagagatagcaaccttaaaaaaaaaaaacttgtaagccgggcgcggtggctcacaactgtaatcccagcactttgggaggccaaggcggccggatcacgaggtcaggagatcgagaccatcctggctaacacggtgaaaccccgtctctaataaaaatacaaaaaattagcccggcgtggtggcaggcgcctgtagtcccagctactcgggaggctgaggcaggagaatggcgtgaacccgggaggcggagcttgcagtgagccgagatcgtgccactgcactccagcctgggcaacagagcgagactctgtctcaaaaaaaaaaaaaaaaaaaaaacttgtaaatttgacataatttcaaatgtacagaaaatctacaagaatagtatgaagaaactcccatgtgtttacccaaaatcaccaaacatacacacttctcacatttgttttagaattctctgagagcaagagtgagagaaaggttctagaatacgttgttttatctgcaggatccaactattcttgaaaccaagatctattcctgaaggggtgggttgcccctccacgcctgtgggcatttctcgtcaggtggaacgagaggcttggaaaagaaagagacacagagacaaattgtagagaaagaaaaatgggcccaggggaccggcgttcagcatacggaggacccgtgcccgcaccggcctctaagttcccttagtatttattgatcattagcaggcatttcccggacagggggatgtgccaggataatagggtataatagtagagagaaggtcagcaggaaaacatgtgaacaaatgtctctgcatcataaacatggtaaagaaaaaagtgctgtgcttttgatgtgcatatacataaacatctcaatgccttaaagagcagtattgctgccagtatgtcccacctccagccctaaggcggttttcccctatctcagtagatggaatatacaatcgggctttacaccgagacattccattgcccagggacgagcaggagacagatgccttcctcttatctcaactgcacagaggtgttccttcctcttttactaatcctcctgagcacagaccctttacaggtgtcgggctgtggaatggtcaggtctttcccttcccacgaggccatatttcagactatcacatgaggagaaaccttggacaatacctggctttcctaggaagaggtccctgcggccttctgcagtgtattgtgtctctgggtacttgagattagggagtggtgatgattcttaaggcgcatgctgccttcaagcatttgtttaacaaagcacatcctgcacagcccttaatccatttaaccctcagttgacacagcacaggtctcaggaagcacagggttggtggtagggttacagattaacagcatctcaaggcagaagaatttttcttagcacagaacaaaatggagtctcttatgtctacttctttctacacagacacagtaacaatctgatctttcttttccccatatattcccatactcttacatttttctttttttcattaaaaaaaattgtaggccgggcgcggtggctcacgcctgtaatcccagcactttgggaggcggaggcgggaggatcccttgagtccgggagttcgagaccagcctggacagcatagggagattcccccacctctataaacaaattaaaaattagctgggtgtggtaacgcgcgcctgtattcccaactacttgggaggtcgaggctgcagtgaaccgtgtttgtgcaactgcactccatccagcctaggtgacagagtgagaccctgtcaaaacataaagaaaaggatgaaggaagggagggaggaaggaaggaagggagggaggaaggaaggaaagaaggaaggaagggagggagggagggaaggggaagaaagagacagaaagaagagaaagaagaaagaaaagaaagaacagaaaagaaagaaaaaagaattcctttaatttagtgtatggtgttaaaacgcaaccaaacgctccatccggcgaagagagagagaaaagaagagaggaaggaaagaaggaagggagggagggagggagggagaacaccttcctttaattcagtgcatggtgttaaaatgcgaccaaacgctctatccggctgcaatctccccgcacgggagtgatttatgcagtagctggaggttagtcaggactccaggatgcaccgcagacaccgaggcgatgatcctcggactcattaatagggagtcatttgtgactcaggtgcgctctctgcgtctgcaagtcacgttcccttcggcacgcccatctcgaggattcatcctctccaacgggtgacgagcaccgcctgccggcggcccgcctctcggcctcttggccacgccccccaccggagggcaaggcgcacgctccgcaatttttctccgcccccgtcttccggcttctcgcgacatccgcccagcggcggccggaatctcgcgataaaggctcattgtctcgcgggagcgctgctggcggtcgggcgctcgggcggccctggccggggagacgagttgcatgtgttggttcagctggcgatagcggcgggagcggagccggcggggcctgtgcgaccgcctgggtaacgaccccaagtgcttctcccgctcccgagaagctcgtagagagtgtgggggaagctgagatgctgcctggcggaagggggccgggccgggcctctccacacccccgcccacaagggccccttctggcgtccccggggttgctccttcgcctcagacctggtcgcccttgtcccctcagtgctcttacattctgcgctcgttttctctcctcatccttcttacgctctggttaccccgccccctcccatgccctttttagactccccaggcccctctcatggcgtttagttgcccccacaccctgcaccccgggcttctccgatgacccaccccttgttcctaggcacttccagcctctctccattcggcgcctttgtagcccttctctcactgcagtttgcatccctcccagatcaccctcagacctttttgctccgtgtctgccgtgggtactcaccccatctttccttccccattgcttcctgtttttctctagtgagtccctctgccccatccttcatggtccatttgctgcttgcttccctgtagacctgtggagcaaggagatgttgtgcctgggattgctcatattttatgaatcgaatgcagcttgtatcccccactcaacaacagacttgaaacagctttggggtggggaggtttctgttgagaggaacactgctcttctggggtcttgattctaaaatagtgagggtgtgttattttccttgcttacaggtttgtgaaatggctgctgacatttctgaatccagcggggctgactgcaaaggagacccaaggaacagtgccaagttagatgccgattacccacttcgagtcctttattgtggaggcaagtgttggtagccacagaatgacttttactcactatacttttatgcattgtaataacagtttgacatttggtaagctttcttccccatccttttcatttggtgagtttgtactgggggagaggagtcctggggaggaggaggcatgaattaacagagtttccccacctgggtgatttgtgtctggctactctgcctgaagaagcttacagtccatttgtaacaggatgtgcaactaggttatttcagcctgaaggtcctcaaggtgtatgctagtctagctgtcaaaggagggcttcttggaagattatgagttaaggatggcaaggactggatgagaaggtggggaacggcgtcccagacaaagcgcacgactatgtaagaaaaagcttgatggctgtctgtgaagaagtgagcagctttgagtttgtctggtgtatcgtatagggagggtggcccgttaaggagtgggagaaggtgaggttggagtgttgggtggtaggacagtgaggaaagtcttcttggtttgaatcatgatatatgtattaggtttaatcaagatctttttcactttcgagtgtttttcttcattttcaatatagaaatatttgtgaattgtaaatgctgtatgtattcgcatcttggaaactttcagaaaaatctgaagatacaggacagtaaaagggcaagtaaatattttttcagtaaatatttctcagaacttactgtgtgcctagtgatgttttaggtgctggggcctgagtagtgaataagtcagaagatccttgttcacgtggaccttacattctgtgactgcagtagagaccacatctgacatttaagtaccgtagaaggagaaatgatatctttttgccattaaaagtaatggcaaaaactgcagttacttttgcaccaacctaatcattttttgagcaggaaaataaagtgacaagagattaatatgctgcattatttggaggaaatagaacccacaaatttgaaggccactttcagaaatctaggtttgaggtaaataagtgccttgctgagagtgtaagcagtataaaagtgaataaagagggttaatcaaagaaaagatacaatgtttaatggtgaaaaaggaaaaagatatttcacaattgagagagttgaaaaaccagaacaccactaaaaatgatgactttgagaaagattagatttggagatagataataggctgacttgcaatacagtgaatttgagtttctccaaatggaagaatccaagtatgctgcatttggcagcagagagagacagtatatgagcttttctaagggagaaagagagaaaagccagaaagattcttggggtgtacctggaacgaggtgaactgggtagatttcaccacatagagaattgcttagttggtgagaagtttggaagcttagtgaaaatgtcagtctctagaaatcttgttttatttttctgtaattatgaattaaaactaaggggccgggcgcagtggctcacacttgtaatcccagcactttgggaggctgaggcaggcagatcatgaggtcaggagttcaagaccagcctggccaacatagtgaaaccccgtctctactaaaaatacaaaaacttagccaggcctggtggcaggcacctgtaatcccagctacttgggaggctgaggcaggagaatcacttgaacccgggaggcggaggttgcagtgagccgagatcacgccattgcactcccacccgggcaacagtgcgagaccccatctcaaaaataaaaaacaaaactaaggatgtgagaaaaactgatacatttattttaacaagatgctcagaatatagattcctattatatttttatataatgattacctgtgaaacaactctttaaatttggaaacctatgtgagtaaaggataagatctattccctgtgacctcagagggtcagtgaactaggactaaagtggaaactactgaaaggtgcctttctaccttgtcaacactctccagaacagtacaggcttccacttaatgtaaaaacattcttatgcttaattgaagaaactagtagtggagatgggattagactgtaccttttaatttctaacattaccattttgtaaaagtagtggattttgttagccagcttggtaagaaggtatgatgacattgttaatagagtccacatcataatcaacaatttacaaagactataaacaatttttacctagtatctctgatgtataaggtcctcggctaagttctgtggaggcatataaattggcagaggccctgtctgtctacatataacttaacagggaagatgatgaatgctgaaagaaagagacaagaaataggccaggcgcggtggctcacacctgtaatccaagcactttgggaggccaaggtgggtggatcagctgaggtcaggagttcaagaccagcctggccaacatggtgaaaccctgtctctactaaaaatacaaaaattagctgggcatagtggcaggcgcctgtaatcccagctactcgggaggctgaggcaggagaatcgcttaaacctgggaggcggagattgcagtgagccaagatcgtgccactgcactcagcctttgagagcaaaactccatcccagaaaaaaaagaagaaagagacaagaaataaagattaaggactaatagctgcagtgtcagtacaggaggggagagatttgtaggaaattaggggaagacttcatagaggcaaccacagccaaatggggatttgaaggaaaggttgcattcaggcaggcacagaagggctgaaggttggacttgccaggcaaaggagtggaggtaggaaagtatttaatagtgggtagtgtggagggagtttcgagtgttacagtttggttgtattgtggaattcatgaagaggggcagccggaaattatggcaacgtggtttggggccaagttctggggcacctgatttgtagataattgtaagtcattgaaagttttggagcagtgaagttacatgaagatgaatctggcagcaagataacaattgagggaggcaggcttattggccaggctataataagactttagacaaaattaatgagcatttaaatgagtggcataagtgaggaagagaggttgaaaaataaattatggtaggatgaacagtataaagcagttaatcagatttgaggacaagggagatgggagaaataaactagatgtagttttgacagacatttagtattgctggagtgcttagagaagagggaaaaccctccaatagaatacccaactgattaaagagaaaaatagaagcgatagtgacataggcatttttcttatcattccttccccctccctccctttccccttttgcaaaaagaaggatgcaaattagagaatttgctctcagctaaagtctggggtttcagagagcagctcaaattcatttaggaaacacgttttaagcatctgctctgtggcaagcattgtgctccatatacagaaataagacataattatctcctggaaactgagcttaactgggaagacaaacattttaacaggtgagttataatgtactaattgtatactagaggggtgagcagactgcagtgagaataaagaaccaaccagttctacttgggagaactgaaaaaagggaaagttaaagtattgagtggattttatgtttgtatatttaatcttcaaaattgaaatattacagttttattgatgataagcttctcaattgtataagtggtggggccaggattaaaatccaagacaagccattataacatcagcttcaaggaaacttagcagagtcttgaaggatgaataggtgtttgctgaaaagaatggcatggatagaagttcattgtggttggaccatgggctggtaggagttgagtctggagaagtacgataagatgtttgaaaagttcttaatctgggaagtgatgtgattggttatatctttttggataataactgtttggaaggaaggaggaagtgcctgaaatgggttgaaactggccacagaaatcaagtttaggagactttatttttattttaatcttttccaccctcctccccaaatttagaagactttaaagtatgagatgattgaggcttagtgacactgtgtgcaaagttagtgattttggtgactgttgacagcgaaatttgtaattgaaaatattgactttcaggaagctgattgtggctgttcattctctgttatagaaaggcagtttttgtttgtttgtttttcagaaggagtctcactctgttgcccagactggagtgtaatggcgtgatctcggctcactgcaacctccgcctccagggttcaagtgattctcctggttcagcctcccgagtagcggagattacaggcgcctgccaccgtgcctggctgatttttgtatttttagtagagatgaggtttcaccatcttggccaggctggtcttgaactcctgaccttgtgatccacccgcctcggcctcccaaagtgttgggattacaggcgtgagccaccagacccggccattctgatgtgttcttaagactagatttagtttatgatcttgtgccaagaccaccacagaagtgctgttaatttcagtgcattttatcaagaggtacctggctgtggattagtcccattccatgtttccatgtggtggtaactttgctcatttggccaggcacagtggctcacacctttaattccaacactttgggaggccgaggcaggcagatcatctgagctcaggagtttgagaccagcctgggcaacatagtgagaccctgcctctacaaaaaattaaataaattagccaggtgtggtggcaagtgcctgtagttccagctactcggaggctgtagtggaaggaacacttaagcccaggagttcaaggctgcatgagttaagatcacatcactgcactatagcctgggtgacaaagtgagactgtctctttaacaaaaaaaaagaagctggagtctagaggcttaattttttatttatttttttttttttgagttggagtcttgccctgttgcccaggctggagtgcagtggcagtctcagctcactgcagcctctgcgtcccaggatcaagcgattctcctgcctcagccttctgagtagctgggactacaggtgtgcgccaccacacccggctaatttttgtatttttagtagagatggggtttcaccatgttggccaggctggtcttgaactcctgacctcaggtgatccaccacctcggcctcccaaagtgctgggattgtagacgtgagccaccacacccagcctagaggcttaattagattcaagttaaacagattttggcaagaaagtttcgtggatgatgtttcattcatcatgttgcattgcatcaagagctcataatgtcagatgtttcactattagtgatgctaagtttgaaggtgacggctaaatgtttgcattgaaaaggtacagttttccctttccaaataagtaagtgatctgtaaagagaaattgacttttttaaagcaaataatggtgaacttaaaggagctcccccaatttttttattgcattagaattttgctgaaccgggccaggcacagtggctcacacctgtaatcacagcactttgggaggctgaggccaaggcaggcagatcacttgaggccaggagttcaagaccagcctggccaacatggcaaaaccctgtctctactaaaaatacaaaaattagctgggtgtggtggtgcacacctgtaatcccagctactcgggaggctgagctacgagaatcacttggacccaggaggtagaggttgcagccagctgagatggtgccattgcactccagcctgggcaacagagcaaaaccccaatttttttttttttctgaactaaatattatttgaaatagtatacaaaatttgtagctttagtatttgctgtgatggtgtttaaccaataattgtatagttatatcctgaaagtgtggctgaacaactatgcctagtatttgaacttgaattgtgaggaatatagggctgtagctaaccagagagatctttggtggaaataaccctaaactataatagactagactggacaaaaccaatggattccagttttcttctgccacataccacctttgtcattgtatgagctgtttaactcttttagtgccccatctgtaaaatagtgattgtgtggtagcatgttagaatgttagtagggtgaggtgaaggcagatcattttcagctgtcaggtgccactaagttgcttgtttactttgtgtaacctaagttagtggttaatagcatgagcgtcagaaacaggcagattcaaatcctgttatccagatgcaagtggttatgtactctaagcctcagtttcatcatctgaatatagatatggtacttatcttacaaggttgtgataactaaacataataatgtatataaggcatagcaaagcatttggcacatactaggtgcccagtgtgtagtaattgctgtgactacatggtataccaccttcctctccctgagaaatctcaggatattggacacactgaactactccattctaaaccttaaaaataaaaacaaaaggccgggcgcggtggctcactcctgtaatcccagcactttgggaggctgaggcgggcggatcacaaggtcaggagatcgagaccatcctagctaatactgtgaaaccccgtctttactaaaaatacaaaaaattagccgggcgcggtggcgggcacctgtagtcccagctactctggagactgaggcaggagaatggcgtgaacccgggaggcggagcttgcagtgagccgagatagtgctactgcagtccggcctgggtgaaagagcaagactccgtctcaaaaataaataaataaaaacaaaataagcagttgacccagtattagaattacggttaaaattggaagcttttccagttcttctagtccattattagcctgtacaggctctaacaccaaatgacaggattgaaccaagattccttctagctttacactttcatgatcttatgtagcataacatgaaaaagccttggcaacatagcgagatcccgtctctacaaaaataaaaaacttacctgtacatagtggctcacgcttatagtcccagctacttgggaggctgaagcgggaggattacttgagctgaggagttcgaggctgcagtgagccatggacacaccactacactccagcctgagtgacagagtgagagtgagacccttactctaaaaaaaataggccaggtgcggtggctcatgcctgtaatcccagcactttgggaggctgaggcggacggattacctgaggtcaggagtttgagaccagtctggccaacatggtgaaaccccgtctctactaaaaatacaaaaattagccgggcgtggtggcacacgcctgtaatcccagctacttgggaggctgaggcaggagaatttcttgagcccaggagacagaagttgcagtgagccgagatcgtgcctctgcactccagcctggcagaaagagcaagactctgtctcagaaaaaaaaaaaggaaaaatatattgcaaaaagatggtagtaaaaatgctgctaaagtttataaatgtgtcagtatgaataaaaagtggtggctgttttggtagaaccatcaaaagaaataaccaggctgggaacagtgcttcacgcctgtgatcccagcactttgggaagctaagataggtagatcgcttaagcccagaagtttgagactagcctgggcaacatggtgaaaccttgtctctacaaaaaattagctgggcatggtggtgtgcatctgtagtcccatttagttgggagactgaggtgggaggatcatttgagcccctggaggggtggaggctgcattgagccatgattgcaccactgcaccccagcctgggcaacagagtgagaccatgtctcaaaagaaaagaaataaccagtttccttcaaactctgatgtatgggaaattgttcgtgtcttagcttaattttttgacccactgaaatggttatggtaagacctcattatatacaaaatagcatattttgatgttccatcagctgatggagacactctttagatgaaaaagtcaagatagtatcatctcaaataaccatgtgccttttaccccaaaaacactgaagagtagcatttgaaaagtggtatagaaaacttatagggaaaatgtaaaaatgaagcattttctcaaatataaaagtaaggataagccctgtgtatgtgtgtacatataggtttaacatttcaaatcttttttctttttacttcctcagtctgttcattaccaacagaggtaagttctttaatttttttttttaccttatgtatttgaagttattcttggttttaaagctaccttgagaatttttttttatttttcatttttgattatttgatagtaaagctttaaccttttatagagaactttgatttagagtaattttttggtcttatatattctttcctaaatttagaccttaaatcatacatgtgcatcttttgcacatggctgtgcagtttggatttttgcatgggacttatgaatagtcagctaataaaataagagtaaccttaatgccaaaatctatacaaatgagcagaggaaagaaagggcagtataaattatgtgtaagactttctaagtccagctctatgagcaagtcatgaaaatgaggcacttatgtgctcaaagcaagaaatagagggagaagaaataaattggtactgtgaagaggtacctaatccttcttaatatctaattttttatgggacatatcgtggttgaatacagatttcctgtggataagaagtcagatgggagtggtttgttttattctttgtattaacaagtatagggggtgatttttaattacgacatattgtttgactgaaaatgttttgttgtgactcagttctttttttttctcctagtactgtgaatatatgcctgatgttgctaaatgtagacaatggttagagaagaattttccaaatgaatttgcaaaacttactgtaggtatgaacattttttttcttgcattaaacttctgtacctgagacaaatgcatgtatggcattattctaaagataggaaagtcctcctttagtaggatattacagaattaacatttatctgttagctgtttaagttctctctgagataggataggtctgaatatcaactttcttacataaaaaagtaaatgggccgggcgcagtggctcacacctataatcctagcagtttgggaggctgaggcaggcggatcacaaggtcaggagatcaagatcatcttggctaacacagtgaaaccccatctctactaaaaatgaaaaaaaaaaaaaggcgtggtggcaggcacctgtagtcccagctactcaggagggtgaggcaggagaacggcgtgaacctgggaggcagagcttgccgtgagccgagatcgtgccactgcactccagcctgggtgacagagcaagactccgtctcaaaaaaaaaagtaagtaaatgattggctgggcgcagtggttcacgcctgtagtcccagcactttgggaggctgaggcgggtggatcacctgtggtcgggagttcaagaccagcctgatcaacatggagaaaccctgtttctactaaaaatacaaagctgggcgtggtggcgcatgcctgtaatcctagctactcgggaggctgaggcagaagaatcgcttgaatccgggaggcagaggttgcagtgagccgagatggcaccattgcacgccagcctgggcaacaagagcaaaactctgtctcaaaaaaacaaaattaaaaaaagtaaatgatttaggggcaaatatatattgatttttattgtaagtgtactatatgctacacactgttgcagattctgaggataagccaataaaagatttcctactcttgtggcaattacattctagaaagggagacagattaaataagcaaaacatagtatgtagacagtaataagcaggaaagggggagataagaattggtgggaaggaatttgaaattttaggtagtacccagggaagattttgctgaaaaggtggcagttgattattttggaactgagggaatgagtcatttgggtatctggcagaacatttctaggcagaggacacagcctgaggagaggccctgagtagaagctttcctagtatattcaggaaacagcaaggaagcctttgtgtctggagcttattgaaggaccggagaagagtttgaaaggaagtcagagtagaccacaacgggtagggcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagatttcggttcgaaagcccgtgtttatcacccccttccttagcctccaaagtgctgcgagtacaggcatgagccaccacctgatttttttttttttttaagaaaacttaatttcagccgggcacggtggctcacgcctgtaatcccagcactttgggaggctgaggcgagcagatcacctgaggttgggagtttgagaccagcctgaccaacatggagaaaccccgtctctactaaaaatacaaaattagccgggcgtggtggcacatgcctgtaatcccagctactagggaggctgaggcaggagaatcgcttgaacctgggaggcggaggttgcggtgagccgagatcgtgccattgcactccagcctgggcaacaagagtgaaactccgtctgaaaaaaaaaaaaaaaaaaggaaacttaatttctttttatttatttatttattttttattattatactttaggttctagggtacatgtgcataacgtgcaggtttgttacatatgtatacatgtgccatgttggtgtgctgcacccattaactcatcatttacattaggtatatctcttaatgctatccctcccccctccccccaccccacaacaggccccagtgtgtgatgtcccccttcctgtgtccaagtgttctcattgttcaattcccacctatgagtgagaacatgcagtgtttggttttttgtccttgtgatagtttgctgagaatgatggtttccagcttcatccatgtccctacaaaggacacgaactcatcattttttatggctgcatagtattccatggtgtatatgtgccacattttcttaatccagtctatcatttttggacatttgggttggttccaggtctttgctattgtgaatagtgccacaataaacatacgtgtgcacgtgtctttatagcagcatgatttataatcctttgggtatatacccagtaatgggatggctgggtcaaatggtatttctagttctagatccctgagtaatcgccacactgtcttccacaatggttgaactggtttacagtcccaccaacagtgtaaaagtgtttctatttctccacatcctctccagcacctgctgtttcctgactttttaatgatcgccattctaactggtgtgagatggtatctcattgtggttttgatttgcatttctctgatgaccagtgatgatgagcattttttcatgtgtctgttggctgcataaatgtcttcttttgagaagtgtctattcatatccttcgcccatttgttgatggggttgtttgtttttttcttgtaaatttgttggagttcattgtagattctggatattagccttttgtcagatgaatagattgcaaaaattttctcccattctgtaggttgcctgttcactctgatggtagtttcttttgctgtgcagaagctctttagtttaattagaacccatttgccgattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttatataaggtgtaaggaagggatccagtttcagctttcagcatatggctagccagttttcccagcaccatttgttaaatagggaatcctttccccatttcttgtttttgtcaggtttgtcaaagatcagatagttgtagatgtgtggtattatttctgagggctctgttctgttccattggtctatatctctgttttggtaccagtaccatgctgttttggttactgtagccttgtagtatagtttgaagtcaggtagcgtgatgcctctagctttgttcttttggcttaggattgacttgacaatgcgagctcttttttggttctatatgaactttaaagtatttttttccaattctgtgaagaaagtcattggcacctcgccatagccagatggtgtttcaccatgttgaccaggctggtcttgaacttctgacctcaggtgatccacccgcctcagcctcccaaagtgctgggattacaggcatgagccaccacgcccagcctattattattttttaagacagggtctggctctgtcgcccaggctgaagtgcaatggcacaatctcagcttgctgcagcctccgcctcccgggctcaagtgattcttccacgtcaacctcttgagtggctgggaccacaggcacgagctacaacacctggctaatttttgtatttttagtagagatggggtttcaccatgttggccaggctggtcttcaactcctgacctcaggtgatctgcccacctcagcctcccaaagtgctgggattacaggcatgagccaccacgcccggcctgatggcctgataagtgttttgttcgcatagtgcagagaggaggtaaatctggagaagtaattaaagaagggatattctacacagacataaagaatagcgtctctttgggattgaataactggctagaacttctctatcagttgaaatcgaagctataaatagatggtggtttagcgtgtgaaaaggtgcacaacattgttagtcattaggggaatgaaagttaaaaccacactgagatacctcttcatacctattagaatgtctggaatttaaaaattgaccattgcaagtattgactggaatctggagcagctgggaccggagcatcagcaccacactgatggtgggaatgtaactggtataaccactttggaaaacatcttgcagttccttaaaatgttaaatataccccagcactttgggaggctgaggcaggaggattgcttgaggtaaggagtttgagaccaccctgggcaacataacaagaccacatctccacaacaaatgtaaaaatgagctgggcataatggttcatgcctacagtcccagctaattgggaggctgcagtgggaggattacttgagcccaggagtttgagattgcagtaagccaggatggcatcactgcactccagcttgggcgacagagtgagaccctgtctctaaaaaaagaaaaaaaaaggttaaatatacacctaccatatgagctagctagcattccattcctagataaacgaaaaaaaaatgtgtctatacaaagacttatgatacatgaatatgcaagcagctttatttgtattatctagcacaccagaaacaacccaaatgtccactgacaaatgaatggctaaatcactgtggtaataggttggtgcaaaagtaattgcggtttttgccattactttttttttgagattgaatctcgctctgtcacccaggctggagtccagtagcacgatcttggttcactgcaacccctgcctcccgggtttaagcaattcttctgcctcagcatcctgagtagctgggattacaggcacacaccagcacaccaggctcatttttgtatttttagtagacaggggatttcaccatgctggccaggctggtctcgaacgcctgacctcaagtgatccgcctgcctcggcctcccaaagtgttgggattacttttaatggcctaccattacttttaatgacaaagaccatacttacttttgcatcaacctaatatatccacacaataggatacttgtcagcaacaaaaaggaattatttatatacacagtcacataagttaatctcaaaataattacactgagtgaaagaaacaagagggacacaaaagtttgaatgcatttatataaaattctagaaaaggcaaactaatctgggttacagaagacagattagtgagtgattgtctgggaatagggagggacgcacagggcagaggaagaattccaaaggggtttgggtgtaatgaatgtgtcactattagtctgtcacatacagactaatgtgtggtaaatgggattttattatacaagaaaatgtctggccaggtacagtgccttgtgcctgtaatcccattagtgggatgaagatttcaatttgccaccctggtatcttggtaaatcatagatgtcagatgtttacctttttttttttttttttttgagacagagtctcactctgttgccaggctggagtgcaatggtgcaatctcggctcactgcaaactctgcctcctggtttcaagcgattctcccgcctcagcctcccaagtagctgagattacaggcacccgccactacacctggctaatttttttattttagtagagatggggtttcaccatgttggtcaggctggtctcgaactcctgacctcaggttatctgcccaccccggccttccaaagtgctgggattacaggcgtgagccactgcgcctggcgatgttttcctcttttatgtttttaaaattttattgaaacaaaaaatagaggcagggtcttgctatgttgcccatgctgatcctgaattcctgggcttaagcaattcttccactttggcccccaagagtgttggaattacaggcacgaggcactgtaccttgccacacattttctcatataatgaaatcccatttaccacacattagtctgtatgcatgtctctgcagatagagaaatctgtaagcaagcccaccaacgtgtcacctgggtctctctagacactgccaggggttgtgtatttggaggaaggggcagctgagaccaagcagttaggtgatatctatatttctgtattgttcttgtggtttgtttttctttttcttttttctttctttttttttttacaaccaacatatatcaagttgccaaaaaaaaaaaaaatacaatttttctcgaaagaaaaaaatagtcccagcacggtgattcacacttataatcccagcacactttgggaggccaaggcaagaagatcacttgagcccaagtgttcaagaccagactgggcaacaaattgagaccctgtctctacaaaaaaatgagaaaattagctgggcgtggtggcatgtgcctgtagttgcagctacttggaaggctgaggcaggaggatcacttgagcccagtaggttgaggctgcagtgagccacgattgcaccactgcactacagcctgggtgactgagtatcctgtctcaaagaaacagaacaaaacacaaaataataaaataaataaaaggattgccttaaaagcatcttaaaatcctagaattaaaaaaaaaaaaaaaaaaacggaggaatagccaaaataagcaagctaacagtggttgctagagaagcattaaaagctggtgagaggcctggcttgagtaagctggggatgtctaagcaaaatacgaaccttttcattgaatgctggtgcatctttgtagattaacaaactcgtaggtgagttctttttattggaagaggactccgtctcatcttctctcaaggcagattttgaagaacccaaagagtgggaatcttggatggcaattagctcactaagaataagaaaacccaacaaaaacaaatatcttaaaacaatatcatacatagatcactcttatactcaaaagtatcttaaaaggacaaataagtgtttttgttattgaagcaggtcaagtttgagtagaacattatagattggaatagaatattataagttaatgcataccttttgcaaataagaattaaaataaggctgggcatggtagctcatgcctataatcccagcactttgggaggctgatctgggtggatcacgaggtcaggagatcaggactgtcctggccaacatggtgaaaccccatctctactaaaaacacaaaaattagctggatgtggccgggagcggtggctcacacctgtaatcccagcactttgggaggcagaggcaggcggatcaggaggtcaggaaatcgagaccatcctaacacggtgaaaccccgtctctactaaaaatacaaaaaattagctaggtgtggtggcgggtgcctgtagtcccagctactcggaaggctgaggcaggagaatggcgtgaacccgggaggcagagcttgcagggagctgagatcgcgccactgcactccagcctgggcgacagagcaagactccgcctcaaaaaaaaaaaaaaaaaaaaaaagagctgggtgtggtggcatgtgcctgtaatcccagctactcaggaggctgaggcaggagaattgcttgaacccaggaggcggaggttgcggagagccaagatcgcaccactgcattccagcctggtgacagagagacactctgtctcaaaaaaaaaaaaaaaaaaagaattaagacaaaattattaggtaaaggtaactatagaacaaagaatgttccccctaaaaatacaatgaaatgaaagttctaaagataggatcatctaaaagggagggaaaaattaaaacagactaattctcacaaaaaaaaaaaaaaaaaaaaagccggccagttgcggtgactcatgcctgtaatccccatactttgggaggccgaggagagctgaccacctgaggtcaggagtttgagaccagcctggccaacatggtaaaactccatctctactaaaaatacaaaaatcagccgggcatggtggcgcgcgcctgtaatctcagctactctggaggttgaggcaggagaatcgcttgaacccgggaggcagaggttgcagtgagccgagatcgtgccattgcactccaggctgggcgacaagagtgaaacttcatctcaaaaaaaaaaaaaaaaaaatggaaccaagtgcagtgactcgtgcccgtagtcttggctacctgggaggctgaggtgggatcacctgagcccaggagttagaggctgcagtgagctatgattataccactgcactccagcctgggtgatagcgagaccctatctctaaaaagagaaaaaaaaaacaacatggaataaggttatacttgtgaaaattttaggttttcagtttgtgagattgatttttgttaatggctttatttatttatttatttttgttattattggagatgggccatgctgttgcccaggatggccttcaactcctgaactcaagagatcctccttgctttggcctcccaaagtattgggattacaggcatgagccacctcacttggccaatgacctttttttttgagaccgagtcccattctgttgcccaggctgcagtgcagtggcataatcttgggtcacggcttcctccacctcctgggttcaagtgattcttgtgcctcagcctcccgagtagctgggactacaggcgtgtgccaccacgtccggctcatttttgtatttttagtagagatagggtttcaccatgttggccaggtcggtctcgacctcctgacctcaggtgatccgcctgagtttgacagcaaaagctgttctggaacagaccagaggcactagaactgcttccttccctgtaagctacaatgaagtgagaacaggctgcccccagtttctccctgcacgggtaaacctctgtttgtcaaatggaatgctggcacagatgtgaacattttagttagataataaagtaggtacgcaagttcttataatctatggaaaaagagaaaaacataattatctttctacttaatcacatatttgtcatgtgatatcttggcatccgtctctgctggcagaacaggcaatcacttcaatcattttaagtcggtgaggtcaaaagggccttgaaggaaactctgaatgtaaatctgaacttatttcatacgttaaatttaatcctctatgctcttaaaactatctgacataagcttgtcccttaatatatgagtgtccttgttcagtagtgaaaaataggcattgtgccctgatacttgcaattatccaaagatctttaaagaccaaatatgaatagatgacatttagcgtgatgaccgactttttaaaataatttgcaactggcagaatgactatctgcatgacttttaaacaattcaagtttctaaaagggccaaaggaaataaataaacaaaatacaattaaagagccaaaggatactccaaataattaagcactagaaataaactttaatcataaagtcctataaaagccaatgtaatgattaaaatacgcctctcaatatagaaacttcatcctttctgtaatttaagattaaagagctatgctttattttaaaatagcagacattattatgacgacactcacacacaagattcagctattccaacaataagacaagcctgaataaggcagcatatgccttattctcttaaattttcttctcttaaaaaaaccaataacttaccagcttgttaaatacaagtatcctctttcctgaatgattttcaaaaattaagaaagtctgggcaatgtaaagtctcaaacagatatgaaatgaatgaacacaaaggcaggcacggtcggatatgtaaatatactaagtgaccctggataagagctgagagatgctggatgcggtggctcacacctgtaatccccacaggtgaaaagattgcttaagcccaggagttcgagaccagcctgggcaatatcgtgtcacctcatctcaatttttaaaaaaagagccatgacaaatgtttttgaaatagagtctcactttgttgcccaggctggagtgcagtggcaccatcatagctcactgcagtctcaaactcctgagttcaagtgatcctcccacctcagcctcccaagtagcttggactacacgtgtttgccacccatgcccagcaaattaaaaaattttttttgtagagatggagcctcactatgttaaccaggctagtctcaaattcctggactcaagtggtcctcctgcctcagcctcccaagtactgggactacaggtgtacaccaccatgcccagctaacttaaaaacaattttttaaaaatgtgtagaggccaagtgtggtggctcatgcctgtaatcacagcaatttgggaggccaaggtgggtggaccactggaagtcaggagttcaagaccagcctggccaatatggtgagaccccatctttacaaaacttataaaaattagctgggcatggtggtgtgtgcctttaatcccagctacttgggaggctgaggcaggagaatggcttgaacccaggaggcggaggtttcagtgagccaagactgcgccactgcactccagcctgggcgacaaagctagactccatctccaaaaaaaaaaaaaaaaaaaagtgtagagatagggtctcgttatattgcccatgctggtctcaaactcctggcctcatgtgaccctcctgccttggcctcccaaagtgctagaattacaggcatgagccaccacaatgcaccaagagacatttttatatggggtctaggtaatgccatctggaccagaaatggtcagcgtgtcagttcagaatggcttctggggtgaggaatgctctagggtggcgttccactctgtgcagcgatccacccgtttgctttttaataaagcatatctgcccaagtcataacaactggttttgtttttaaacaaaacctttgcctcagaagccgtcctcagtataaacacatccctggaacctaatagagcctctataattaaagactcaacagtccatgctgtgatgaaaagagggaaccattggtcctaaggaagatttctgttagcaaacatgccttttggattaatagtaggtatggcgtggcttccatcaccctttgtatttccaaatactggcatgcatgctccgtgggtgtttacagatgtgaacgttactcaccttgccggggagtcatgttgtgtgccacagatgctttctgaacaggtgcacccagatttgaggcggacaattctctgcattttggaaggcttgaaaatactcatccactccacgtcagacatgtggcctggggcttcaattatgaagttactcgggtggcagcacttggagtcacacatgccactttcgcccagacaggcttcatttttctggcagcatgagatttcggacctttccatctgatcttgacattctacatccagcttttctggatgttttgaacttggacagttggtcaggcccaggtaaacactgacatcatgccactgcttctcatcagataaagtgggtgtttctgagggttgttttccttcgttctgaaccccagtgccatgacattttggtgattttgtgtggatcttgcacaatgtaattttgttttcgggttcaatctgggtttttcctcccagagaccaagggaggttgtgtttctctactaagtctttggtgaatatggatgacagcgtaattacacttttctccccaaacacagtatcgatctgttgtttcttctctttgcattcatcgcaagagctcttgtctgacctattttgctgaaccaacatggcttcaaatttctggtccttaaacagtgacttctgatttttttccctcttaatatcgacttttgggtggttattttcaaggtctgataaacacatgtctctgctatggtggcattagaaaaaaaatggaggttataagatatacttgatgctatcattctaaacatttcacccaaaactcagtagagctaaatcccaatgagactcgtttgtctgaacctcagagcccaattccagcccgaccttctccaggaatcctttctgaccacaaagcccacattcccttttccatcctcctcttattgcacttactgtctacatgagaaaaaaagaatactgcagaaatgtgacaaaaccttttaataaatcttcctttaaaatttttcatgtcacttgtattcaggtattctaatctgcatcattctgatatcttaggaaatacaactctctctttccataatgctataaactattttatgcttaaaaaaaattttttttgaggccgggtgcagtggctcacgcctgtaatcccggtactttgggaggctgaggcgggtggatcacctgaggtcaggagttcgagacccagcctgaccaacatggagaaaccccatctactaaatatacaaaaattagccgggcgtggtggcgcaggcctgtattcccagctacttgggaggctgaggcaagagaattgcttgaacctgggaggtggaggttgcagtgagctgagatcgcgccattggcactccagtctgggtgacaagagtgaaactccatctcaaaaaaaaaaaaaaaattttttttttatagagacagggtcttgctatgttgcctaggctgctcttgaactcctggcctcaagcaatcctcctgccttagcttccgaaagcactgcaattacaggtgtgagccatggcgtccagcctatttttagcttttaaggaataacctcaactcatctagtacctcctagaggcaatgaaggtcaaaaaggagaaagacagccttcgcaacacgacgaaaccccatatgtacaaaaaaaaaaaaaaaaaaaaaaaagtagccgggcatggtggcgcatgcctgtgggcccagctacttacttggaaggctgaggtgagaggatcgcttgaacccaggaggtggaggttgcagtgagctgaggttgcaccactgcatgccagcctgggcaacagagcaagaccccatctcaaaaaaaggaaaaagaagaaagagccagtatgtaaggggcttctgcctgcaagagagctctgagttagtctggtgtctggtggcagcggcagcagctaggacccagagccacaggccacaacccctcgcagagggccccaaaggaaagtgaagcaagtgcagcggaaagcagggcggccccagccacacgccacacgcctggggtgatccctgcagtgctgcagctactaagccctgctgctctcaactccattctcccagggaaagtcgctgctgcaacccagtccagcctccatggttccaaacagccatggggagcttccctaatccctctccctttcaaagacttcttgtaaaattttggcttagaaaagtagactaagttgagctgtggtacagttatatgcctgttaaattaaaccacactttatatgtttatattttaattttaccaaaaccaatttaattcccacactgcttgttgtggggatgggaagatgtttcctattaataaggcaagcaggaaaatccagttaagggcacagatcaccctcggtggagtggggctcctactcagtaatcaatgcattccttggcattacttcttttgggcaagtgccatgccctatatacctacatgtgcccaagtcctagcctagtgtccaaacactgaatgctggatggatggatggacggatggatggatggatggatgaacgaatgattcatctctgtagtgtctattctagctcaaagccttctacacaacagaagggaaaatcaggttaaataaatttacttctatccagtggctaaatcaggatcatgactaaaattcttagattgggtcttcctgcgactgaggattatgacaatcattattagctcacacacatttattgtatttatttattatttatttatttatttttcatacggagtctcactctgtcacccaggctgaagtgcagtggcgcaatctcagctcactgcaacctctgcctcccgggttccagcaatcctcctgcctcagcctgccgaatagctgggactacaggcgcctgccaccatgcctggctaatttttttgtatttttagtacagatggggcttcaccgtgttagccaggatggtctcgatctcctgacctcgtgatccacctgcctcggcctcccaaagtgctgggattacaggcatgagccaccgcgccaggcctatttatttattttttgagacggagtttggctcttgtcacgcaggctggagtgcaatggcgcgatctcggctcactgcaacctccacctccggggttcaagtgattctcctgcctcagcctcccaagtagctgggattacatatacccgcgaacacgcccagctaatttttatatttttatttatttatttattttgaaacagaatcttgctctgttaccaggctggagtgcagtggcgtgatctcggctcactgcaacctccacctcccaggttcaagcgattctcgtgcctcagccttgcaagtagctgggactacaggcatgagccactatgcctggctaatgtttgtatttttagtagagatggggtttcaccatgttggccaggctggtctcgaactcctgacctcaggtgacccacctgccttggcctcccaaagtgctgggattacaggtgtgaggcaccgtgcccggccacatttatttcctaccatatggggaatagtagtcagtactggccaacagtaagtgcgcagtaaatactggctgatggaatataatacaagatcatattaattgcatcttgctaagattacctggagtccagagcctttgattcctccatctttgagtcatacatctgtattaattcctgagaattttccacattgaaattaagaaactgcagatcactctgttgttttacataaatctgtcatagatattgacaaatcaacatgaaatgtaataacaaaactaaactgaaccaacaatttggcactttccctgaaacagttcacaaatcctaaaacaggtcagatagttactagagaaatatgctaaatatgtctgcttttaattttcctttgttagcactaagatttgctaggatagctgggctcccagcctttgatcaccacaagcaagacctatttgctatactaaacatgatatacaggctgggtgcgctggttcacgcctgtaatcccagcactttgggaggctgaggtgggcgggtcatgaggtcaggagttcgagaccagcctggccaacacagtaaaaccctgtctctactaaaaatacaaaaaattggctgggcgtggtggtgggcacatgtaatcccagctacttgggaggctgaggcaggaggatcgcttgtaactaggaggtggaggttgcagtgagccgagatcaggccattgcaccccagcccggttgacagtgcgagactccgtctcaaaaaaataataataataaaaataaataaacatgatatacaactaatgtagttaggattccaaatcaccaattaaacaaaatcgacgggcatacatttttcctaatttgctatttgtttacaaacatttcttatgtgacagagaaggatgattggggacatacctgtctcagattgtgcagttctgaatttgtgcgttcttgctttgacttcgcaatattaagcaattcatctttcctcttttctctctctactatttaagaacaagtattattaacatttttcatcagctatagccacacaaacctctccatttccaacaatttaatgctcagctaacatttttgttgttgttgttcctgtacttaaaaatagcagaatgggctgaacgaagtggctcacacctgtaattgcagcactttgggaggctgaggtgggtagaccacttgaggtcaagagttcgagactggcctggccaacatggtgaaaccccatttctactaaaaatacaaatttagccgggtgtggtggtgcctgcctgtggtccagctacttgggaggctgaggcaggaaaatcatttgaacctgggaggtggaagttgcagtgagcagagattgcgccactgcactccagcctggatgacaaagtgaggactttgtcttaaaaaaaaaaaaaaaaaagaagaagtgatttgtagattcagggattatttgtctttccttttgtggggagatagaataaggatgatttccaaatctctatacttaatacatattacttcaattatttatttaaaaattttaaaagataaaatatttttaaaaatagagatgggggtctcactatgttgcccaagctggtcttgaactcctgtgtttcaccatgttagccaggttggtctcgaactcctggcctcatgtgatctacccgcctcagcctcccaaaatgctgggattacaggcatgagccaccatgcccggccaaaactgagacattttaacagtggaagtgatatccgtagtgcatctgactccgtgggtctcaattctacatgcctttcatgttaacagcatccaagcagggtttaaataaacctgttttgttatatttcctaatgtttaaataaacctgttttgttatatttccagctactttggaggctgaggtgggaagattgcttgagcccaggagtttgagaccagcctgagtcaacacagcaagacactgtctcttaaaaaaaataaataaatacttgttttggatacagcatggtccctaaacaaaagccaactactttacctggccctcagagtaattttaaatatatctgaatgttggccagtggggttgtcggggggcggtgggggagggcaggtggtcaaagaaaaaaaaaatatatgtatatttgaatgttgccttaatctctgatttcagaataatctacttttgcataagaggcaatgccaatgtaaatataaatgtttccctagtccagatagttttctccatggctgggtttagctgagagatcaaagtggattgggtctgactattttcacaagttggccacagaaaacagaggtaaggaactctctgctgctatctgcctgaacaagcagcctaagctaaaacaacgggaagggacttagacgcctggaacctgctgaattctgatcaagactctgccttttaccgcctgggagacctgaggcagacactcagtctataagagctcacctacaggactgtcaggacccacagaaatgtaaactagtatcattgttctctttgcaaactccttactcctagttatgtacaagcaaaacatgtccctcagcctatgtaaaagaacacgcctgtaatcccagcactttgggaggccaaggtgggcagatcatgaggtcaggagatcaagaccatcctggctaacacggtgaaaccccatctctactaaaaaatacaaaaaattagctgggcatggtggcgggcgcctgtagtcccagctactcgggaggctgaggcaggagaatggcatgaacccaggaggctgagcttgcagtgagccgcgaacgcaccactgcactccagcctgggcgacagcgagactccgtctcaaaaaaaaaaaagaactgcattttctacaagttttaaacttaaaagtaaaactttaagacatcttccaacttcaaataaaacatggtaacatctgactgggtgcggtggctcacacctgtaatcctaacactttgggaggccgaggcgggtggattgtctgagctcaagagttcgagaccagcctgggcaacacaatgaaaccacgtctctactaaagtacaaaaaattagccaggtgtcgtgacgtgtgcctgcagtcccagctactccggaggctgaggcatgagaattgcttgaacccaggaggcggaagttgaagtgagacaagatcgcaccactacactccagcctaggcgacagaccaagactccatctccgaaaaaaaacaaaaacaaaaaaaatcgtgacatttagccatagcacttgacggcatattatcatgttatgccctttaaaaattcttttttgggcttaagccaagcacgatggctcatgcctataatcttagtactttgggaggccaaggcaggaggattatctgaggctaggagttcaagaccagcagcctgggccacatagcgagaccctgcctctactaaaaataaataaaataaaataaaattagctaggtgtgatgacacatgcctgtagtcccagcaactcaggaggctgaggtggcaggatcacttgaacccagacagtcgaggctgcagtgagctatgattgcaccactgcactccaggctgggcaacagagcaagaccctgtctctactaaataaataaattcttttgtaggctttgttcacttttataattgaaacatgcaaatctaccaattgtctatattttgaaaaagaagaataaaacatacaaaaattgttttcagacaatggtgtgagattgtctttagttaagaagatgtttaaggaatcaatttaggatgacaggcatggtggctcatgcctgtaatcccaacgctttggggctttgggaggcagaggtaggaggatctcttgagcccagcagttccagaccagactgggcaacatagtggaacctcatccatacaaaaaatttaaaaattaggcatgtgtgatggcatgtgcctgtggtcccacctacctgggaggctgaggtgggaggatcacttgagcctcagagtttgaggctgcagtgagctgcgattgtaccactgcactccagcctgggtaaagaaatctgcttagtatatgataaaaatatttcacaaaatcgatttattataatattagctaacaaattccatgtattttacttagtaatacatagtagagtgcatgggtaaaaagtgattaatcaaaaagaaaagagactaacgtatcctttaagctttgttctttcctttgacctcccatagcattttatgcatagcatttgtatagtagtgaattctgtgggcctgtgagcttctgagcatatcgcagggcacctggcgtacaaatgctggtccaaggactgtttgaatgcaactgtaaagctacaaatatgtgatatctttagcagcgttaacgggttatcactacttgcagatgcagcaatcctagaaatggtgaaaatagtgacctctagtggcagaataccacactttcaccccgatctttaatcacaagagattaaaattaagaattccatttcacttaaaacttcttaggtcgggcatggtggctcgcacctgtaatcccagcattttgagaggccgaggcaaggggatcgcttgatcccaggagctagagaccagcctgggcaacatagtgagaccccttctctgcaaaaaaattaaaaatttagccaggctactaggaaggccaaggcgggaggattccttgagtccaggagtttgaggctgtgatgagcctcaatttttttcccattaatttacagacaaactgcattccattccctgccatattccttacctacccccagtatctcagagtttccactggtgaaggcctacttctccactcccaactgagaatgactgacatagagagcttgttgacatccctgccagccaagatgattctactgggctttcttttcagtggtttgtgttaggaaagtcattgatttagaggtaaagttccgaagagaaaatcatatgaacactttttggtctactgatacctaccctcagtcccccttttactaggggtacacattcattaaaaaacccctactctgagcacccatacaaccattctgtttttcgctttcagtaaattacatgatatattcaacaatttattataaaacagcctttgtgtgagatgatttcgtccaaatgcaggctaatgcgagtgttctgtgcatgtttaaggcaggctaggctgagctatgctggtggctgggttggcttcattaaatgcatttttgacttgcgaggggtttatcagaatgtaaccctgtaagtcaaggagcatctatgttatgtttttagtaagaagcagagtcacacgcttaagctggaagggagaatagctcattttacagaagaggaaatagtgactgggaacgggatggcagcattaacactcgctgcttggtccaccatcggtcccacaaagggtgttaaaaacaaacaaaaaggcctggcgtgatggctcatgcctgtaatcccagcactttgcgaggctgaggcgggcggattatctgaggccagagttcgagatcagcctggccaacatggtgaaaccccgtctctactaaaaatataaaaattagccgggcatggtagcacgcgcctgtaatcccagctacttgggaggctgaggcaggagaattgcttgaacctgggaggcagaggttgcagtgagccgagatcatgccactgcattccagcctgggcgacagagtgagactctgtctcagaaaaaaataaaaataaaaaagccgggctcacgcctgcaatctcagcactttggaaggccaaggcccgtagatcacttgaggttaggagttcaagaagaccagcctgaccaatgtggtgaaaccccgtctctactaaatatacaaaatttagccgggcatggtggctcataccagtaaccccagctactaaggaggctgaggcaggagaatcgcttgggcccgggaggcagaagttgcagtcagacgagattgcaccactgcactccagcctgggtgacagagcaagaccctgtctcaaaaaagaccctgtctcaaaaaaaaaaaaaaaaaaaccattttgggagaggtataattccttcagcctgtcatcattgcaagtctaggttacaaatacattcgatcatctgttttaccagtaaaaagcaattcatcgtgcaggcaacttttctcttgcttgaggcgaatgatctcttctcgttgctcattattttctgtcgtcttttcattgaggtcctcttcacaacagaagaaaaagaaagtcctcaaataaatactaggttccagtcctcatatacacactatgcctaactctcacatcctcagcggctccttccggtcctgatggatctatagacaaaatctgtttcacagccaacatctccacacctggcaaggacccctggttggaggcttcgcttgctctcatctgactgacctccctgcaccagccttgcctctcctgtgacagcccagtgtacacagagcaatcttttaaaaatcaaaatctgcccagcgcagtggctcacgcctataatcccagcactttgggaggccaaggcggacaaaccacttgaggccaggagttcgagaccagcctggccaacatggtgaaaccccgtctctactaaatatacaaaaattagctgggtgtggtggcacacacctgcaatcccagctactcaggagcctgaggcaggaaaatcgcttgaatccaggtggcagaggttgcagtgagctgagatcacgccactgcactcaacctggacaacagagtgagactccatctcaaaaaaaagtaaagtaaaataaaaataaaggccaagtgcagtggctcacacctgtaatcccaacactttgggaggctgaggcgggtggatcacctgaggtcaggagttcgaaaccagcctggccaacctggtaaaaccccgtctctactaaaaatacaaaaattagctgggtgtggtggtgggcgactgtaatcccagctactcagaaggctgaggcaggagaattgcttgagaggcaggcgggggttgcagtgagctgagatcgcgccattgcactccagcctgggcgacaagagtgaaattctgtctcaaaaataaataaataaataaaactaaaaataaaaatctgctcgtgtcatttctcagtgagaagccttgctactgcactgaggatgaaatccaaatccattaccacaaactgcagagcccagcatgacctgacctgcccatctccccaccgccgttccctcctttccttctgttccttgagtatgtctgtggtataagaagaaatagatgtggtttttgtcctctgttcctggagaacagagctcctaaaacttgtgccgttggtaagtgacagtagcttcttttgtcattcatgcagagtcagttgattactccagactacatgctaacgaggtgactcagggtggtgctcctacgtggcctcatgatgcagacagccaccagagctcactaagtgaagacagggctggaacctgcagtcccacttgtggacctccaggaaggggagggagggctggagattgagctctataaaaattcctcttctttttttttatttttttgaggcaggatttngtcntttgcccaggctgaagtgtagtggccaatcttggctcactgcaacctccacctcctgggatcaagaaatcctttcactttgcctctcgagtagctgggactacaggatcacaccaccatgcctggctaattttttgtagagacagggttctgccgtgttatccaggctggtcttcttgaagtcctggcctcaagcaatctgcctgctttggcctcccaaagtgctaggattacagatgtgagccatcatgcccagctcctattatgtacatattagttcttcgggaggaaggatatcctcccacccttnnntttttttttttttttctttttttttgagacggagtcttgttctgtcacccaggctggagtgcagtggctcgatctcagctcactgcaagctttgccttcccggttcacgccattctcctgcctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggggggagactcctggtcagatgagcactgcaactgcatctgttttttaaatcagattgggggacgggcatggctgtatccagtatcagaggcgagcaagaaatagcttgacccaggaggtggagtttgcagtaagctaagagggcaccagtgcactccagcgtgggtgaatgagcgagactccgtcttaagtaatataaaaaaaaaaaaaggacaccaaaatgctagcagaattgtttctgggtagagaggtcacgagtggtttttccagccagcttcattatattcattctgtactttccattttttatatgattgttattaaataatcaaagaagaccgtccggtaagaggcagaagccaattgagtacttttgcatgctaagaatgagtatcattatgatcacactatggcggagtacggttaagcgatgtatatcaaaaaaaaaatcagcgtgtcagattcaattgactatcctacatcatcttccagattagttgggagtacaggtgcccacccccacacgtggttaattttagaatttttagtagagacggggtttcaccatgttggccaggctgatctcagactttggacctcaagtcacctcccaccttggcttcccaaagtgctgggattataggtgtgagccaccatgccgggctcaaaaaaccagtcttacagtttttattcccaatatgccactaacattatgagataagacacaataattggctgggcacagtggctcacacctgtaatcccagcactttgggaggctgaggcgggcggatcacctgaggtcgggcgttggagaccagcctggccaacatggagaaactccgtctctactaaaaatacaaaattagctgggcatagtggtgcatgcctgtaatcccagctactcgggggagtgaggcaagagaattgtttgaacccaggaggcagaggttatggtgagccgagatcgtgccattgcacttcagcctgggcaacaagagtgaaactccatctcaaaaaaaacacacaataatttagaaaacatcattgaggctaccaaaacttgattataccctctcatctttgaggaaagctttctaaaataactcattgttgattaaatggtagatgctactaaaccaaatggcataacggttaaaaagcgttgtactgaagctcaatctctaagacaggataatgccgtgcagctaaccaaaactgtaggagaaacacaaaactacaaggggtggatgagtgtagataccttcgtacacacacgtatgcatttttgcattggttgcttgctgttgttgttttttgttgagatgaggtctcactatgttgcccaggctggacttggactcctgggcccaagcaatgtttctgcctcagcctccccagaggctgggactacaggcgtacaccactgtgcttggcttacatacgcttttttttttttttttttgtcacccaggctggggtgtagtggcacaatcacagcttactgcagccttgacctcctgggctcaagtgatcctcctgcctcagcctcccaagtagctgggaccacagcagtgcacccccacacccagctcatttttgtatttcttctttttatagagacaggcatttgccatgttgccaagcctggtcgcgaattcctgggctcaagcaatcctcccacctcagcctcccaaacaaagagctgggataacaggcatgagccaccaagccactgtgcccagcctcacatgcatttttaatgaaacatttaaatctaatttttcttttttctttttttttttgagacagagtttcgctcttgttgcccggactggagtgcaatggcgcgatcttggctcaccgcaacctccacctcccgggttcaaacgattctcctgcctcagcctcctgagtagctgggactacaggcgtgtgccaccacgcccagctaattttgtatttttagtagagatggggtttctccacgctggccaggctggtctcgaactcctgacctcaggtgatccacctgcctcggcctcccaaagtgttggcattacaggagtgagccaccgtgcccggccaaatctaatttttcaataactgaaacacaaagggaatttggactagtgaagcttatcaaaaactaatcccaacctcaaggtcttcagagagaagagaagaatgcgttgccttttgagccatttcctgaagctgtagttgggtcttttggagagctgtttggcattccatttgattggattcaagagcttttaccttcttcgtgagtgacctgattatttcagttcttttatgtagttcacctgagggaagttcatcaataatttgtagtcacaccttcagcttaaaaggcattattttcaaaatgggtggttaaaaggtaaaaatgtggtagagaatttttaaaaagacaatcttcttttaaaaccttttattatgaaatgcacaatatcacacctaatcaagaaacagaactgtgagcaattggaagcctctggaggtcacttcccgaacataatcactccagtttccgcgttcccaaccatgaccctgatcttagagtaatcacttccttgctttccattacagttttaccagtgaccacatgcctcaaaattatagcttaatttgaaccatataaaaatggaatcatattctgacaattcttctgtttgctttttttgcttaagataatgattctgagattcactcagttgtgtgtaacttgtgtttgtgcactaacattgctaggtaatattccactgaatgattacgccaaagcttatttctattttttattttattttattttattttattttattttattttattttattttattttattttatttttgagacagagtcttgctctgttgtccaggctcgagtgcagtggtgcgatctcggctcactgcaagctctgcctcctgggttcacgccattctcctgcctcagcctcccgagtagctgggactacaggtgcctgccaccacgcctggctaatttttttgtatttttagtagagacggggtttcaccgtgttagccaggatggtcttgatctcctgacctcgtgatcagcccacctcggcctcccaaagtgctgggattacaggcgtgagccaccatgcccggccttcttttttttttttttcgttgagacggagcctccctctgttgcccaggctggagggcaacggcacgatctcggcttactgcaacctccacctcctgggttcaagcgattcttctgcctcagcctcccaagtagctgggattacgggcgagcaccaccatgtctggctatttttttgtatttttagtagagatggggtttcaccatattggccaggatggtcttgatctcctgaccccatgattcatcctcctcagcctcccaaagtgctgggattacaggcgtgagccaccgtacctggcctaccaaagcttatttctaatattgatggtcatttaggttatttccactttgcagctatgataaacaatgctgctctgaatattcttttacatgcatcttttttttttttttttttttttttgagacagagtctcgctctgtagcccaggctggagtgcagtggtgtgatctcagctcactgcaacctccacctcccaagttcaagcaattcttctgccttagcctcccaagtagctgggattacaggcatgagccagcacaccctgctaatttttgtatttttagtagagacagggtttcaccatgttggccaggttggcctcgaacccttgacctcaggtgattcgcctgactcggcctcccaaagtgctaggattacagatgtgagccacagcgccaggcctttttacatgcatctgggtgcatattttcaagagtttcttgagagccttgcttctcaaaatgtggtccctggaccagcagcggcagtggcatcgcctaggatgcctgttagaaatgcagacccttgggccccagacctattgtatcagaatctaaattttaacaagacccttaggtgattcatgtgtctattaaagggtgagaatattcctagaagtggctttgctgggctgtaggatatgcacaccttcagcttcactagatgctgccaaatgattttgcacactagcagtgacaactgactcccaccagcagcgtctcagctttcccttggtgccatactttaccaacacctgataatttctgccaggctggtaaaggtaaaatagtatctcaatttggttttcatttgcatttccctaactactaatgagaacaggaaacttttaatatatttattggccattcaattttcctctttccatgaggtgcctattcaaatcttgctcattttaaaatcaaatactgatggctacatataatgtgggttatatatgttatatgtgttatctttgttctttaacatgtctatataagagctataagatgttatactgcatttaatgagcaaccattttaaacactgtgtgtatatacgtgtgtgggtgtggtcagagtaaaatcagatggtcatcaaagaaacgaaaaaatcatatatttgggttttttgtttgtttctttctttgttttgacggagtctcgctctgtcgcccaggatggagtgcagtggcgcaatcttggctcactgcaacctccacctcccaggttcaagcaattctcctgcttcagcctcctgagtagctgggactacaggcgcccaccaccatgccccgctaatttttgtatttctagtagagacgaggtacaccatgttggctgggctggtattgaactcctgacctcaagtgatccgcctgcctcagcctcccaaagtgctgggattacaggcatgagccaccgcaccccaccaaaaatgacagatttggattgtcacatttacagaatcctttgagtaatgttaagtaaaaaaaggttatctttctattatacagatctagtgttttctcctctaatgcattctactaacaatctagagtcaatggaacattcagatttagggcagcactaaaggaatgacagaattaaaatatggtgtcaaataaactttttgcaaccatttttgagacagctataatttttttttttttttttgggacagggtcttgttctgtcccacaggctggagtgcagtggcgcaatcttggctcactgcaacctccgcctcctgggttcaagcgattctcgtgcctctgcctcccgagtagctgagattacaggtgtgcatcaccatgcccagttaactttttgtatttttagtagaaatggggtttcaccatgttggccaggctggtctctagttccagagctcaagtgatccgccaaagtgctggaattacaggtgtgagccactgtgcctggccggacagctataactttaaaagatgaccattttaggaacttaagatcaagttcaataccaaaagcctaaaatctttcagtttagtttaagagaaatggctagtcatatggcatcttcattcatactcttgctcaaaacttcaacttcaccactggcgctcaccccatgttgactggagctccatccagccccctttctatactgaaatactttgcttgtcctactttatttgtgtgtgtctgtcccattgtggctgttcataaagtcctcctgtctccaatgagcctaaacttgaggacaacagggattgcagtctttacttcctctctatcttccctatgagcccatcaatgtgttagcacacagaagtgcataactgttgtccctgaatgtatttctgaccttctaatttgctgcaacgttcttccagtgtcaacactttctgccgatcctcttcccatgaaagaagctgttgctggtgcactgcaaccatgtcattgagctctttatctcgatcttttaattctccaatgagcaactgcagctccttccgttgtttctcgatagtggaaatctcaacttctgacccgatgttctaaacatagaaagcggtttcacatcaaaatagaatgaaatcaataacaaatcagccaaagtccattttccaaataagtatatcttcttttgcggccaattctaagtagttcaattaagttttaataacatggcagcaaaagattatgtatacttaaaacatgttcaagttaaaatctaccatgcactctgcctctctacaattttctgtcatgccatacgtaccatgcctaaaaagtgggactgtttctaaaacccactgggtaaacaaataaacctatttctgcactttttctccccctttgccaacaacccttttctctgccagtcaataacattatcccctaccttgccccagcaatttgagtaaccaagtacaggtaaacatgaaatagtggccaggcgtggtggctcacgcctgtaattccagcattttgggaggtcaaggtgggccgatcacctgaggtcaggagttcgagaccagcctggccaacgtggcaaaaccccatctctactaaaaatacaaaaattagctcagtgtggtggcatgcgcctgtaatcccagctactcaagaggctgaggcaggagaactgcttgaaccctggaggcagaggttgcagtgagccgagatcgtgccattgcactctagcctgggcaacaagagcaaaactctatcaaaaaaaaaccaaacaaaatcacgaaatagttactgtttaaatgtaaatgatccttactaaacaatgggaattttagtctataaaaagaaaattaagtcttccagtgttcaatatgcatgacaactacaacatctaaggcatctatacatactcaatctattaagggcaatttaatattgtaactgatccaaatacaacatacatcattaaaaaataaattatgtaaggaaatctttcacatgtacccaaagacaatagtacgataaactcccatatactctgtgcctgggttctaccattattgagatttcactgcggctgcttcaatgtccttttcttttcattattggttaaaaaataccatttcacccttacatacttcagaatgcatctctaaaaatgaacatttcctatataaccatgatgccatttttatatctaacaatattatctattaatacaataatttctttgaagtatacagcattttaaaatctaacaagttggcctgaccaaattgtgatcccagaattagccacttagtggctacataaccttgggcaagttacttaacttctctaagcattagtttcctcacctgtaaaacgatagcaactgcattttaacatcttggagtggtgaagattaaacaagacaaactctgtaaagtactgagcacaaagcctggcccgttgtaatcactcaacaaacatcagctctcattaacactgtaaaccacatttcaaatcatggtgctgtccctgcctatgaaataaacaactaaaagtgttactttaatagagttccaccttaaagacagtaattaaaggttcaacagaggccctttgtacctccttactgctttttgaaaagtaagatttgtaaataaacaagaataatgaggttgggctcagtggctcacgcctgtaatcccagcactttggaaggccgaggtgggcagatcacctgaggtcgggagttcgagaccagcctggccaacatggcgaaaccctgtctctactaaaaacacaaaaattagctcggcatggtggtgggagcctgtagtcccagctattcgggaggctgaggcgggaggattgcttgaactcgggaagcagaggctgcagtaagccgacattgcgtcactgtactccagccctggggacagagccagaccctgtctcaaaaataaataaataagaatgatgaataaattacagttgctagtcttaacaaggaaaatggaatttggagtcaagggatttcaagtcccaaggcttgaattccagtgttgggttagcccttcattcatgcactcaacaaataatttattgagcgccagtggctgggccacagacctccaggcaaggagcacatattccactccaggaaaacaggcagtaagccgagtacacaaaggcaggtcgtcttacactgatggacgcgaaccttgggcaagcccacttccagactttttggtacagtggagttgtgagagctccttcctctactcgccaggttgtgtaaattaaggacaccctgagaggtaaatgggaaagcagctccccagacgccaatcgtcctccttaaacagtaagcaccgggtacgcgctactctgtggcccgggctgaataacaaggtgttattgggttaaggaaacggtcgtgacgccgttttcctctagtgtattgtttcacttttttttttttttttttttttttgagacggagtctcgctctgtcgcccaggctggagtgcagtggcgcgatctcggctcactgcaagctctgcctcccgggttcacgccattctcctgcctcagcctcccgagtagctgggattacaggcgcccgccgccacgcccggctaatttttttttttttatttttagtagagacggggtttcactgtgttagccaggatggtctcgatctcctgacctcgtgatccgcccgcctccgcctcccaaagcgctgggattacaggcgtgagccaccgcgcccggcctgtttcacattttaagtagacaccgttcttgagaagcaatagatttcgaccaatgtgcaccgttcccgcggcgccccgccgcgcccggaaccgctgcttacctggcgcccggcaaggaaggctgccggagggttcataggtgtttcctccgcccccggagaagcccggtgtgggcggcgtcacctcagaaacgccatcggcgcgcctgccccgagcggcgggggcgagcccggagccccggggccccgcgccctcggccgacccccgccccgtactccaaccgcctgcctggtgcccacgcggcgtgcgcccgccggggctcggggctccccgccagggtttccgggccgcagccccgctgcgctggtgggcactgttcttctgcctcggaaactgggggctcccaagtggctcaggctgcgtatggacgctttttgcccacgcccgaggctccggcgctggaaggcctgaaagaaccggctgttcaccactacccagagaatgaagaagtcaataaaggctgctgcgccgcccccagcactctggtttatgacatttgagttgctcacttccctatcttccatcttccccctaataaccgtgagctcggccgtgctcgctcctgtgtagctggctcccagaacaggacctgacactcgaatgcgtggaggcagagcccagccctcggggataacagttgcgggctaccctagcacctttgatactttaaaccaagaatcacagatgaagagggggaaatttactcttgggggctcctgaaaagcaatgaggagaaccacggtactttgtcatgacaaaatctacgatattctgggttgaatctaagctttttcacctgttcttccatagtcacctcttcatccccctttcactcttcctaagatgtgggaacgggactaggaaaaaataaggcttatcacacttcagccccggctgcccatccctgaatgcttaacccatcagacagcaacacaattactaaatacggtcggtcttacagggtttcaactttactttttggttgaatatgaaatgccaaaacatgcccttgtgttcaaaaaatacaatctgaaaatggaaaaacaaaattaagatttcttattttgaagctttactgataggctcatgtttgggagaccaaagcaatgtcttagaatttaaaatcaagaaagctgggcgcagtggcctgtaaccccagcactttgggaggccaatgtaggaggatctgttgcgttcaggagtttgagaccagcctgagcaacatggtgacacccacctctaaaaaactttttttttttttttttttttgagatggagtctggctcttgttgcctgagctggagtgcaatggcacaatctcggctcactgcaaactctgcctctggcctcaagcaaatctcctgcctcagcctcccgagtagctgggattacaggtgcccgccaccacgccacctttgttgtatttttagtagagatgggtttcactaccttggccaggctggtcgcgaactcctgacctcagttgacccacccacttcagcctcccaaagtgctgggattacaggtgtgagctaccgcacctggccaaaaaataaatttttttttaaactgggcgtggtggtgcactcctgtggtctcagctactcacgaggctgacttgagctgggagatggcggctccaatgagctgtgatcatgccactgcattccagtccgatcgagagtgagaccttgactcaaaaaaacaaaaatcaggccagacgtggtggctcacgcctgtaatcccagcactttgagaggccgaggaggatggatcatgagattagaagtttgagaccagcctagccaatacaacgaaaccctgtctctactaaaaatcaaacaaacaaacaaacaaacaaacaaacaaaaactagccacgtgtggtggtgcgcacccatagtcccagctactcggaaggctgaggcaggagaatcgcttgaatgcaggagacggaggttacagtgagccaagactgcgccacctcactccagcctaggcaatagagggacactccgtatcaaaaaaaaaaaaaaaacaaaaaaacaccaaccaccactaccaccaaaacccaaaaccaaatagccaataaatacaaaaaggtggtctacttccctgatcattacagaaatgcaaaaaaataaaaataaataaataaatcaacaaagcaaattctgggtgggtatttgctaaaaacagtctagcagtagatgactgcagtaagttggtggtgatgagatgtaaaggaatgtgggttgaatgtcaatttttgaagtgaggagtgttttaattcacgtttcttaggtttcaccattgttaagacttgatatttttctagaaagtcctcgagtgccattgttcaccaggcaaccatgtgtgacactcaagtaaaaatacatgtacaggctgggtgtggtggttcacacctgtaatcccagcactttgggaggctgaggtgggaggatagcttgagctcaggagtttgagaccagcctggacaacatagggagaccccccatctctataaaaaatttaaaaattagctgggtatggtggcatgtgcctgtggtctcagccactccagaagctgaagtgggaggatcacttgaggctgggagatcaaggctgcagtgagctgtgatcatgccactgcgttccagcctgggcaacagagcgagactctgtctcaaaaatgaataaaattgtgtgtatctagaatagtaagaaattaggctcattttgattatggttcataaatagtaactgagtatagtaagaggattatgatggcaaggtacaaattaaaaatctcaagtttttaccttcgctccccacaggttttcattaaaacaacaacaacaaaaaaaattaaagagaatacataactttaaaaatatgacagaggtgaaagctacaagaattacactgcatctgattttatactcacacagtctaatccaaactgaagttctgaatgaacttttcccagtctccctatttgatttcctaggtaaaggaatttagtaaataatgagaacagggaactaaaaggtaaaattcatctttaaaacagtaatttatcaacttttaaactaagagtgagaaagctaccacagactggcttttatgtagtaataaaaagtttaaaatcacttactgtcagcatctgtttttaaaaaatgaaatacttaccaaactatatgcaaaaagtatttgcattaaaagttgccagcttaatcatggaaaatctcttataaggctgcttaaaggttcatgttttttactaaaaatggtagactgtgagaatgtgtaaagtcaatttttgaactactagtactttttttttttttttttttggagaccaggttttactgttgcccaggctggagtgcagtgtcgtgatctcagttcactgcagcctcaacctcccaggctcaagtgatcctcccaactcagcctcccaagtagctgggactgcaggcgcacgccaccatgcctggctaatttttgtattttttatagggacagggtcttgccatgttgcccaggctagtcttgaacctggactcaagtgaacctcccacctcggctgggattatagccatgcatcaaagcagcttggccctattagtacattttaatcagagattaaactatgttgcattttaaatttcagtttaaaaaaatgattcacacgttatacacaaggacaattttaatcctgcattttcctggagtaacatccactgctggctatctatggattgtaactgcatttgctaagaactgtgaacacaaagaaactttacatgaagtcacatgttgatacaggcacacagacatctttcagcagcaacagactacatacataacgcataccagatagtctcgatggataaatctgcttcaccagtaattctatttagtaaaatccacagttaatggagaattccattttttaattttacatctttactacacatttttctaatactttatttttaaaaaacactcattcaagattgtaatttgcatggcgataaacaagggttccatgggttctaagtttcttaaaagtgtccacagcaacttaaaacaccacaagtcttctttccaatttgcagcacctgacttaaagtttaaattcatcaaatacatcattaaaactgtcattttctcttgtgagaagacatgtttcaattgctatttccaggactatatattgagcatgggtgtacagtacttttaactggttagcacaattttactcacataatttatagccagaataagaacctctagcctctctgaacggccttccactcagagcagatgatgacgataaatgtctaaaatgtatctggggtactccacttgacattaccaaacatgcttccaaataatcttagaaaatatgattctttaaacatatgcataatattctaccacacaatgcaccatcacttctttaaccatttcccaattgttcatttataacatttgcaattttttattataaataatattgtgatgaatactttcatccataagttttatgcaaggctgattatttcttctaatgtcttctaatgtcaaagaagtggcttactggttcaaacagcgcacatacatggttttaaggcttttagtatactttaccaaataatctccagaatagctcaaacaactcctaccaacagttatgttattgtgcccacagggtggacttcataacaacacagcaaattcaaccacagatctattagattctcacccatctcaaaactatcacatcaaagaagcaaggagacatattactggtgaggaagccaaattcaaattcttttaaaaaatcactcagctttagatcagtaaaattatcaacaaaaatgctccccacaaagtctaccgggtttttcaaaaaataaagttaaaaagagagaaagagaaactcaggctgggtgcggtggctcacatctgtaataccagcactttgggaggctgaggtgggccaatcacgaggtcaggagttcgagaccagcctggccaacatagtgaaaccccatctctactaaaaatacaaaaattagctgggcgtggtggcgggcgcctgtaatcccacctacttgggaggctgaggcaggagaatcacttgaacccgggaggcggaggttgcagtgagccgagatcgcaccactgcattccagcccaggcaacagtgcgagactctgtcaaaaaaaaaaaagagagagagagagagagagaaagtcagtaccaaatgaccaaaattttttatttgactaaattctattcatgcatgagcatgacagtctcccgtttatttgactttggcaataaaaaaacaagcagccttgtacagaacagtgaaaatgccaaggacgaggacagtctacagttttactgtagaatatatatatatgtatacatatatgtgtatatatgtatacatatatgtgtatatatgtatacatatatgtgtatgtatatatgtatatacatgtatacatacacacatgtatatatacatttttttttgtgtatacatacatatatgtgtatatatacatatatatgtgtatatatatatatattttaaaaggcctctctccctttggccatatcaactctcagttcaggccattaaatacagacaaattttcaaattcacttctttacttctccaagatcttcgatgctgtcatcatctacctataaaacacaaataattatatctcatgagttgtggttgcaattaagaaaaaatggaagcaatttgctttaaaaacttatctctagcgatgtatgtgttccatgcactcacctctggccatttttcctgaatgacatcaattatgtcatctgtaaaatctccctgaatgataatttcatcctcccctgttactgaggcaccacaggagaatttttgagcaaaaaatctttgtgcttctttaagatcaatttctatttttttaaaaaaagaaagagcaagaactgtaattggaattgtgcaaagatgtttttccattttgaaatttaatctgcattttaaaatcataaaacagattgttaatgggttttatattcctttcagaacaatacaaactaccacagagatcttaacaatgcaatttacactttcaaggtcaaataaaggctcaatacataaaaacagaatcatctatactaccccttactcatattaagaccaaaataaatccagggacactttattcatttttttttttgagacggagtcttgctctgttgcccagactggagtgcagtggctcgatcttggctcactgcaacctccgtctcccagattcaagcgattctcctgactcagcctcctgaacagctgggattacaggcatgtgccaccgtgtctggctcatttttgtatttttagtagagatggggtttcaccatgttggccaggctggtctcaaactcctacctcaggtgatccgcccatgtcagcctcccaaagtgctgggattataacaggtgtgagccatcacgcctggcctcttttttcttttttaaggctagtcaagtgaagcagtgggagtaaagaaggaacaaagaaatatgtaagtggttgtgatcatttagctgtaaacaccactgtactcagaccagcctattgattgtttttcaatctgtgttgtctcatagaggcatcatagtttacattttcacccagtttcactactcattcaaggcttccaggaactaaggggctctaaagaaggatgttctgccaccttcctcaacctctcctgtcattcccagaggggatgagccattttgcaaccttttgccaccatgcctgcagaggacagaggagcagcattggctggtttcaaagagaatcctacccagccgtcctcatcccacataaaatgtgcccaagcaggaattccagaaagtaaaaagtcccctctacaaaagattttgacatttctctaaaatttgattttgaagctatagttagaaatgcaaaatttatcttcttagcaaaaaacagacctgtgaagttttcatggtatgtgagagagagagagacagagagatagagggagacagagagagaaaatagttcacacattttaaatatacttaagcctgaactcaccaaaagttgcaaggccacatactcttgtcacatatttcttctttgctctgggaattttggctatagtaaccttttgtggtacggtcttctttttttgttttatttgaccccttccacctttatttattaagaaagagcttagctttagttgtttttgacataagagaatactgtctttaaatttattaattctcaaaaggtttaagtttctttttctctaatacaaaaattactaaacacatccaagtattcattcaataaacatttattaagtacctactatgtgcctagcactgggctaagagccgaggatacaaaagtgaacagaacatagcccctgccctccagagactcagtctagtgaagggagtaaaaaaagaagttacagcaacctgatacatacaataataggaatcatgaataaggctttatgatagctttgcagagaaacaacttagtctgcttccagaggacacagaaagtttcctagaggaagtaatatctaggtggagttttgaagaataaggaaaggtccaggtaaagggaaaaaggctggagaggcataagaaaggacattccagggaaagggaacaagtacagagataagaaaaggcgttatatttgggaacttcacttgtcttgattgaaggatgcttatgaatatgtagcagatggagccagaaaagcaaaagattacatacatagcagtcactggatctgtgtttcggtggatctgtgaagagtaagactgatagaaaggcccctacagaggctcttgcgttagctcaggcaaaaaattgaaagtaaagcagtgccaacagtaatggccactaggccacaggcaggagaggagggaggagaaagaacagaagcaagaactgagtaaagggagaaagagaatgtaagatggttctcagggctctggtttgcatgactgaataaatagtgttgtcactaaccaaaatagagaaaaagaagtcagtttgggacttgagactcgagactcagtaagcttaatttccaaagtgcagtgtttgaggtgcttctgggataaagcacacttctaggctagagacacaggccagatccagatatacagatttgggaattttaagtgcatactgggcagcagaagttagggatgtgatagaatcatccaacaagaacgtgcagaatgagaagtaagtgggcctaggacagaatcctggaaaataccaacttttaaagggcagaaggaacagaagtccgcacagaagactaaggaggagtgataggagacctaggaaggaacagaaaccaaggagggacaatgtttcaggaaagagggagtgcatgtgcgcttattatttagcaataactaagccactgctgacccttatcggaagagctgcagtggccaggaagtcaggttaggatggactgaggagtgaacagtgtaccacagaacagaagcggggatagtgagtctggccttagtaaagaaatctggctaagggaaggagagggataaggtaaagaaagacatgagctttggggagagttttttttttttttgaagatgcaaagtcctaaaaatatttataagtgaattttagtcataggggagaataatgaatgaaaatgaaacaggtgggtacaggatccacagcaccaggagttggtttgagaaggagtcaagtgtatgcaacagccgtaaaacaaagttttcaactgagctatcagaagtaatgagaagataaaattttttatataaatgtcctcactctacttaaatagaagacacaggaattttagctgttttttacatacaaacagggcaaataagcatgttttcctaggtccaatttactgacacagcccaaatcataccacatccaaccatgatcctattagtatgtgcccctttgtatgatatacatggggaattacaataacaggtacatggtattaatgttgggaacctccccctttttgtaagggatgaggtctcactatgttgcccaggatagagtgcagtggctatgtggaggaacgatcattgcatactacagccttgaactcctgggcttaagtgatcctcctgcctcagccccctaagaagctgtgactataggcgcccaccattgtgcctagctttgggaaccattttaattacttacattttctatcgcagtgacggtatgactgtacaaatcaagatgtgaatttaggtcttacctctcttctgttttttcttctcctcttcttcccctgctgttccttgaccctcactaattccagcttcttgtttgggtgaattttctagatataaaagtgaaatacaaaagcatgaacatcatctcacactgttaaaaaaaaagaaatcacctttgagcaacctcatatacaaataaggcatcttaccaacagctgagcatgaaatttgtaaagcaatggattacactgctagatttctattcaagtctagttctaaagtcattatagtaagtgtatggtaacagaagagaaaacccagtcttttgatatgtgagggctgaaatttttagccacaggaaaggagcatagaacacttgggctctgcaggagtgctctagcatctaaacttactaattttgttaacatctagagaagagctccccacccgctcagacatgatcctatcccaggaaggtcccgttcagggacaaccatgtagactgaatataaaaccagacttgagggttcttattcaaccactgacagtgatggagtagctaccagccaaaatggacttaccaagttaggggtttgtgtgtcagggaaatcacttgaaagtcaaggagcaatgagtggggcagcactgggtgtctctgagcaggcctgttcccagaccaggctttctcttcttcttgctactgccttcatttttaccagtcttgcaagagaagccatcaatatgagaaaactgaggaattctgttcctccatagtcttcccacctctggcaatggcaactccattttttttgagacggagtctccctctgttatccaggctggagtgcagcggtgcgatctcggctcactgcaagctctgcctcctggattcacgccattctcctgcctcagcctcccaaagtagctgggactacaggcgcccgccacctcgcccggctaattttttgtatttttagtaaagacagggtttcaccgtgttagccaggatggtctcgatctcctgaccttgtgatccgcctgcctcggcctcccaaagtgctgggattacagcgtgagccactgcacccggcctctttggtctattcttagcagagcagcctaagtgatgctgctgaaacaagtcagaccttatcactcttctgcttaaactcctccaagagctcatcatctaactaagagcaaaaggcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaagaaagaaagaaaatttcaaatatgcactgaagtggaaagaatggcacggtcactcacctttgaccaccatcgattttatcttaccccatccatacacgttttctttggaagcattttagctcagcatcatatcatgtcactcataaatatttcatgatcatgatgtctctctaacagatatggacttttaattttttttttttttttttgagactgagttttgctcttgttgcccaggctggggtgcaatggcacgatctcagctcactgcaattctctgcctcctgggttcaagcaattctcctgtttcagcctcccaagtagctgagattacaggcacctgccaccatgcctcactaatttttgcatttttattagagacggggtttcaccatgttgaccaggctggtctcgaactcctgacctcaagtgatccacctgccttggcctcccaaagtgttgggattacaagcatgagccaccctgcccggcctaattttaattttgtgtatttatttatttttgagacagcatcttcctctgttgcccaggctggagtgcagtagctattcgcaggcgtgatcacagctcactgcagcctcaaattcctgggctcaagcaatcctcccacctcagtctcccaagtagctgggaccacaggcacgcactgccatgcccactctgtttgccaggctgcttgaactcccggcctcaagtaatcctcctgcctcagcctcccaaagtgttgggactatcagcatgagccaccatgctcagcttatttatttgttttttagagacagtcttgctctgtcacccaggctggaatgcagggccaacttgaacctccaactcccaggctcaagtgatcttcccacctcagcctcctgagtagctgggattacacgtacacgaaaccacacccagctgatgtttttattttttgtagaaacagggtcccacaatgttgcccaggctggtctcaaactcttgggttcaagcaatcctcctgcctcagcctcccaaagtgctgggattataggcgtgagccgctgtgcctggcctggcttttcttaacagtgtcttttaaaaagcgaaatttaaaattttgattacttccaacttaacaggtttttttttttcttttttgagacggagtctcgctctgtcgcccaggccttggtgccagtggcgcgatctcggctcactgcaagctccgcctcccgggttcacgccattctcctgcctcagcctcccgagtagctgggactacaggcgcccgccaccacacccggctaattttttgcattttttggtagagacgggctttcaccgtgttagccaggatggtctccatctcctgaccttgtgatccgcccgcctcagcctcccaaaatgctgggattacagacgtgagccaccacacccagcctattctagtagtttttttgtagattccttaggattttctacacaatcatgtcattcatgaatagagacagttttattcctttttccaatatttatgccttatttcattttcttcccttactgctctggctaggacctccagatgagtgttgaatagaaggaggggagcaaacatctttgccttatttcacgaaatgctctctgatggcaattcttgcttagtccttcagattggtattttgttagattcagagttccctggagcagtttctatgtgctgcgaatagatccaaaactagaacattaatcattttagaatcaagatgctcactgccatgagcctaaacaggtagttgcagagattaccttaaagcagaacaggatccaaaactagaaatttttcaaagtataccatgtgtgccatataaacttttcaaagtggaaaccgtgatggactctggtgtttcctaggaagatttcttcttcacaagctgtctctgaggcattagtgaagcattgcatttatattggggcagaggaaggtttttaatgacaaaactattttggtgcttagctatccctttaaatgtatgcagtgaggctgcttcttcccctgtgtctggggagaacctttatgacgtttctagtcattctttggcagctatttctttaaaatacatttttttaattgagatataggccagccatggtggctaatgcctgtaatcccagcactttgggaggccaaagcagatggatcacttgagccaaggagtttgagaccactctgggcaacattgggaaaccccacctctacaaaataaaaaattttttttaattagctggacacactgccatgcaccagtagttccagcaactcaggaggctgaggtaggaagatcacttgatcctgggaggtcaagactgtggtgagccatgatcttgccactgcattccagcctgggtgacagagtgagaccctatatcaaaaagagagacagaattcacattttattatttacatacaattcacccttctaaagtgtacgatttggtggttttttaaaatcatattaataaaatcgtgcagccactaccgctatctaattctagaatattttaatcaccccaaaaggagaccccacatccacagccactggttaccacaatctactttctgtctctatggatttgttggacagataattttaatcagaatttgttgactagaattcatgggatccatgaactttgatggaataaagattacatgccagtttatttttatttttaaattttatttatttatttatttatttatttatttatttattgttttgagacagagtcttgctctgtcacccaggctggagtgcagtggtatgatcttggctcactgcaagctccaccttctgggttcacactattctcctgccccagcctcccaagtagctgggactacaggcacccgccaccacgcctagctaattttttttttttttttttttttggatttttagtagagatggggtttcaccatgctagccaggatggtcttgatctcctgaccttgtgatccacccacctcggcctcccaaagtgctgggattacaggcatgagccaccatgcctggcctatttttttatttttattttatttttgagatggagtttcactctttcctccacttcctgggttcaagcgattctcctgcctcagcctcctgagtagctgggattacaggtgtgagccaccatgcctggttaattttttgtatttttagtagacagagtttcaccatgttggccaggctggtctcaaactcctgacctcaagtgatcctcccaacttggcctcccaatgtgctgggattacaggcgtgagccactatgcccggcccaaattcacattttccaaacaagcattatagcaacagatgtctcctccttgtcctcgtggcttcaggttgttctctcaacctctttgttagggttttatgtcaaattcctgagatataatcaatcactccctcatttttgtcctgctagtgtagctctgtgtgtgtgtgcctgcacatgtgtgtgtgtgcatgcatgcatgtgtgtgtgtgtatctgcctccatcagagtgcacgtcaggtagccaacaggtgactgcgtccatgactcctgctcactgtgaacgcctcaggacccttctccaccttggcaccctggctgcagcacccagcatctgccacaggcggtctcagggcctaccttgaatggaactgacaggaacatgcagaaaaaagaaaaagctggccaggtgcagtggctcacacctataatcccagcactttgggaggccgaggtgggaggatcacttgagggcaggagttcaagttctgctggggcaacataccaagactttgtctctacaaaaaattcaaaaattagctggatgtggccaggcgcggtggctcacgcctgtaatcccagcactttgggaggccgaggcaggcggatcatgaggtcaggagatcaagaccatcctgtctaacacggtgaaaccccatctccactaaaaatacaaaaaaattagctgggcgtggtggcgggcgcctgtagtcccggctacttgaaaggctgaggcaggagaatggtgtaaacccatgaggcggagcttgcagtgagccaagatcgtgccactgcactccagcctgggcgacatagcgagactctgtctcaaaaaaaaaaaaaaaaaaaaattaactggacgtggtgacccatgactgtagtcctgggtacttgggaggttgagggggaaggatcgcttgagcatgaggtcaaggctacagtgagctatgatcacaccactgtactccagtttgggccatagagtgggacactgtctaagaaaaataaaataaaattagctgggtgcagtgactcacacctgtaatcctagctctttgggaggaccacacaggaggattgcttgagcctgggagttcgagaccagcctgggcaagatagtgagaccccattgctaaaaaataaaaattagccaagtgtagtggctcacgcctatagttccagctactcaggaggctgaggtaggaggatcatgactttgagcccaggagttcgaggctacagtgaaccacgatcacaccattgcactccagcctgggcaacagagcaagaccctgtctcaaaaaatatatttttttcagagtgtttgagctagaaagaaccagaagagatatctaattccaaccttacattttacaggaagggaaaaatgaccgaatctctttagtcaacaaagtacagctagaatcagaaaatcatttaattggaaagactgttggctccagatatcatacattttctggtgcattaactgattctagagatattgggaagacagaatttaaataacagggatttacctggcaacacgctttacaaactcctccccccatgcctttgtactgagtacagctaggtaccgaaaaagcaaataattttgtttaaaaattcttaatttctgcaataaggaagcagggtaaagttctgagcagcgtgtctgcttctccagggctttgccatctgtcgctacagacaagggtcgcaattcagagccttgctgtgagacaggcactctcccacgttgccagggagcaggaaatgattcagtcctcctgttggggaaattggcaatgttttctaaaaatcactgaagaactgacgctttgacaatgcagtgtcactttgggaatctctcccacagatacttctgcatgtgtatgaaatggcataggcacacgtgtttctttgcagcattgctttacaatagcaaatgataggaggccacccacccagtgtccagcaaaagggaaccgagggaataagctgtggtccacccacacagtggagttctgagcagacatagaacagaatgaggtgctctagtatgtggaaatatttccagatatattgctaagtgagaaacgtgcaagatactgaaggttcatatggcattccacatccttaaggagagggccaggagcagtggctcacacctgtaatcccaccactttgggaggccaaggtgggaggattgcttgagcccaggagttcgagaccagcctgggcaacatagctaggccctgtctctacaaaaaaaggtttttaaaaacattagcggggcatggtggtgcacacttgtagtcccaggcactcgggaggctgggacaggaggattgcttgagcccaggaatttgaggctgcagtgagctgtgattgagcaactgtattccagcctgagcgatacagcaagatcctgtctcaaaaaaaaaaaaaaaaaaaaaagaagaagaagaaaagaaagaggatggaaataagaatatatatttgcacaaagacacagtggaaagatgatataaattttaccaataggaggcatgagggatgaggcagaagcgggacttctcagtttatacctgtttttattattttgatttttaaactattcaagaaaaactccaataatttaaaaatagacaaaggagaaaaaaggagttagagtaaggggaagcgcacagctgagcacattgcctcatggcgggcttcctccttgcctggagggtaggggtgaggagcggaccctaccataaactgagcttggacttgtgcctgctgtgtgggcctggccatcctgattgctggcttgagatggttggtgttacctgtcggggctcttggcctttctcgtggcaggctgataaagcctgcagatccctttcagaatgaagtttttaaacgaataagagaaaatacatagcatggtagcaaggcacggtggttcacgcctgtaatcccagcactttgggaggcccaggcaggcagatcacctgagggcaggagttccagaccagcctagccaacaaggtaaaaccccctctctactaaaaatacaaaaattacccgggcatggtggcgtgccgtaatcccagctactcgagaggctgaggcactagaatcgcttgaacccaggtggcggaggttgcagtgagccgagatcacgccactgcactccagcctgggcaacagagcaagactctgtctcaaaaaaaaaaaaaaaaatcagatggtaaaatacatgggcaatttgcatagagaggaagcagcatgagtaaaagcacagaggactggaagcacccttgggtgcccctgaggaactgtgagggatcccggggtggctggaatgcaggccacacaggcagggggaggtgaggaggtgggctcacctgcaagccaggggtcaccacggaatgcactggggtctttccaggcatcatctccccttcattcctcccccttacctctccactccccttcttcctcttttccccacccagacacctaagaaggctaacgaggcacttagagttgccgatgcttaactactgaccactgttttcaacacggctcactgagggctcactggatcggtgcctgtgttaggactgacagcgagccagttatatctgggcattagctgatggccagcgtttagctgtaacacacatggtgaagcagacagagaagtccttccagattagagacaaaggggaccccacacatgaatgggaagtcaagaagcctttgttggatggatggatggcaattgtatgcagtcacttcattatattttattcattccctaaggtcttatttatttattattttctgagacagggtgtcactctcttgctcaggctagagtgcagtggcacgatcatggctcacttctgcctcaaactcccaggctccagcggtcctcccacttcagcctcctgaatatctgggagtacaggtgtttgtcaccatgcctggctaattttttttaagtgtattttttgtctccccgtgttgcctaggctggtctcaaactcctgggctcaagagatcctcccacctcagcctcccaaagtgctgggattgcaggcgtgagccactgtgcgtagccactatggtcttttttaaattgacaaataataattgtatatatttacagtgtatagtgcaatgttataatatgtatataacatagtagaatgactaaaccagctgtgtatctatcacctcacatacttatcatgtctttgtagtggaaagatttagaaccgattcatttaacaattttgaaatatatcatacattattattggctgggcacaatggctcacacctgtaatcctagccctttgggaggctgaggcgggaggatcacgtgaagccaggaatgggcaacaatgggagaccctgtctctataaatttaaacacacacacacacacacacacacacacacacacacacacgacattatttatcttttttttttttttttgagacagaatgtcattcttgtctctcaagctggagtgcagtgtcgtgttcttggttactactatcttttgtatgtactatatgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccaatcagttcatcatcagtcatcagatattttttgagttcatgcttataagaggtgcagaaagccagcttgtttatttgttatatccttcattctttttttttttttttcctgagacggagtctcgttctgtcgcccaggctggagtgcagtggtgccacctcggctcactgcaagctccgcctcccgggttcacactattctcctgcctcagcctccctagtagctgggactacaggcgcccgccaccacgcccggctaattttttgtattttagtagagacggggtttcaccgtgttagccaggatggtttcgatctgctgacctcgtgatctgcccgcctcggcctcccaaagtgctgggattacaggtgtgagccaccgcgcctggccccattcttttatttcttagtgatatttcatatacgtcttggtaatataatgagtctttattcataatagtatagatttttattttatggtttttaaaagaatactattctagatagtttctagctataaaataagtaaaaactattctagaatatctactgattatgttgcatgaaaaagtggaagagatcttttttaactaatacactttatttatttagtgcatttttaggttcacagcaaaattgagcagaaagtagagagagttctcatacacactctgtatccacacacccagccttccccacgatcgacctccacaccggggtggtgcatttcttataattggtgaatcttcatggatacctcattgtcacctaaagattacagttaacattaggggtcactctttgtgtttacattctatggggttttgacagatgtgtaatgacacatatcctctactatattatagtatgtacagaatagtttcactgtcctaaaaatcctctgtgatctacccttcatcccttcctccccctcacccctggtcacacgaatctttttaccgcctccatagttttgccttttccacaatgtcatatgcttggaatcctacagtatatagccttttcagattgccttttttcacttagtaacacacatttaaatttcctcctaaagatatctttttaaaagtctaattaggctgggaggccgggcgcggtggctcatgcctgtaatcccagtaccttgggaggccaaggtgggtggatcacgaggtcaggagttcgagaccagcctgaccaacatggtgaaaccccatctctactaaaaatacaaaaatcagctgggcatggtggcacgtgcctgtaatcccagctacttgggaggctgaggcaggagaatcacttgaacccaggaggcagaggttgtagtgagccaagaccacgccactgcactccagcctggcaacagagcgagactccgtctcaaaaataatgataataataataataattaggctgggtgcagtggctgatgcctgtaatcttagcactttgggaggccaaggtgggaggatcgcttaaggccaggagttcaagaccagcctgggcaacatagcgagaccctctctacaaaaaatacaaaaataaaaattaactgggcataatggtgagaacctgtagtcccagctactcgggacactgaggtgggaggactgcttgagcccaggagttcaaggttactatgagctatgagtgcaccactgcactccagcctgggtgacagagtgaggtcctatctctttaaaacaaaaacaaaaacaaaaggccaggtgcagtggctcgcctgtaatcccagcactttgggaggtcaaggcgggcagatcacccgaagtcaagagttcgagaccagcccggccaacgtggcgaaaccctgtttctactaaaaatacaaaaattagccaggcgtagtgttgtgtgcctgtaatcccagctacttcagaggctgaagcaggagaatcacttgaatccaggaggcagaggttgcagtgagccgaggtcatcccaccactgcactccagcctgggcgacagagtgagactcagtctcaaaaaataaaaagcctgatggttatttttctcaactagtaaatagattgtatacataataattatatccgacatagcactatgtgtttttttaaataattgttgagtaggaataccccagtatgaggttctttcgacaaagaatattttttaaattcacacaattcactaatgctactttatttcaacaaaggaaatctcttactaatacagttctcattcattcattttcttgcctcttcccaacctaaaattacacataaaagatactaggaaatagacatgtttacaagcatcaccaacataattcaatagggcaaatacaagtactgagaggatggtagaattaatagagaaatatatatttgtattcctttttgatgactgctttcttaggccacttcattactaaaacaatgtaggctttattagcccactccattaccaactcttttttgttactaacgagttaaacaaggaaaaaacaaaatagagaagtaagcgcagattgtggctagcaagagtagtgaaagctttaaaaggactcaagcagtatcatctgtgttgttttcttgtaggctagaaacgaaactctcagcaacacgttagtggaactttctgcccaggtaggacagctacaagctcgagaacaagctcttacgacaatgataaagctaaaggtaatcaaaaataagaattcctccatttgccagagtgcttggtagttatatccatattcattatcttacctaagtcgctaggatcccagaaatgtgaagctaccaacgttgctcttgttttttaaaacgcccatttagaaatgagggaaacaagtttaaaatgatgttcccaaggcatgaagaaaggaggcaggactctgcttctggtcttctgtctccaaggcccattctgtgggctggcaggtctgaattaacttgttttctccccgggtatccattattaggtctcatagagttatgggccattagattgcttgagaggttttttttgttttgttttgttttgagatggagtctcgctctgtggcccaggctggagtgcagtggctccgtctcagctcgctgcaagctccgcctcccaggttcacgccattctcctgcctcagcctcttgagtagctgggactacaggcgcccgccaccacatccggctaattttttttgtatttttagtagagacggggtttcaccgtgttagccaggatggtctcgatctcctgacctcgtgatccgcccgcctcggcctcccaaagtgctgggattacaggcgtgagccaccgcgctcagccagaggtttttttaatggagagaaaaaccatctgcaatcaagcagttgatgtagtcactaacatgcaatatacaacgatacacactctcctgctgttacacatgtcattgacaattggtatttaagggaacaatgttggtataatgaaatgctcacgctaataaatatgtgatttttctcagcacattgttttcaagtgattggggcaagtgctgttaaaattaaagagaaaggccgggcacggtggctcacgcctgtaatcccagcactttgggaggccgaggcgggcagatcacgaggtcaggagatcgagaccatcctggctaacacggtgaaaccccgtctctactaaaaatacaaaaaattccccgggcgaggtggcgggcgcctgtagtcccagctactcgggaggctgaggcaggaaaatggcatgaacctgggaggcggagcttgcagtgagccgaaatcgcgccactgcactccagcctgggtgacagcgagactccgtctcaaaaaaaaattaaattaaattaaagagaaaatattaaaatctacagtcatgtctttagtcaagtagcagacagtttagtggcttcaacaacctctctggtttccatcatagcaaactctggcaaagctataggtatgtctgaaggtgctgccaaggcatttccccaccattaaaacagtgggtgcgttaggaaggctgtgctcctggaggccgggtgccgtggctcatgcctataatcccagcactttgggaagctgaggtgggtggatcgcttgaggtcaggagtttgagactagcctagccaacatggtgaaacccctgtctttactaaaaatacaaaaaaattagccgggcatggtggcacacgcctgtaatgccagctactctggaggctggggtgggaggatccccggaagccgggaggtggaggttgcagtgagctgagattgcaccactgcactccagcttgggcgacagagcaagactctgtctcaaaaaaaaaaaaaaagaaggtcgggcgtggtggctcacacctgtaatccctacactttgggaggctgagccaggcagatcacaaggccaagagattgagaccatcctggctaacatggtgaaacctcatctatttttaaaaatacaaaaattagctgggcatgatggcacacgcctgtagtcccagctactcaggaggctgaggcaggagaattgcttgaacccaggaggcagaggttgtggtaagccgagatcacgccactgcactccagcctggtgacagagcgagacttcatctggaaaaaaaaaaaaaaggctgtgttttcctagtcttagagattttatttgatgaaaatggtttccattagaagcagatgccctccaggacatccttatcaaaggagcaagtaggaatcccaggtttaaggctgaaagggattgactgtcgtgggtgtcctggtgttaatggaactgtgttcctgtacttattagaacggttattttttgctactgacctggtcacaaagttccatgggtttttgcatggcctgccccaaccctattattctataagtcctagtgtgagatgtgcagacaatgtgatttttcaggagtgcatttatgatgctgtagcagaaatgtttagacttcagtaggggtaaaacctcttaataacagttattccaggtgagtgggggagggatagaacttttacttatttttatacttttaggtgttgtttgagttgcttttcaagaagcagataccttttttggtaactaaaactgcctcaacaattaagagattctaatttgggagatttggaatgatgttgttgtggagtctgtcatgttaacaagctggaaaatgggagggaatgatgggccattagacttacctgtataatccagaggacgattttcccatccaggggccacccaccctcttgctgctattatagtttcttaggtaatggaatggtctggctctaactttttgagagagagtaaggggtagtggttcagtacatagtgtctgaggcagccagctaggttcaaatggtggctccaccactaactagctgtgtaaccgtgggcaaggaacgcagcctttctgttgactcatctgtcacttggcaagaacaatagtaccaccctcatagagttactgtaaagattaaatgaattcatatgcgaaaaatgcttagagtggaacctggcacacgataagatcttagtgttatcttttcttcttggttaattggaatttaagaatctaggataaccattttcaaatttggtttttaggacaaagatattattgaggcagttaatcacattgcagattgttcgggtaaatttaaaatgctagagcatgccctacgtgatgccaagatggcggagacttgtattgtgaaagaaaagcaagattataagcagaaattgaaggcacttaagattgaagtcaacaaactaaaaggtaaggaagagacctacatttaagatacaaatgtattatcttgggaatatagtttttcatctgggttcacttaatcttatgcttgagagtagatcaattcctggccttagaccctaacgtgaaatatccatttcatttatataggattatgctgcaatttgtgtcttataagatatataacagagttggggaaaactgcagaatgtatcatattttaaagtaatcctgccttagttgaggtggctgtaccattagctatcgctaatacatgctttgtggcagacaacatcagtatctcagtggcagacagtcgtagcatttattaaacccacatgtctagaggcaaatgggggagttggctgactgtggttgggcctcactgagcttcccatctgggcagttttggctcacacatttcatcgtcttgctatcaggctagcctgggcatttcttcccatggtgagggcagaaacttctgattctgaaattaggaatttttatttttgccgatttatttattttcgacagaatctcactctgtcacccaggctggagtgcggtggtgcaatcttggttcaccactgcctccacctcctgggttcaagctattctcctgtctcagcttcccgagtagttgggattacaggcacctaccaccatgcctggctaatttttggatgtttagtagagacagagttttgccatgttggccagactagtctggaactcccgacctcaggtgaatccctctgccttggcctcccaaagtgctgagatctacaggcgtgagccaacacacccagccgatctttgctgatttaacttaaaagattcagcattcaaaaatgttgtccttatgatgccttgacctatggttagccataggtcttatctccatttgtagcttcagctaaaaccataatcgtattatcatccccttgacagcaggaacagactctgcttctctttttcagtgtactgttaatagcatggcacaagggctacactctaggtatttggtatttattgaatgtttatatacaccgaggtaaaatattcaagtagaaagaagtctgttctgtcaatatttatatactaaaaacattttataaattcaatattaaaacttttttttttttgagatagtgtcttgctctgctgcccaggctggagtgcaatggcgtgatctcagctcactgcaacctccacctcctgggttcaagcaattctcctgcctcagcctcctgagtagctgggattacaggtgggtgccaccatgcccggctaatttttgtatttttagtagagacagggtttcatcatgttggtcaggctggtctcaaactcctgagcttgtgatccacctgcctcagcctcccaaaagtgctgggattacaggcatgagccaccacacccagcttaaaacttttttttttagaaaagaaaaatagtggctgggcatgatggctcacatctgtaatcctagcactttgggaggccaaagcaggcagattgcttgaggccaggacttcaagaagaccagcctggataacacggcagaaccctgtctctacaaaaaattagccaggcatggtggtgtgatcctgtagtcccagctactcgagaggcaaagtgaaaggatttcttgatcccaggaggtggaggttgcagtgagccaagattggccactacacttcagcctgggcaacagagcaagatcctgcctcaaaaaaataaaaaaaaagaagaggatttttatagagctnatgatgaaaaactggacctttgttcagaagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggacgtagttcatcaataaaacctcagaggagaccacagagaaggtgatgttacgataaaggcagagatgggagtgatgcagctaccatccaaaaacctggagccaccaggagctggaagaggcaagaaatgattctctcctagaacctctagagggagcgtggcccaactgaccccttgtgtttggacttataaaattctgtggttttttgtttgttttgagatggagtttcgctctgtcgcccaggctggagtgcagtggctcaatctcagctcactgcaatttctgcctctcgggttcaagtgattctcctgcctcagcctcccgaatatctgggattacaggcgctcaccaccacacgcggctaatttttcatatttttagtagagacggggtttcaccacgttggccaggctggtctcaaactcctgacctcaggtgatctgcccacctcggcctccgagagtactgggattacaggtgtgagcccccgagcctggccagctctgcggttttaagccactaagtgtgtggtgatctgtttcagtagctataggaaactacattcaggtagagcatgtccttttgagcaaagcttttgtaccaggtcacttcatgggcttctggccagcctgtggatgactttccaggcatggatgacagtagctggtccagtcaactgaagccaaatggtcacatgacaccgtatttgcgccacggatttctcttctggcaatgctgagaaagactgacaggaggaactgcggttagatttgtacagcctgccctttctttgccctttgtgggccgataacaatcatttaccctcaaacattatttttcctataaacattaagataaaaacaaatgagttctcactgtgctttagcggtgtccctggaatctgtgcctggcctcgcttgctccttgaaggacctcagtgacgcttcccagtctgacacccagagaaggcgatgtgaagataataagtatttcccttaaatactttcttgtcacaaatagctgtcagttttccttttatttttttgaactcagtacatatttatcaaaataataaatgggctgggcgcggtggctcaggcctataatcccagcacttgggagggccaggtgggcaaatcacctgaggtcaggagttcaagaccagcctgaccaacatggagaaaccccatctccactaaaaatacaaaatttccatcctggctaacatggtgaaaccccgtctctactaaaaatacaaaaaattagccaggcgtggtggtgggcacctgtagtcccagctactcgggaggctgaggcaggagaatggcgtgaacctgggaggcggagcttgcagtgagccgagatcgcaccactgcactccagcctgggcgacagagcaacactccgtctcaaaaaaaaaaaaaaaacaacaacaaaattagccaggcatggtggcgtgtgcctgtaatcccagctactcaggagtctgaggcaggagaatcgcttgaacccgggaggcagaggttgcggtgagccgagattgcaccattgcactccagcctgggcaacaagagtgaaactccatctcaaaaaaaaaaaaaaaaaagaataaatgaaatgtctcataacaaaagaaaatagacactgtttaaaggcttgagctttttatagaatataaatgcacgaactctgcagttgatggactcagtagtgtgaggctgttctatgtccttgtgtacttattcccataagctatgtcctaaagataggtggctgctgtgtcattaaactgctgcaatttttttttctttgagatagaatctcactctgtcacccaagctggagtagagtggcgctatctcggctcactgaaacctctgcctcccgggttcaagtgattctcctgcctcagcttcccaagtagctgggattacaggtgtgcaccaccagacccggctaatttttgtatttttagtagagatggggttttgccatgttggccaggctggtctcgaactcctggccttaagtgatctgcctacctcagccacccaaagtgctgggattgcaggtgtgagccaccacatctggccaattttttttaaataggtaagaatttaccttaaaattttaatatgaatagtagtttatggattgcaaaggatataaattgttctcacctgtttattacatattagagcagataatattatttccatcttacagatgcaagttcacagaactggcaagtagcaaggagaaaagaaaactcttatttgagactttcttttttttttttgagacggagtttcgctcttgttgaccaggctggagtgtgaggcacgatctcagctcactgaaacctctgccttctgggttcaagtggttctcctgcctcagcctcccgagtagctgggattacaggtgcctgccaccatgcctggctacttttttgtattttagtagagacggggtttcaccatgttagccaggctggtctcaaactcctgacctcaggtgatccacccacctcggcctcccaaagtgctgggattacaggcgtgagccaccgtgcccagctttattttatttattttatttttatttttttgtgacagagtctcactctgcttcccagggtggagtgcagtggcctgatctcagctcactgcaacctctgcctcccaagttcaagcgattctcctgcctcagccacccaagtagcaggagtgcaccaccaggcccagctaattttgtattattattatttttatagtagagacggggtttgccgtttcaccatgttagccaggctggtctcaaactcctgacctcaggtgatctgcatgccttggcctcccaaagtgctgggattacaggcacgagccaccatacccagccacaaatgggggtcttgaaatacactcccagcatctctgcaagggcgttacaaggtaaagcacaccccataccattcaggatccttcttctgatatttctctttttttatatttatttattttttagagacaaggtctcactctgtcacccaggctgggaggcagtggtgtgatcatggctcactgcagccttgacctcccaggctcagacaatctctccaactcagccttccaagaagctgggactactggtgcgtaccaccaaactcatctaattttttattttttatagagatgaggtctcaccatgttgcccaggctggtctccaactcctgacctcctgatccaagtgatcctcctgcctcagcctcccaaagtgctggtattataggcatgcaccattgtgccagacacctcctccgatatttcttgagcttccacttcacacagcctttatcctcttgctgttggtcatgactcttgttcccacacttctttattaagacagatgtttgcagaataaacacaccaatgaacaaagacagctacacaacccctaaagggaaggctgcctggctgctggaacagactagattacgcccttgaatgaaacacaaattgctctaataatgttgggggagggggtggtcgacagagaactcacctagctgtgtcaccaccttctagaaatgaccctcctccaagcgacagtgtcattcagaggtgactgggtgccaatccagtacagaaactgagtcttgatcagtttaagccagtcttggtaatatcactctccttgccaagaccacgctgtaggcatggagaagtgacatcattctggccagtaaggtgtcgaggaagtcttccggggatgcttttcagaagattttcttcacttttgaaaaggaccttttggtttggcagttcctcaaaaaattaaacatagaattatcatatgacccagcaatcccacttttagtcacatgcccaaaagagttgaaaacaggttactcaaatacttgcacaggcctgtacatagcagcaatattcaccagagcaaaaaggtggaagcaacccaacagcccatcaactgatgaatgaacaaaatatggtgtctgtgtacgacagaatgtattattatttggtcatgaaatggaataaagcactgacacaagctgtcccatggaggaactttgaaaacatgatgtcaagtgaaaaaagccaggtgcaaaaggccccgcatggtgtgactccatttatatgaaatgtccggaataagcaaatacttagaaatcagatgagctgagagtcggggaatggggaggattgtttttgatgggtatggggtttcctttgggtgtgaagaaaatgttttggaactagatacaggtggtggctgcacaacatggtgaaggtactaaatgccacagaatttttcactttattttatttttattattttttttgggacagactattgctcttttgcccaggctggagtgaaatggcgcgatcttggctcactgcaacctccacctccccagttcaagtgattctcctgcctcaacctcccgagtagctgggattacaggcacccgacaccatgcccggctaatttttttgtatttttttttttagtagaaacagagttttaccatgttggccaggctagactcaaacttctggattcaaatgatttgcccgccttggcctcccaaagtgctggggttggccgggcgcggtggctcacacctgtaatcccagcactttgggaggctgaggtgggcagatcacctgaggttgggagttccagaccagcctgaccaacatggagaaaccccatctctactaaaaatacaaaattagccaggcatggtggcacatgcctgtaatcccaactactcgggaggctgaggcaggagaatcgcttaaacccaggaggcagaggttgcagtgagccgagatcgcaccattgcactccagcctgggcaacaagagtgaaactacgtctcaaaaaaaaaaaaaaaaaatgtgctgggattacaggcatgagccaccacacccagctaattattttgtatttttagtagagatggggtttcaccatgttggccaggcttgtctcgaactcctgacctcaagtaattcgcctgccttggcctccacaagtgctgggattacagatgtgagccaccacgcccggtcagaattgttcactttaaaatgattagtttttcaaaaggacgtggctggagatgaattttttttaaaaaataaaaagtttagttttatgttatgtgaatttcacctcatttgaaaaaaaaaggatatttgaaaattcttgcaaggccagaaggtttggagtggctcagcctttttgcattgtgaggagacaagcaaagagcaaatcagcatgtagaggatgggggatgagatggtagacggagctcggccatgtcattggcctgttcagggaactctggacctctgattaagcaagacgataaatgatgtctttgcttaaagccatttctagctgggttttccattacttgtagccaaaaacaccctaactgatacagacttcgaggttctgaaaaagcaaacccaaggtgttagttttatccaatgggaagaagaatccctagactgacagtggccctttcacatccctgtgtatccctcgctggacagaaatgatgacacaacatgttgctacagcaaaagcgaaagaaatgagctttttcatctttttttggttggaggggagagagggtcttcgtagcccaggctggagtgcagtggcgcaatcatggcttcctgcagcctcgtactccccgcctcagcctcctgagtagcatgtaccaccacacctggttaatttttttttttttttttttttgagacagagtcttgctctatcgcccaggctggaatgcagtggcgcgatctcggctcactgcaagctctgcatcccgggttcacgctattctcctgcctcagcctcccaagtagctgggaccacaggcgcctgccaccacgcctggctaattgttttgtatttttttagtagagacggggtttcaccatgttagccaggatggtctcgatctcctgacctcgtgatctgcccgcctcggcctcccaaagtgctgggattacaggcgtaagccaatgcacccggcctaattttttttttttttttttttgtagagacagggtcttgctatgtcgcccaggctgatcatgaactcccgggctcaagccatctgcccgcctcggcctcccaaagtgctgggattacaggcgtgagccactgtgcccagctgagctttttcatcttgtaggtaaataactaatgatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttagttcatctagttagcttccgcatcttaggctgcagtgaacatggagtggagtgcagatatctcttcatctaacgtctttttttcttttttctttttttgagacagggtctcactctgtcgcccaggctggagtgcagtggcgtgatcttggcttactgcaacctccacctcctagggttcaagcaattctcccacctcagcttcccaagtagctggaattacaggcgggcgccacgatgtccagctcatttttgtatttttggtagagatggggttttgccatactggccaggctgctcttgaattccttatctcaagtgatccgcccgcactggcctcccaaagtgctgggattataggcatgagccaccacgcctggccaagaagtctttatgtggagtaaagttttataaaagttttacatggggtagctgggcgcggtggctcacacctgtaatctcagcactttgggaggccgaggtgggcggatcgcctgaggtcaggagtttgagaccatcctggccaacatggcgaaaccccgtctctactaaaaataccaaaaaaaaaaattagccgggcatggaggcgcatgcctgtaatcccagctactggggaggctgatgcaggagaatggcttgaacccgggaggcggtggttgcaatgagtggagatttggccactgcactccagcctgggcgacaagaacgaaactccgtctcaaaaaaaaaaaaaaaaaaagttttacatcgagtaaaatcttcataaaaacgtgtattgacccagtaagcactttctggatttgtgtttacttctatcaaacctgcatttcatatgcggtttcctcagaacccagtttgataagctaaagcgtacaggcatttcggatcttttcaaggtaagcatatcagcatttcaaagacactggggaagcagagagcctgagcagcgccgtccccgcccccatccctcctcctctcccctccctctctccgctgagttttcatatttatagtattttgcatgtcctgatgttgatgaaaatcaggatgtagagttaatattttagacgccaggagcttatagcatgctctccaatattaattgattgtattttattaatgttgtgttttcttcatccaaaagcagatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaacccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaaaaatatgtttccttggtttctttttattttacaggagtaaaataaggaaggaacgttcatcactttaaactgaacctggcaagttaatttcctcaggaatggggatgtatttttttaagcattgcagatatcaaagttctattgtgctgaataaatgcccctttgttaacaggtctcagtgttacttcagagatgattttcatgagcggggaagagccaccttatttagcctttttaattagggtgctgaaaagagaagttgggtgaggtttggttatgttctttatcaatgcgtgctttctccctcaggctgggctgtctagagcaaaacggagaaaggtatagttgcttctgagctgctgcctgccaagtagaaacctaaaatgacccttgggagcgtgacttcctatctaagaatcaaaatattaaattttctcctccttttcatgttcatgactgcacatcaacttgcctagtgaaaaggcaacactgaatagatgctaaataggaacatgtcagggaactaaaggatttgataacaattaaacattattttatggctaaatgtattttagctcataggattatagtacctacgacacctgacacctattgtatcccaccagcttatcgttccatatgcaatccaacaatgagaaatttcagctgggtgtggcggcttatgcctgtaattccagcactttgggagcctaaggcaggtggatcacttgagatcagaggttcgagaccagcctggccaacatgacaaaaccccctctctactaaaaatacaaaaaattagctgggcatggtgtcacgcgcctgtaatcccagctacttgggaggctgaggcaggagaattgcttgaacccaggaggtggaggttgcaatgagccaagatcgtaccactgcactccagcttgggtgacagagtgaggtcccgtctcaaaaaaaaaaaaaaaaaaaaaaaagaatgagaaatttgatgttagcaatgcatctagctcaaccgaagttatttatttatttatttatttatttatttttttgagacagagtctctctctgtcgcccaggctggagtgcagtggcgtgatctcagctcactgcaacctccgcctttcaggttcaagcgattctcctgcctcagcctcccgagtagctgggactacaggtgtgcgccaccatgcccagctaaattttgtatttttagtagagacggggtttcaccatattggcaaggctggtcttgaacttctgaccttgtgatccaccttctcggcctcccaaagtgctgggattacagatgtaagccactgcacctggcccaaactgagtcatttaaatgacaggatttcgtttgtttttatggctaaatagtattccattgtgtatatatatactacttttttttttttgagaccgagtctcactctgttgcccaggctggagtgcagtggctcaattccagctcactgcaacctccacctcccgagttcaagcaattctcctgcctcagtctcctgagaagctaggattacaggtgcccaccaccactcctggctaactttttgtttttttagtagagacggggtttcgtcatgttggccaggctggtgttgaactcctggcctaatgtgatcctcccaactcagcctcccaaagtgctgggattacaggcgtgagccaccacatttctttatccactcatctgttgatgggcatttaggttgcttccacatcttggctgttgtgagcagtgctgcagtgaacgtggagtgcagatacccctgacctaagctttgagcaatttctgttagagaggcagtctcctttttttttttctatactttaatggatgcacagaggcagtctcatagcgtatttgaaatagttacaagataaaactagattttagcatttatgtcttatcaccaacattcttaagatcaacacatctgaagaggaggcaaatgaattatactacaatctgcctgccagaagtaatctcagcattggaaaagactgatataagggtatttttagaatctgtgaatggatttttttttttaattttatttttagtgacagggtctcactctgtcacccagcctggagggcagtggtatcatcatagctcactgtagcctcaaactcttgggctcaagtgattctcctgcttcagcctcccaattagcgaggactccaggcacgtgccaccatgcctaattttttttttctttagatggagtctcactctgtcacccaggctgaagtgcggtggcacgatgtcagctcactgcaacctccatctcccagattcaagagattcttctgcctcccgaatagctgggattacaggcatctgccaccatgcccggctaatttttgtatttttagtagagacggggtttcaccatgttggccaggctggtctcgaactcctgacctcaggtgatccgcccacctcagcctcccaaagtgctggggttacaggtgtgagcccccgcgcccggccaacagatatttaaaaacagaaatagaaatacccccaaagaaaaaaagttctgaattaagataaaacataaacactaaaagcagctttaccccaaaagtgccaagagaatgcgtctagaacttcttggctgtgtgggataaggttggctccataccttccaggaaggagactgaagactgaatccttgttatgttctggcaaactgatcctggagttttctcctgtggctttgtgtggtttgacacctgtagctggggtggtgggtttgcagtgttgtacttttgtttctcttgagccatttgatgatgattttgttaggacacattgcaggaaagttcattattctaggccttcaacagaataatcttagcaacctccagtgtgatagagaacagagtgaacaggatcaaaataagaaaccagacacattcatcaagactgcagctgacaaggaggtttaaaaaccagaatggggccaggtgcagtggcccacgcgtgtaatcccagcacttagagaggccaaagctcgcacatcatttgagatcaggagttcgagaccagcctggccaacatggcgaaacacctctctactaaaaatacaaaaattagctgggcgtggtggtgggtgcctgtaatcccagctactcaggaggctgaggcacaagaatcacttcaacctgggaggcagaggttgcagtgtgctgagattgagccatgcctccagcctgggcaacagagccagactctgtctcaaacaaacaaacaaaacaaacaaaaaacacccagaatggtctttgagagaagttgattgaatgaaaagtgtacatgaatcagttctttaaaggatgatgtctgggttctcagccagatgcatgcttaagaaacccaaccacaacaacaacaaaaagaaacccaacaaaaaatcaaagaattttgagcacacagtaggtgctttgctggccactggagacacaacaatgagcaaagcagacaatctagtcgtagaaacacactaatctaagaatcccatacatagttcacaagagactggttagtgctacaaaagaaagctttgagatatgatgacagcttataatagggactcaggtgaagggtggagtgttaagagaatgcttccttaaagaagtgacatctgagccaagagttaaagacaagtggatgctaagtagggcgaacgggaagcagaagagaattccaggcagtaggaacagcatgtgcaaaggctctgaggtgggagggaacatgacgcatctgggacctgatgggccaggatggtgcaagatgaagccagggacagaggctggggccagatcatgcatacgagtcgatgagtcagtgtgggtgtggtagcataccatgttttagtgggccagatgatgtaaactctcctgtgcatcttggattttccttaaaacgaggtcttatttgtattccaattgctttgcttttgtaatagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcttcctggggttaggatatggacatgtcttttgggggagccacccttcaactccctacagttggctagtgactactggactcctatcccccacccacagggaacgggcattgctggacggtggcaacaatccagtggggtcttctcttcatggaagtctgaacttgaaacatataagaaattgacactgccactggagttgtgcagaggccagaaagaggacaggtggtagatactgtgggtaaggaaaagccaggaggtgagcaggaaaccaagtcagaagtcagaggcacagtcaacgaagcagtgccacgaggatggtgccaatgcctgtggttgcccagcaaccacatttcatcaatctgaagatgcacctttccccgccccccgccccgcattttggcattttggaatgtgtctaacaacagatgatgtcttatttgctgcttttggtcgggcggcagccctgaggttgctgggactgcccgcaggtaggtgaactcctagagcgttgtgatccccacgggcagagcaggcgctggtggctttgggaacaccgcgggacccttttcactcctaagaatccgagggtcagatgcgtttggcaacattctcacaggaggagtcagaggaggctctcctgcatgatgggtgagccggcataggaattgtgccaagggccattagattttgtagagactctgaaccccctgtccagaggacaggagctgaggacaacagcaggcgaaaaacacaaacctcaaagtgcgtgcactggaaagagaccagaaagccagattgaaaatgtggaggtgttgcaggagtaaatcaccggtttcccttacatcatcctctttactttatttacttatttacagacagggtctcgaactcctgggttcagcgatcttcctgcctcggtttcctgagtagctgagattgcaggtgcctttttacttacaaaaatttttttaattgagagatagaaattgtatatatttatggtgtacagcatggtgttttgaaatatgtatacattatggaatggctaaaatgagctaattaacatatgcattatctctcatgactttttttgtagcgagaacacctaaaatctactcttaacaattttcaaggacacaatccattgttgttgacactatttattcatttattatagaaatggggtcttactatgttgcccagtctgatcttgaactcctggcctcaaacgattctcctgccttggctttccaaagcctctgtgcccagccattgttgactatagtcaccatgttgtacaatggatctcttgaatttatttctcctgtctaacagaacatttgtaccctttgatcaacctctccccaacccagccacccacctccagctcccggtaaccaccattccaccctctgcttctatgagttcaacttttttagattcatatataagggagatcatgcagtatttgtctttctgcgtctggcttacttcacttaacataaagtcacccaggttcattcaagttgtggcaaatgacaggatttccttctttttaaacgctgaatagtacttcattgtgtatacaccacattttcttcatttatccactgattgacacctaggctgattccatatcttttttttttttttttttttttttttttggagacagcatctctctctgtcacccaggctggagtgcagtgtcacaattttggctcactgcaacctccacctcccgggttcaagtaattctcctgcctcagcctcccaagtagctgggattacaggtacccgccaccatgcctgactaatttttgtatttttagtaaagatgaggtttttgctatgttgaccaggctggtcttgaactcctgacctcaagcaatcctctcacctcggcctcccaaacgtgagccacggcgcccggccagctcctatatcttgactgtggataatgtcatgaagaatgctgcaatagacatgggtgtgcaggtatctcttcaacatactgatttcatttccttcagatatgcattcagtagtgagctttctagatcatatggtagtactatttataattttttgaggaacccccatgctatttcccataatatctttcttttcatatatacacaagactgatataggaaataaagaaacactggagactaaaagagtcaaatgaaattttgaagcaataagaaagaagtatattatagttaaattgtgtgcattttctttctttcttctttttcttcctttctcattctttctctttctttctttctgatggactccctcccttccttccttctttacttccttccttccctccttccttccctccttccttccctccctccctccatccctgagaggtgggggagaggagaatgaaacttagaacatcacgcatcaattaataaaaccaccacaatatagtatcgctccaccatcataaacgcaatctgagttgtggttgatacatggataccctaatctatgcacagacattgaattccnnggcncggggcgcctcgtccccccgaagtaaatcggccatatatatctaatctaagcatcagcaatcacaagagtttgatgaccccgcagtataaatgatatagatggcccatccaacaacgccacgaatttcaccgtattgtcatatcatccatcacgatcgccgactccccgtaccacgccttgccccgatgcgcaccatccgccctctgggacttgatactgcatagacccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccccctttaagagcaattggcagtgactaattatcatgccaaacttcacatcccaaagttgaaatttaataggaataaacgaaggcacatacccacatatttttcaaggcttataagcctttaatgttgtcctattttgcaagtattttgacatgctaaatacagcattgacaagttggttgaggagagttaaccaatgcctaggattcttttatcgcatgggtgttacttcattagctgtagtaagttctgtttaagtcaaattatttaactgagtaggttctaagaaataaagggggctgggtgcagtggctcacgcctgtaatcctagcactgtgggagttcgaggcggatggatcactggaggtcagaagttcaagaccagcctggccaacatggtgaaaccctgtctctactaaaaatacaaaattagccaggtgtggtggcgggcaactgtagccgcatctactcgggaggctgaggcaggagaatcacttgaacccgggaggtggaggttgcagtgagctgaggttacactattgcactccagcctaggcaacaagagcaaaactccgtctcaaaaaaaaaaaaaagaggccgggtgcggtggctcacacttgtaatcccagcactttgggaggctgaggcaggcagatcacgaggtcaggagattgagaccattctggctaacgtggtgaaaccccgtctctactaaaaaatacaaaaaaaaattagccaggcatggtggtgggtgcctgtagtcccagctacttgggaggctgaggtgggtggagcttgaagtgagccgagatcatgccactgcactccagcctgggtgacagagcgagactccgtctcaaaaaaaaaaaaaaagaaagagagagagagggagggagagagagagagagagagagagagagaaagaaagaaagaaagaaagaaagaaagaaagaaagaaagaaagaaagaaaaggaatgaatttagttattcttattctactatttgatgtccagctttgctttgtaacacctaaagacaaagaaatattcacaggtgatcgggtgtagtggctcacgcctataaccccagcactttgggaggccgaggcaggagggtaacttgaggccaggagttcaagaccagcctgggcaacatagtgagatcccacctctaccaaaaaaaaaattgctcggtgtggttgcacacacctatggtcccagcttttcaggaggctgaggcaggaggatcactcgagcccaggagcttgaggcaatcagctgtgattgtgccactgcacttcagcctgggcgtcagagcaagagaaagaaaaaagaaaacaatattcctaggtagttagcatttgtgtttgtaaacctaagcatttaaaggtgcctcttaatttcctgtaggcttcaattgtgttaccctcccaggatgatttctcgcccacgagcaagctccagcgtttgctggcggaatctcgtcagatggtgacggacctggagctgagcacactgctgcccatcagccatgagaatctcactggcagtgccacaaatgtatgcgtttcattttctcttgactatatttgtcacatccaaacacaccactgaacaccagtgtgcaaatatcaccggcagggcggcctttctgttagagggagagtttctgtgtctctagggaggaaagggaacatgcttgttttaaggaggaaaaagttacacttagatgtcactggacccaaacttcctctttctaatgatctggggcatatgaagataaattcttggggacttttttcttggagggggcgggtacagagttttgctcttgtcgcccaggctgaggtgcagtggcacgatctcagctcattgcaacctccacctcccgggttcaagtgattctcctgcctcagcctcccaagtaactgggactaaaggcctactctaccatgcccggctaatttttatatttttagtagagacagggtttcaccatgttggccaggctggtctcaaactcctgatctccagtgatccacccaccttggcctcccaaagtgctaggattacaggcgtgagccaccctgcccggcctaattttaattttgtgtatttatttatttttgagacagcatcttcctctgttgcccatggctggagtgcagtagctattctgnatgaacttacttct

SEQ ID NO: 702 - DNA, 204382 bp, Homo sapiens
  misc_feature (1)...(204382): n = A,T,C or G
aagccaccctcgcggatgcagaataccctctacacatgagtttcccaaatgtgtacctggacccctcgaaacagagactctacgaaatgacaagctgcccctgccctgaattagggggaaacattccaggccaactctagctcctttctcaagctacaaagtggtgaacatggttctcaactccttaatttatactctttttttgcccaggatactctacccacttaagaaccttgccaacttctgggggttgggcatggtggctcatgcctgtaattccagagctttgggaggccgaggcgggaggatcacttgaggccgagagtttgacaccactctggccagcatggtgagactccatctctacaaaaattttaaaaattagccaggtgtggtggtgcgtgactgtagtcctagctacttgagaggctgaggtgacaggatcccttgagaccaagaagtagaggcttcattgagctacgatcatgccactaaattaaaaaaaatttttttttcagacagtctcgctctgttgtccaggctggagtgcagtggggcgcatcttggcccactgcaacctccccctccctggttcaggcgattctcctgcctcagcctcttgagtaactgggacaacaggcgcatgccaccgcagcaggctaatatttttatatttttagtagacacaagttttcaccatattggccaggctggtcttgaactcctaacctcgtgatccacccacctcagcctcacaaagtgctgggattacaggtgagagccactgcgccaggccaaaattttttttaaataataaaaagtattaagaattttgaagatggtagcacagggcccttctgagctcatccacgaagcagaggctgtaagtttacacacatttatttatttattatatatatttctgctatataatttttacatatgacatgttgtttatcgtcatatttaccatattatatgtcatatttatatatgtacattatataatataaatatataattatttatatattagagagagatggaatagaataaacagatgaaacagatgggctcacatatgagccaaatctgtattcgggtttctgtgtattggactataaaatgacatagagggaggggggtaaatattttattccttataaggattcattcattcatttcctatttcaaggtacattaatgaagcactagctctatactggacacagtagaaacataaatgaaaaacatagccacggggcccattgtagaaaccaagggaaaaaataaaattagaaaataaaaaattataaaatatggccaggggtggtggctcacatctgtaatcccagctgtttgggaggccgaggtgggcagatcacttgaggtcaggagttcaagaccagcctggccaacatggtgaaaccccgtctctactaaaaatacgaaaattagctgggtgtggtggtgtgtgcctataatcccagctactcagggggctgaggcaggagaatcgcttgagcctgggaggcagaggttgtagtgagctgagatcacaccactgcactccagcctgggcgaccaagcaagactctgtctcaaaaataaaataaaataatacaattatcctgtgggaccctgtgtttggcactttcacacagggtcctgcaggagaatccagggcccttactcctgtcttagtcgtctcagaggaagtagcttgcaaactcggctctgaaggatggacaggaagccaccagggacacagtggggaagggtattccaggcagatgtagaaaggtgaaaaagagccaagtgtttgggaaatgcaggaagaccaatagggcaggaacgaaaagtccaggctggggctgcgaccactcggtaagacgtgaagccatgaggtcagccgaggagggaagggtctgttgtctgttctaacccttagcgtgacagaagattcatgaatagactttcagattcctctctatcttgtttttctttttgttgttgagacagggtgttgctctgtcacccaggctggggtgcagtggcatgatctcagctcattgtaaccttgaacccctggactccagcaatctgcctccctcagcctcccaagtagctgggaccacaggcatgtgccaccatgcccagctaattttggtattttttgtagagaccaggtcttgctgtgttgcccaggctggtcttgaactcctgagttcaacggatccacccaccttggcctcccaaagtgctgggattacaggtgtgagccaccatgcctggcctcttacatttccttctaagagttttttagatttagctcttacatttaggtcgtaacccaagttgagttaatttctgtgtaccgtgtagcaaaggggtccagttcttttgcttgtggtgacctagttgtcccaacatcatttattacaaagactcttctttcccccattgtcttggcacccttgttgaaaatcagctgatcatgaatataagggtttatttctggactctcagtcctgctctcttgagctgtaatatctatccttatgccagaatcacactggactactgtagctttacagtaaagggagagttctccaacttagttcttctttttcaagattatttggttattctggtttgcccttaggttttttacaataaacccaaacttttcaaaaccatgaagtgctcttctcctttttcaaaagaaatgtgtgtgtgtatctatgtgtctctgctagtcagtatgatcagcttcctctctacccccttacttcccagcttctacaactacatctccttcgttgggggcccaggggccccttatttcctgctagccaagggtcctgactcagtgtcatctatattctgtagtggtgagtctgaatagccccaatgtgctgtacctcctggcactcccacccttaggtggcacctcccagtggaatatggactggctctgtgatttgttttgcctgattgaatgtggtggaggtgatgttctggggtttccaagcccagggatggagaaggtctgcctgtgtgccttcagaagccctaagtatgtccatgtacaaagtccagactatgtcgtggaaagaagatgtgaagaggctgtgtgtagatgccacatagaggggccacacagagaggccacagggacgccatgtagagaggcatcaaggttctgtggagacagagagaagcctgagtgtcccagtgtccttcttaagcatccgtatgactctagcccggctgccatctgagaatccccaaatgagaagcacccagctgaggccagccaacacagagaaccatgagagatgacacaatggaggttgtgttaagccgctatgttttgtggcaatttttaatgcagcaatagataattaaaacagaaatccgatggcctggcatggtggctcacacctgtaatgccagcactttgggaggccgaggctggaagatcacctgggcctacggttcgagaccagcctgggcaatgcagtgagaccctatctctatttaaataataaataaaaccaaaaatcccaggttagttcaaagacacgaaatagttacttaacctcctgatgcctcggtttctcaatctgtaaaatggagatgataatgacaataataatacatctgtcacagggtttttgtgaagattaaaggagatcacatatgcaaatctctcagtacaatgcagtcgtgtcactattaatttttacaataattcaatccagtttagtggtacacattcaagttgtcataagataaccaggcatggagattcaactgggtgagtgataaattttaagtggagtttctacgaaatgcggagggatcactgccttcactcttgaaatgattcattaaacaagtttctgtacaactcatacacttgtaagaaaaaaataataaatgcatgaaagaaggaaacaagcaagacaaaacatgctcactgtgcagtgggaagaccggaaattccatcggaggcaccagaatccagcgaggctgccctttagaatctgcccgagtagccgcggactttggtttagaatcatgtagtgtgagagctgggaggaagttcgaagatcatctaattcctcatgagcgggtgaggggttaaggggtttcacagctagttaatgagagagccagaacatacatccaggctccaggttcttttgcaaacttaacatgtgtggttgttcttttatttatttttattttaatattattattattttttgacatggattctcactctgttgcccaggctggagtgcagtggtgtgatcttggctcacggcaacctccgcctcccgggttcaagcgattctacctgcctcagcctcctgagtagctgggactacaggtgcctgccaccacacccggctaatttttgtatttttagtagagactaggtttcaccatattggccaggctggtcctgaactcctgacctcatgatctgcctgcctcggcctcccgaagtgctgggattacaagggtgagtcaccaggcctggcctgtggttgtttttttctaattttatccatgactattgtttaaaaaaaaacacacacacaaaatattatgaaattgtgaaacttagaaagggagagtcccttgcaaatttcagcttctagaaataaatactgctgacttctctgactcttagttaataaaggcccttaggattactttatgaatgttgttgacaagtgtccacatacatccaagaaggaagcatggtattcacaggcagcaagaacaagaaacaaataccaattatttcactaaagcctgaacagcatgacctccatccccaccatgccctgagcaagatcttcaaccttacagacaaggcaataacatagtaagaggcagtgagcatgatggttagggacacaggctttgaagtcactgccagattcaaatccaagctcagctgttttttttcttttagttttgagacaggatctcactctgtcacccaggctggagtgcattggcacgatctaggctcactgcaagctccgcctccctggttcatgccattcccctgcctcagcctcccaagtagctgggactacaggtgcccgccacgacgcctggctaattttttgtttttgtatttttagtagagacagggtttcaccgtgttagccaggatggtctcgatctcctgacctcgtgatccgcccgcctcagcctcccaaagtgcttggattacaggcgtgagccacggcgcctggcctctgttttttttttttttttttctaaacagagtttcactcttgttgcccaggctgtagtgcaatggcgtcatctcagctcaccgcaacctccgcctcctgggtcccagttcaagcagttctcctgcctccgctactgagtagctgggattacaggcacgcgccaccacacccagctaaattttgtatttttagtagagatctgatttcaccatgttgaccaggctggtatcaaactcctgacctcgtgatccgcccacctcagcctcccaaagtgctgggattacaggcgtgagccactgtgcccgggtttttttgtttgtttgtttgtttgtttggtggagtctcgctctgtcacccaggctgcagtgcagtggcacaatcttggttcactgcaacctccaactccctggttcaagcgattctcctgcctcagcctcccaagtggctgggattacaggcgcccgccaccacgcccagctaatttttgtatactttagtagagacggggtttcaccatattggccaagatggtctggatctcctgaccttgtgatcctcccgtctcggcctcccaaagtgttgggattacaggcgtgagccaccgcgcccggccatgctctgctcttatgagctgggtggccctgaatattttatcctctctgagcttcactttcctcatttgaaatcagaatcaataataataccttccacatgggctacagtcagagtgaaacaagcaactataaaagcactgagctcctggctaacatggtgaaaccccatctctactaaaaatacaaaaaattagctaggcgtggtggcgggtgcctgtagtcccagctactcgggaggctgaggcagcatggcgtgaacccaggaggcggggcttgcagtgaggcgagagcgagactttgtctcaaaaaaaaaaaagcactgagtatgggttccagcacatgggaagctctctataatgtaggtgccaccatcatcttcatcattgtcttcatctcacctggatcatcatcaagtacttgtagttctatgggaacctaatattaggtcatcctaactctagtttacttgaagactctataagctcctattattgaacctgcgtttgcagctaaagaaataaattgacatcttatggccggcagtgatggttcacacctgtaagcccagcactttgggatgccaaggcgggaggatcacttgaagtcaggagttcaagaccagcctggccaaaatggtgaaatccatctctattaaaaaatacaaaaattagccaggcacggtggcgggcacctgtagtctcagctacttgggaggctgaggcaggagaatgactggaacccaggaggcagaggttgcagtgagccactgcactccagcctgggcgatagagtgaaactccatctcaaaagaaaaaaaaaaaaaaaggaagaaatttacattatataactcaaagtagaagcaacatagtttagaagtctcctgcatggaagaattcataagaccaaaatattaaagggagaaaacattctataggatgacacccaatcgcactgacaagcagagaaacaatgtgtgcaatggtgtcccgctacaaggcagggttccatgtcctcttaggtcctgtcactctaagtttaattttacaaaaatgggggctttaaaaatatcacatacttagtgggggaggttttgcgtgtgtggagacagagtgcacaggaccgtccgtactttctgctcaattttgctgtgaatctaaaactgccctaaaaaataaagttcattaaaaaaaaaaaatcacggccaggcgcagtggctcacgcctgtaatcacagcactttgggagaccgaggcgggtggatcacaaggtcaggagttcgagaccagcctggccaacacagtgaaacctcgtctttactaaaaatacaaaaaattagctgggcgtggtggcgcacgcctgtagtcccagatactcaggaggctgaggcagaagaattgcttgaacctgggaggcggaggttgcagtgagctgagattgttccaccgttctccagcctgggtgacagagtgagactctgtctcaaaaaaaaaaaatcacatcctaaggtcccaaggacataaaacaagttagagacctcatccagttttttgtttgtttcagggacctgcaaccaactttcttactgaccagtttcctgggctgtctagaacagacagcttatggggtactaaccccatgctctatcctaaggtacccctcttcatgcagagcgacacagaaaaacaaatttgtagcacaaagtacacccgatttgctacagcttacaactagcctcatgaatccttttctcattaattcaaagtttgcaaaaaaaagaaatcacatacttaaatcacttgagcacagaagcatatcaaaatctaatataaacaaacaaaaaacccaacttattttaacatgccactgaaactgggctcaagttttcaaacatcttatgaaatattacactctccagcaggcttttttttttttcctaactggagatgaatggcagagttctgatatggaaaagcactccatgtttgtacagaaaggtagcataggaaaagtggtcaaattcaaccagtctgtcctcatcaaacaggcaactactgtcttctcagcatttccaaaagaaatcatatgcctgctactgtttatgtcatatgcctgttaatttttcatgctaattcttagtgtttctggaaaacctcactgtttggcaccaaaaattattattgctattgttgttgttttgttaattatgtcagccaagcagatgacggtgaattaattctgcaacgttgagtactcagttggcatacaagcacccagccttccaaagggatgtccttcatgtttcactgattttcgaatgacagtcagcttgcctaaacttatcctttacatttaagacatttggtgggttcctgtatgcccaggggatttttattatttgtttatgcaaacagcaggttgcataagagccttgctggcttttttttttttttttttagagatttcgtagtttcctgataaccattcagtcatctatttcaacaccctgacatgacataaaggcaggcacggaaccacacgttcaccatacagacacacgccactttgctggagcattcactaggcgaggcgctccatcggactcactagctgcactcatgaatcggcaccatctgcaggatcactttctggaaatagacaagaagaactgctgtgtgttccgagatgacttcattgccaaggtgttgccgccggtgttggggctggagtttatctttgggcttctgggcaatggccttgccctgtggattttctgtttccacctcaagtcctggaaatccagccggattttcctgttcaacctggcagtagctgactttctactgatcatctgcctgccgttcgtgatggactactatgtgcggcgttcagactggaagtttggggacatcccttgccggctggtgctcttcatgtttgccatgaaccgccagggcagcatcatattcctcacggtggtggcggtagacaggtatttccgggtggtccatccccaccacgccctgaacaagatctccaattggacagcagccatcatctcttgccttctgtggggcatcactgttggcctaacagtccacctcctgaagaagaagttgctgatccagaatggcactgcaaatgtgtgcatcagcttcagcatctgccataccttccggtggcacgaagctatgttcctcctggagttcttcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccacatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagataacaggtgagccagataataaccgcagcacgagcgtcgagctcacaggggaccccaacaaaaccagaggcgctccagaggcgttaatcgccaactccggtgagccatggagcccctcttatctgggcccaacctcaaataaccattccaagaagggacattgtcaccaagaaccagcatctctggagaaacagttgggctgttgcatcgagtaatgtcactggactcggcctaagatttcctggaacttccagattcagagaatctgatttagggaaactgtggcagatgagtgggagactggttgcaaggtgtgaccgcaggaatcctggaggaacagagagtaaagcttctaggcatctgaaacttgcttcatctctgacgctcgcaggactgaagatgggcaaattgtaggcgtttctgctgagcagagttggagccagagatctacttgtgacttgttggccttcttcccacatctgcctcagactggagggggctcagctcctggggtgatatctagcctgcttgtgagctctagcagggataaggagagctgagattggagggaattgtgttgttcctggaggaagcccaggcatcattaaacaagccagtaggtcacctggcttccgtggaccaattcatctttcagacaatctttagcagaaatggactcagggaagagactcacatgctttggttagtatctgtgtttccggtgggtgtaataggggattagccccagaagggactgagctaaacagtgttattatgggaaaggaaatggcattgctgctttcaaccagcgactaatgcaatccattcctctcttgtttatagtaatctaagggttgaacagttaaaacggcttcaggatagaaagctgtttcccacctgtttgcttttaccattaaaagggaaacgtgcctctgccccacgggtagaggggtgcacgttcctcctggttccttcgcttgtgtttctgtacttaccaaaaatctaccatttcaataaattttgataggagacagtctggcgttgctatatctgggttatggttcacagaaatggacttcttacttaagcagagacctttatgggttgttaactttgtcctggtagaaaactactccacactgcaaagtaagaaagagacacagacactgagctacatcatgaaacaactaagcagaaattacacctgtgtctaaacaaagatagaaagagctgggattaaaaataatttggaaggatagtacagataggattgcaagagcacttacattttattagagtttggtgaatattgctcttcatatttgtgcattaaaaagggaatcaaggccaggtgcaatggttcatgcctgtaatcccagcactttgggggagccaaggcgggcagatcacctgaagtaaggagtttgagaccagcctggacaaaatggtgaaaccccacttctactaaaaatacaagaaaaattagccaggcatggtggcggccgcttgtagtcccagctactgggaaggctgggagaagaagaattgcttgaacccgggaggcggaggttgcagtgagccgaggtggtgtgcctgcactccagcctgggggacagagcaagacttcatctcaaataataataataaataatataaaaagggaatcaagccaggcagatatttttccataggagggggaagagcgagcttcctatggaatggtttcagttcccaattcggagaaggaaaggagatgtactggtttgagtctgtgatcagtccaagtttctgttacgctttcatttctaactctgtcagtccttgattatttggcaagacgaggcttgcttcaacctcctgacatgaacacagataaggaatttagagacaggctcccagctctgggtgaatgacagtaaatgaagaaaggtggatgctctggaattacctctgtgctttcagagcagttggcttgtctgtatcaccaagcaatgtacaggtaaaaagccaaaagcaaggatcaccttaaagaggaagagatgtcagggatgagctcagaggaaaatagggattccccagcctcggaggcatgagtcagtggggagcctcgttgtgaaacgcggattcgttcaagggatgaggtggtttggggtgtttggacctccacagctcacattcattcactgattcaggcattccatcagttctttgttttttttttttttttgagaccgagtctcactctgtcatctaggctggagtgcagtggtgtgatctgggttcactgcagcctctgcctcctgggttcaagtgattctcctacctcagcctccccagtagctgggattacaggtgtgcaccaccatgcctggctaatttttgtatttttagtagagatgggctttcgctgtgttgcccaggctggtctccaactcctgacctcaggtgatccacctgcctcagcctcccaaagtgctgggattacaggtgtgagccactgtgcccagcctcattccatcagttttatgtattaagcgccaactgtgtgccaggcgctgttctgggtggtggagatagaacaaggaacaaggcagccacagtcctcttctcatcgagctgacttttggagtggggagacaggcaggaataaaaaggagccttggggtggctatgggtgtcatgactatggtggagtgggacaatggggataaaaagtaaccggggctggggtgactgggatggcttctatgaggcattgaccctgagctgagccatgaatgactaaacagaaaagcaatgcaaaagtctgggggaaagacacgccaagcagagggaatggtaagtgcaaaggccctgaggtgagaattaggttggtgactgcatgttcatttcctgtggctgggtggcttggaacaatagaaatgtattctcccacagatctagaagctagaagtgcagaatcaaggtgttggcagggttggttccatctggaggctaagggaaaatgtttcatgcctcactccgagctttcggagactgctggcactcttggactttccttggcttgtagacgcttcactccaatctctgcccctgtcaccacatggtggtcccctctgtgtcctctcctcttcttacagacacctgtcttttcttttcttttcttttcttttcttttctttttttttttttggtctgtatttgagacagagtctcgctctgtcacccaggctggaatgcagtggcttcatctcggctcactgcaactctgcctcctgggctcaaccgattctcctgtctcagcctctcacgtagctgggattataggcatgcacccccacacctgtctaatttttctatttttagtagagacagggttttgccatgttggctaggctggtcttgaactcctgacctcaggtgatccacctgcctcagcctcccaaagtgttgggattacaggtgtgatccagcaggcccggccataaatatgcctgtctttataacccaccctaatccaggatgctctcatcttgagatctttaccttagttatacctacaaagacccttattccaaataaggttgtattctaaggtttggggtgaacatagctgttgggaaccagaactcaaccgactatagtgaggaacaatgtggccagcacgatgagcgtggggcctgccatatagtgaggtcgtgatcccctttcagacaaaagtaatgaaagacttgagatgaagatcatactatatttaaatgaaaaagtttctaaacagaatatgatatccattttcttttaaaatacgtgtatctgtgtacttgtgtatggaacaacagactacaggaacacacaccaggctgggcacagtggctcacccctgtaatctcagcacttttggaggccaaagcgggtggatcatgtgagcccaggagttcaagaccagcctgggcaacatagcaagactccatctgtacaaaaaatataaatatttagccaggcatggtggcacacacatgcagtcctagctacttgggaggctgtggtgggaggatcacttgagcccaggagtttgaggctgccgtgagctatgatcaggccactgcactccagccagggcgacagagtgagaccttgtctcaaaaaaaaaaagaaaaaagaaagaaagaaggaaggaagggaaggaaaagaaaaaagaaagaaagaaggacggaagggaaggaaaagaaagaaagagagagagaaggaaggaaggaagaaaaggaaagaaagaaagaaggaaagaaaggaagaaagaaagaaagaaagaaagagacagaaagacattctgatactcaggctgagccattggaaagtatcttctacatttgctctgtgtgtgtgtgtgtgtgtgtgggtgtgtgtgtgaaaggagaaagaggaagaggaagacagaatttatgtatgtagatctgtctatgtgtctatatattggaaaaggtggttataatcatatatgcatctattttgcattactgcctttaaacctgtcttgcagctgtttattttgggggcttagttcttggggtcaccagattcatgagttcactctctgctatgtagaccagaacttcctcacagctcttcccaacaatctctttccagcatcaagagattatccctaagtctagatccataaaatcagaggagcaagatcatgttcatttctgattctttgagctcccttccctttcgaggttcattctcttatttgccccacaatgccttacctgaagtgagggtgaaaccgcctttgcaaaaattataacggagaaaattatgatggtgaaatagatctaacctcactccatctttcttctaacctccaagctgtccttgttcagtactgggcataggccatactaacttcgggaggaacttgtttatagtttaactttgaaacaaagacaataacagccctttcccaaaacgaacccccttcctgcctgagggctagactgcctttgcaggactaacaaattagctataagattagaaattacggtttaccagccatgcagcctctggctgcaagattctgaaccttcccaaattgctcctgggaataacatcactgttgcaaaacctaaaatcagtgcttgaggtattttgcagaccctgcactctgatgcaccccctgacaccacccagtccagtaatctggctcaaccagttctgccatcccacccaggaacagaagacagtaagaaaactcactttgacccctatgatttcatctctaacccagacaatcagcattccccacttcccaagcccctacctgccaaattagccttaaaaacgctgatcccggattctctgatttgaataatgataaaactctggtctcttgtacagatggccctgcaggaattaaactttattgcaattcccctgtcttgttttttttttttttttttttttctttggagacagagtttcacaggctggagtgcaatgtcgtgatctcagctcactgtaacctctacctccccggttcaagctattctcctgcctcaccctcccaagtagtagggattacaagcatgcaccaccatgtccggctaattttgtatttttagtagagatgggttttcatcatgttggccaggctggtctcaaatttctgacctcaggtgatctgcctgccttggcttcccggaatgttatgattacaggcgtgagccacctggcctggccccgtcttgataaattggctttgtctaggcagtggacaaggagaactccactgggtggttgcaaatctggggagtcatccgggaccatccttgtggatacctgcctgacgtttgttagccctccaccagcgatggatctggaggcccgcccaagtggcaatttagttcttggactgggggctaactgtagcaccgtctctaccagcagggtgttgccaactcatggtgcatggattcaaatgcaataaacagtcctggggagatgtcccgctcctgtagccccatcatgggtgtctgatttggtgagtattctaggtgcttccaacaacctcatccttctgacctgctggcctctctgaagggggtgtctgctctaactggatcaagaataggggacttgtttggaggaacattcttggtttgtgatttggtctggagtctctgtctgcaagtccttctgcttgtctttttcacttgagtgtttgtgtatgtacaggaattgctgatggaagtccaacaggctctcctagtttgtctggtctgtcacatttgctgaaccctgaaggaactgttagcggaagcgcaacaggcctgactcgtggtgattttccattgttctggaagctgcagggaaagggaacccagaaatctggtatgccagcaaagagagtaagaacttctgacaagccaggcttctggtctctctctctctgtctctctctcactctctctctctgtgaatggtaaacatcattgtttgtctcctctgcaagggtttgattaattgaaaaaaggatttataactgggcacagtggctgtaattccagcactttgggaggtcgaggtgggcagatcacctgaggtcgggaagttcaagaccagcctggccaacatggtgaagccccgtttctactaaaaatacaaaaattagccaggcgtggtggcgggtgcctgtaatcccagctactcaggagcctgaggcaggagaatcgcttgaacccaggaggcagaggttgcagtgatccgagatcatgccattgcactccagcctgtgcgacaagagtgagatgctatctcaaaaaaaaaaaaaaaaaaaaaagctcttcaagaaaactggccttgcctggccagccgccccgtccgggagggaggtggggggggtcggccccccgcccagccagccgccccgtcggggaggtgaggggcgcctctgcccggccgcccctcctgggaagtgaggagcccctctgcccggccaccaccccgtctgggaggtgtacccaaccgctcattgagaacgggccatgatgacaatggcggttttgtggaatagaaaggcgggaaaggtggggaaaagattgagaaatcggatgattgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcacgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctccgcgagaaacacccaagaatgatcaataaaaaaaaaaaaagaaaaaaagaaaactgggcttataccttgtatatgcagtctctgtacagggttcctgacttgtcataagtaaagaatgtcactttctgacaggcccagaagcccaaattatcttgggaccttgagaggaggaaaattctcccaactcatacaggtatttgcaggcatagataaatccatggctgggctaaaggctttaaaaagtataaggtgagattccttagggaatgaaatttcagcaaagctaattttgtttttatttatttatttatttttgggccatggccttgctctgtcatccaggctcaggcgattctcccacctcagcctcccaagtagctgagactacaggcacgcgtcaccacacctggctaatttttgtagagacggggatctcgctatgttgcccaggctggtcttgaactcctgggctcaagtgtttctcccaccttggcctcccaaagtgctgggattacaggtgtaagccaccatgcctgaccagcaaagccaattttaaagagcctatatggcaaataattattcttgctgtacgttatacaaataatcaggccaagtataataagactaagacttatttcgcaattacatttgtcctactactatttgtttttaataaaaatggggactaaagagagaaaaactatgtttcaaaagctatagtacacccattgttagattctagtcttgtccactgttcttgagtttttgttattttctgcaatttggactaaatcctgaattctttgtggctgcagtgagctgtgatcacaccactgcactccagcctgcgtgacagagtgagaccctgtttcaaaaaaattaaaccagattttaaaaattgtgtgtcacagagataaccagtttttcttgttgactgcacctttaactatggctgtcctgaagcttacctaactaatgctccaaactaatgttttccaaactaatgctttcacatttttcttccacttttctgacttggactcaataaaattgctactaccttttttcctgaggccctgtaagctgaagcttattcttttaatataggtggcaaaaacatgtcagattaccactgccttcctgctctataactaaaggtattttgagtttcacatctggataaattgtgcccaacattaacttttgtttttcttatatttccatagaaatgcctcgtattaaaaatctgtttgtcttcatcatgtatagaggcctagcccgtgtgcaatgccacctcctgatatgggaaacagctgtttaactgaactgatctagtcccaggactaggaaactgattaataatatatgggacagtgtatttaaacttgctccttcctggctgactataggtgcattgcctatgagttagccctgatccacaaggagcagtaccaaataaaataaagtaaaataaaatgaaattcactcattcttgtctatcccaatatgtttgtccaaaaacctttgacccaactctctctgctagtgacccatgtctgactgattcttggagctattcacctggatccctcagagcttaagatcaattctacaaaggcttcttcttctttttttttttttttccatagacaaagtctcactttattgcctagactagtcttgaactcctgggctcaagcaatcctcctgccttggtctcccaaagtgctgggattataggcatgaaccaccacgcctgtgtttgttgttgtttttttttttttgagacagagtttccctcttgttgcccaggctgtagtgcaatggtgtgatctcggctcaccgcaacctccgcctcctgggtcccagttcaagcagttctcctgcctcagcctcctgagtatctgggattacaggcatgtgccaccacacccagctaaattttgtattttagtagagatggggtttcaccatgttgaccaggctggtatcaaactcctgacctcgtgatccacccacctcagcctccaaaagtgctgggattacaggcgtgagccaccgtgcccggctttttttttttttttttttttttttggtggagtctcactctgtcacccaggctgcagtgcagtggcacaatctcggttctctgcaacctccaactccctggttcaagcgattctcctgcctcagcctcccaagtagttgggattataggcgcccgccaccacacccagctaatttttgtaaattttagtagagacggggtttcaccatattggccaagatggtctggatctcctgaccttgtgatcctcccgtctcggcctcccaaagtgttgggattacaggcgtgagccaccatgcccggccatgctctgctcttatgagctgggtggccctgaatattttatcctctctgagcttcactttcctcattttgaaatcagaatcagtaataataccttccacatgggctacagtcagggtgaaacaagcaactataaaagcactgagctcctggctaacacggtgaaatcccgtctctactaaaaatataaaaaattagctgggcatggtggtgggtgcctgtagtcccagctactcgggaggctgaggcagcatggcgtgaacccgggaggcggagcttgcagtgaggcaagagcgagactttgtctcaaaaaaaaaaaagcactgagtatgggttccagcacatgggaagctctctataatgtaggtgccaccatcatcttcttcatcatcgtcttcatctcacctggatcatcatcaagtacttgtagttctatgggaatctaatattaggtcatcctgactctagtttactgtgaagagtctataagctcctattattgaacctgcgtttgcagctaaagaaataaattgacatcttatggtggcagcgatggttcacacctgcaatcccagcattttgggatgccaaggcgggaggatcacttgaagtcaggagttcaagaccagcctggccaaaatggtgaaatccatctctactaaaaatacaaaaattagccaggcatggtggcttgcacctgtagtctcagctacttgggaggctgaggcaggagaatggcatgaacccgggaggcagaggttgcagtgagccaagatcatgccactgcactccagcctgggcgacagagcgaaactccatctcaaaagaaaaaacagaaaaaaaaaaaaaaaggaagaaatttacattttataactcaaagtagaaggaacacaatttagaaacctcctgcatggaagaattcataagaccaaaatattaaagggagaaaacattctataggatgacacccaatcgcactgacaagcagagaaacaatgtgtgcaatggtgtcccgctacaaggcggggttccatgtcctcttaggtcctgtcactctaagtttaattttacaaaaatgggggctttgaaaatatcacatacttagtgggggaggttttgcgtgtgtggagacagagtgcacaggaccgtccgtactttctgctccattttgctgtgaatctaacactgccccaaaaaataaagttcattaaaaaaaatcacggccaggcgcggtggctcacgcctgtaatcccagcactttgggaggccgaggcagacggatcacaaggtcaggagtttgagaccagcctggccaacacagtgaaacctcgtctttactaaaaatacaaaaaattagctgggcgtggtggcgcacgcctgtagtcccagatactcaggaggctgaggcagaagaattgcttgaacctgggaggcggaggttgcagtgagctgagattgttccaccgttctccagcctgggtgacagagtgagactctgtctcaaaaaaaaaaaatcacatcctaaggtcccaaggacataaaacaagttagagacctcatccagttttttgtttgtttcagggacctgcaaccaactttcttactgaccagtttcctgggctgtctagaacagacagcttatggggtactaaccccatgctctatcctaaggtacccctcttcatgcagagcgacacagaaaaacaaatttgtagcacaaagtacacccgatttgctacagcttacgactagcctcatgaatcctttttctcattaattcaaagtttgcaaaaaaaagaaatcacatacttaaaaataaatcacttgagcacagaagcatatcaaaatctaatataaacaaacaaaaaacccaacttatgttaacatgccactgaaactgggctcaagttttcaaatgtcttatgaaatattacactctccagcaggctattttttttttcctaactggagatgaatggcagagttctgatatggaaaagcactccatgtttgtacagaaaggtagcataggaaaagtggtcaaattcaaccagtctgtcctcatcaaacaggcaactactgtcttctcagcatttccaaaagaaatcatatgtctgctactgtttatgtcatatgcctgttaatttttcatgctaattcttagtgtttctggaaaacctcactgtttggcaccaaaaattgttattgctattgttgttgttttgttaattatgtcagccaagcagatgacggtgaattaattctgcaacgttgagtactcagttggcatacaagcacccagccttccaaagggatgtccttcatgtttcactgattttcgaatgacagtcggcttgcctaaacttatcctttacatttaagacattttgtgggttcccgtctgcccaggggattcttattacttgtttatgcaaacagcaggttgcataagagccttgctggcttttttttttttttttttttttagagatttcgtagtttcctggtaaccattcagtcatctatttcaacaccctgacatgacataaaggcaggcgtggaaccacacgttcaccacacagacacacacctccttgctggagcattcactaggcgaggcgctccatcggactcactagccgcactcatgaatcggcaccatctgcaggatcactttctggaaatagacaagaagaactgctgtgtgttccgagatgacttcattgtcaaggtgttgccgccggtgttggggctggagtttatcttcgggcttctgggcaatggccttgccctgtggattttctgtttccacctcaagtcctggaaatccagccggattttcctgttcaacctggcagtggctgactttctactgatcatctgcctgcccttcctgatggacaactatgtgaggcgttgggactggaagtttggggacatcccttgccggctgatgctcttcatgttggctatgaaccgccagggcagcatcatcttcctcacggtggtggcggtagacaggtatttccgggtggtccatccccaccacgccctgaacaagatctccaatcggacagcagccatcatctcttgccttctgtggggcatcactattggcctgacagtccacctcctgaagaagaagatgccgatccagaatggcggtgcaaatttgtgcagcagcttcagcatctgccataccttccagtggcacgaagccatgttcctcctggagttcttcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctctccttaaataaccatgccaagaagggacattgtcaccaagaaccaggatctctggagaaacagttgggctgttgcatcgagtaatgtcactggactcggcctaaggtttcctggaacttccagattcagagaatgcgatttagggaaacggtggcagatgagtgggagactggttgcaaggtgtgaccgcaggaatcctggaggaatagagagtaaagcttctaggcatctgaaacttttgcttcatctctgacgctcgcaggactgaagatgggcaaattgtaggcatttctgctgagcagagttggagccagagatctacttgtgacttgttggccttcttcccacatctgcctcagactggagggggctcagctcctggggtgatatctagcctgcttgtgagctctagcagggataaggagagctgagattggagggaattgtgttgctcctggagggagcccaggcatcattaaacaagccagtaggtcacctggcttccgtggaccaattcatctttcagacaagctttagcagaaatggactcagggaagagactcacacgctttggttaatatctgtgtttccggtgggtgtaataggggattagccccagaagggactgagctaaacagtgttattatgggaaaggaaatggcattgctgctttcaaccagcgactaatgcaatccattcctctcttgtttatagtaatctaagggttgggcagttaaaacggcttcaggatagaaagctgtttcccacctctgtttgcttttaacattaaaagggaaatgtgcctctgccccacagttagaggggtgcacgttcctcctggttccttcgcttgtgtttctgtacttaccaaaaatctaccatttcaataaattttgataggagacagtctggcgttgctatatctgggttatggttcacagaaatggacttcttacttaagcagagacctttatgggttgttaactctgtcctggtagaaaactactccacactgcaaagtaagaaagagacacagacactgagctacatcatgaaacaactaagcagaaattacacctgtgtctaaacaaagatagaaagagctgggattaaaaataatttggaaggatagtacagataggatcgcaagagcacttacattttattagagtttggtgaatattgctcttagtatttgtgcattaaacagggaatcaaggccaggtgcaatggttcatgcctgtaatcccagcactttgaggggaccgaggtgggcagatcaccctgaggtcaggagtttgagaccagcctggacaacatggcgaaaccccacttctactaaaaatacaagaaaaattagccaggcatggtggcggccgcttgtagtcccagctactgggaaggctgggggaagaagaattgcttgaacccaggaggcggaggttgcagtgagccgaggtggtgtgcctgcactccagcctgggggacagagcaagacttcatctcaaataataataataaataatataaaaagggaatcaagccaggcagatatttttccataggagggggaagagcgagcttcctatggaatggtttcagttcccaattcagagaaggaaaggagatgtactggtttgagtctgtgatcagtccaagtttctgttacgctttcatttctaactctgtcagtccttgattatttggcaagacgaggcttgcttcaacctcctgacatgaacacagataaggaatttagagacaggctcccagctctgggtgaatgacagtaaatgaagaaaggtggatgctctggaattacctctgtgctttcagagcagttggcttgtctgtatcaccaagcaatgtacaggtaaaaagccaaaagcaaggatcaccttaaagaggaagagatgtcagggatgagctcagaggaaaatagggattccccagcctcggaggcatgagtcagtggggagcctcgttgtgaaacgcggattcgttcaagggatgaggtggtttggggtgtttggacctccacagctcacattcattcactgattcaggcattccatcagttctttgttttttttttttttttgagaccgagtctcactctgtcatctaggctggagtgcagtggtgtgatctgggttcactgcagcctctgcctcctgggttcaagtgattctcctacctcagcccccccagtagctgggattacaggtgtgcaccaccatgcctggctaatttttgtatttttagtagaggtggggtctcgccatgttgcccaggctggtcttgaactcctgacctcaggtgatccacctgcctcagcctcccaaagtgctgggattacaggtgtgagccactgtgcccagcctcattccatcagttttatgtattaagcaccaactgtgtgccaggcgctgttctgggtggtggagatagaacaagaaacaaggcagccacagtcctcttctcatcgagctgacttttggagtggggagacaggcaggaataaaaaggagccttggggtggctatgggtgtcatgactatggtggagtgggacaatggggataaaaagtaaccggggctggggtgactgggatggcttctatgaggcattgaccctgagctgagccatgaatgactaaacagaaaagcaatgcaaaagtctgggggaaagacacgccaagcagagggaatggtaagtgcaaaggccctgaggtgagaattaggttggtgactgcgtgttcatttcctgtggctgggtggcttggaacaatagaaatgtattctcccacagatctagaagctagaagtgcagaatcaaggtgttggcagggttggttccatctggaggctaagggaaaatgtttcatgcctcactccgagctttcggagactgctggcactcttggactttccttggcttgtagacgcttcactccaatctctgcccctgtcaccacatggtggtcccctctgtgtcctctcttcttacagacacctgtcttttcttctcttttttttttggtctgtatttgagacagagtctcgctctgtcacccaggctggaatgcagtggcttcatctcggctcactgcaactctgcctcccgggctcaagcggttctccttcctcagcctctcacacagctgggattataggcatgcacccccacacctgtctaatttttctatttttagtagagacagggttttgccatgttggctaggctggtcttgaactcctgacctcaggtgatccacctgcctcagcctcccaaagtgttgggattacaggtgtgatccagcaggcctggccataaatatgcctgtctttataacccaccctaatccaggatgctctcatcttgagatctttaccttagttatacctacaaagacccttattccaaataaggttgtattctaaggtttggggtgaacatagctgttgggaaccagaactcaaccgactatagtgaggaacaatgtggccagcatgatgagcgtggggcctgccatatagtgaggttgtgatcctctttcagacaaaagtaatgaaagacttgagatgaagatcatactatatttaaatgaaaaagtttctaaacagaatatgatatccattttcttttaaaatacgtgtatctgtgtacttgtgtgtggaacaacagactacaagaatatacaccaggccgggcacagtggctcacccctgtaacctcagcacttttggaggccaaagcgggtggatcatgtgagcccaggagttcaagaccagcctgggcaacatagcaagactccatctgtacaaaaaatgtaaatatttagccaggcatggtggcacacacatgcagtcctagctacttgggaggctgtggtgggaggatcacttgagcccaggagtttgaggctgccatgagctatgatcaggccactgcactccagccagggtgacagagtaagaacttgtctcaaaaaaaaaaaaaaagaagaaagaaagagagagagagagatgaaagaaagaaagaaagaaagaaagaaagaaagaaagaaagaaagaaagaaagaaagaaagaaagaaagaaaagaaagtaagaaagaaaggaagaaaagaagaaaaaagcaagcaagcaagcaagcaagcaagcaagcaagagacactctgatactcaggctgagccattggaaagtatcttctacatttcctgtgtgtgtgtttgtgtgtgtgtgtgaaacgagagagaggaagaggaagacagaatttatgtatgtagatctgtctatgtgtctatatattggaaaaggtggttataatcatatatgcatctattttgcattactgcctttaaacctgtcttgcagctgtttattttgggggcttagttcttagggtcacaagattcatgagttcactctctggtatgtagaccagaacttcctcacagctcttcccaacaatctctttccagcatcaagagattatctctaagtctagatccataaagtcaggggagcaagatcatgttcatttctgattctttgagctcccttccctttcgaggttcattctcttatttgccccacaatgccttacctgaagtgagtgcgaaatcgcctttgcaaaaattataactgagaaaattatgatggtgaaatagatctaacctcactccatctttcttctaacctccaagctgtcctcgttcagtactgggcataggccaaactaactttgggaggaacttgtttataggttaactttgaaacaaagacaataacagccctttcccaaaacgaacccccttcctgcctgagggctagactgcctttgcaggactaacaaattagctataagattagaaattacggtttacaagccacgcaacctctggctgcaagattctgaaccttcccaaattgctcctgggaataacatcactgttgcaaaacctaaaatcagtgcttgaggtattttgcagaaccctgcactctgatgcaccccctgacaccacccagtccagtaatctggctcaaccagttctgccatcccacccaggaacagaagacaataagaaaattcactttgacccctatgatttcatttctaacccagccaaccagcattccccacttcccaagcccctacccaccaaattagccttaaaaactctgatcctggattctctgatttgaataatgataaaactctggtctcttgtacagatggccctgcaggaattaaactttattgcaattcccctgtcttgttttttttttttttcttttgagacagagtttcacaggctggagtgcaatgtcgtgatctcagctcactgcaacctctacctccccggttcaagctattctcctgcctcaccctcccaagtagtagggattacaagcatgcaccaccatgtccggctaattttgtatttttagtagagacgggtgttcatcatgttggccaggctggtctcaaacttctgacctcaggtgatctgcctgccttggcttcccaaaatgttatgattacaggtgtgagccatcggcccggccccctgtcttgataaattggctttgtctaggcagtggacaaggagaactccactgggtggttgcaaatctggggagtcatccgggaccatccttgtggatacctgcctgacgtttgttagccctccaccagcgatggatctggaggcccgcccaagtggcaatttagttcttggactgggggctaactgtagcaccgtctctaccagcagggtgttgccaactcatggtgcatggattcaaatgcaataaacagtcctggggagatgtcccgctcctgtagccccatcatgggtgtctgatttggtgagtattctaggtgcttccaacaacctcatccttctgacctgctggcctctctgaagggggtgtctgctctaactggatcaagaataggggacttgtttggaggaacattcttggtttgtgatttggtctggagtctctgtctgcaagtccttctgcttgtctttttcacttgagtgtttgtgtatgtacaggaattgctgatggaagtccaacaggctctcctagtttgtctggtctgtcacatttgctgaaccctgaaggaactgttagcggaagcgcaacaggcctgactcgtggtgattttccattgttctggaagctgcagggaaagggaacccagaaatctggtatgccagcaaagagagtaagaacttctgacaagccaggcttctggtctctctctctctgtctctctctcactctctctctctgtgaatggtaaacatcattgtttgtctcctctgcaagggtttgattaattgaaaaaaggatttataactgggcacagtggctgtaattccagcactttgggaggtcgaggtgggcagatcacctgaggtcgggaagttcaagaccagcctggccaacatggtgaagccccgtttctactaaaaatacaaaaattagccaggcgtggtggcgggtgcctgtaatcccagctactcaggagcctgaggcaggagaatcgcttgaacccaggaggcagaggttgcagtgatccgagatcatgccattgcactccagcctgtgcgacaagagtgagatgctatctccaaaaaaaaaaaaaggaagaaagaaagaaaagaaaaggaaggacattctggccaggtgcagtggctgtaatcctagcactttgggagactaaagcaggcagatcgcttgagtccaggagttcgagaccagcctgggcaacatggcaaaaacctgtctctacaaaaaaaatgtgaaaattagccaggcatgctggtgtgcacctgtggccccagttacttgggaggctcaggtgggaggatctcttgagcttgagaggtcaaggctacagcgagctgagatcacatcactgcactccagcctgggcaacagagtgagtttctctcagaaaaaacaaataaaataaacaaaattgaaagggaaggacattttggctcacactgcaaacatgaatgatcattgaggacattatgctgagtgaaataagccagtcacaaaaggacgaatcttgcatgattccccttatacgaggtccttagattagttgaatccagagacagaaagtaggatggtggttgccgggagctggggtgaggaagaatggggagtcagtgtttaatgggtccaaagtttcagtttcacaagatcgaactggagatggatggtagtgatgattgtataagaaaataaatgtatttaatgccactggactgaacacttagaagttattaagacggcaaattttatgtatactttactataagttttgtttttgagacagtctcactctttcgcccaggctggaatgcagtggcacaatctcggctcactgcaacctcagcctccaggttcaagcaatcctcctgcctcagcctccctgagtagctgggattacagacatgtgccaccatgcccagctaatttttgtatttttagtagagacggggttttgccatgttggccaggctggtctcgaactcctgacctcaggtgatccacctgccttggcctcccaaagtgctgggattaattacaggtgtgagccaccgtgcccggcctattttactataatttttaaaaactaaaacatggaaataatatgattcctaatctatactgggaatgttctgttacctgatctgagtgttgtcacacgggcatgatgacttcatgaaagtctattataatttctgtatttttctgtatgttagttgacttcagtaaaacttatgattattacttctatttattattattatcatcatcattgttattagagatggggtatcattatattgcccaggctggtcttaaactcctgggctcgcataatcttcccaccttggcttcccaaagtgctgggattacaggcgtgggcgactgtgtctggccagattatttctaatcaataactacacagaaagcacactgttatttaaaggattctatacttcacccaaaggcagaagcagtggaaattgagaaaggaggttgtagtaggttgaaggttgaagagtgccctctgctaaattcatgtcttccgggaacctcagaaggtgaccttatttggaaatggggtctttgcagatggaattaagataaggatcaagatgagatcatataggattagggtgggcaatgacagtgtccttagaagagacagaagaggccagacagagaagaagtccacatgaagacagaagcagtgattggagtgacgtggccatgagccaggggatgcctggaaaagacagagaaggatcctcccctagagactttggagagagtgtggatctgctggcagcttgattgctgacttctggcctccagaactatgagaaaataaacttctgttgttttggcgaggcatggtggctgacacctgtaatcccagcactttgggaggccaagagcaggtggatcacttgaggtcaggagttaaagaacagcctggccaacatggcgaaaccctgtctctactaaaaattagccgtgtgtggtggcacatgcctgtaattccagctacttgggaggctgaggcaggagaatcgcttgaacccgggaggtggaggttgcagtgagccaagatcacgccattgcactccagcctgggggacagagtgagactccatctccaaaaaaaaaaaaaagccaacaaaaaacatctttttcattgtttcttacaacccttatcacttacgttttcatttcaccctcgctgtcagcttccctttgtccttccgaaagcacagaagtaaaaatgaaacatagaaaaatcccaccggtaatctagaccgagccagaagaatgtacctttctgagaaaagaccacccatcaatagatctgcacgtggggatcttgtgtttacatgccaaactcgtgaatggtagagctgtcaccctaaatgtggtaccctgtggccggttatgagtcattaaaaaaaagggagacagagattcaccggcacatgtgttcatactgcttgatgatgaaacttttcttagatctgaccaaaacaccaactgccaagcacatggcaccacggggaagggggagggatgaagttttgtaaattaccacttcttcttttgaggtatgaaatataatgtgggttatgagtaatgtacccttttaagatataaccaagttaccaagcctacctaaataacatcagaaaacatgagttgacaatcatttggttttgaggtaataacatttcctcctgattcattacattagctctttgaatataaggaatgtcctaatgcttcctacatatatgtatattcatattaaatgagacagtttcaagcaattccaggaacttggatattaagtaactatcatgtcataaagagggagtgggagttagttaggcaaagagggaaggggagcaaagacttgaaacagcatgaaacgtgcagagaattgtatcccggatacaagacagggagtgaaaaagtctgaccagagagtctttttttttgttgttaatttgtatttttgtttatttatttatttttgagacagtcttgctctgttgcccaggttggagtgcaatggtgcaatcttggctcactgcaatctccgcctcccaggttcaaacaattctcctgcctcagcctccccagtagctgggattacaggcacgcgccaccacgcccagctaatttttgtatttttagtacagatggggtttcaccatgttggccaggctggtctcaaactcctgacctgaagtgatccacctgcctcagcctcccaaagtgctgggattatagctgtgagccaccgtgccagccttttgttgttaatttttaatttttaacttttaggtacatagtaggtgtatatatttatgggatacatgagatattttgacacaggcatgccatgcgtaataatctcatcagggtgaatggggtgtccatcaccttaaacatttatcctttgggttacaaacaattcagttatactcttttagttattttaaaatgtacaattaaattatgttgactatagtcactctgttgtgctatcaataccaggtcttattcattctttctattttattattattattattattatttttgagacggagtttcactcttgttgcccaagctggagtgcaatggcgtgatctcagctcactgcaacctctgcctcctgggttcaagcgattctcctgcctcagtctcccgagtagctgggattacaggcacgtgcccccacgctcagctaattgtttgtatttttagtagaaacggggtttcaccatgttagccaggctggtcttgaacccctgacctcaggtgatccacccgcctcggcctcctgaagtgctgggattacaggcatgagccaccgtgccccgcccattctttctattttctgtacccattagccatccccacgtccccctcctcccccaactccactacccttcccagcctctagtaaccatcctactctctatctccatgagttcgattgtttcaatttttagctctcacaaataagtgagagcttgtgaagtttgtctttctgtacctggcttatttcatttaacagaatgacctccagtttcatccatgctgttgcaaatgacaggaccttattcttttttatggctgaatagtactccattgtgtatatgtagcatattttctttatctgttgatggacacttaggtctcttcaagtcttagctattgtgaatagggctgcaataaacatggagtgcagctatctcttccatatactgatttcctttcttctaggtatacactcagtagtgggattgctggatcatatggtagctctattttaagtttgttaaagaacctccaaacttctccatagtggttgcactgatatgggagtgctgggaggggaagagcgtggtccctttaaatgatatggaaggggggaagggaaatgctgggtaaaggagggtgtggtaactggctagggctccacccctacggacctaggtaaggacaggcactcctgccttccgcgcccaaatgttgcatttcccatgactactctggccccccatgcccccatcctgtgcctataaaaacccgagaccggccaggcgctgtggctcatgcctgtaatcccagcactttgggaggctgaggcggacggatcacgaggtcaggagatcaagaccatcctggctaacacggtgaaaccccgtctctactaaaaatacaaaaataaaaaattagccgggcgtggtggcgggcgcctgtagtcccagctactcaggaggctgaggcaggagaatgacttgaacccgggaggcggagcctgcagtgagccgagatcgcgccactgcactccagcctgggcgacagagcgagactccatctcaaaataaaataaaataaaataaaaccccgagaccctagcaggcagacacaggtggctggacatcgagaggacatcgagggtagcacgctggcggaagagcacatagtcagacactggcatgcctacaggccatcaggccattgactgggggaatgaggcggagtttggcctgggcagtcggaggagagcccgggctgcgaagaagccgcccgactcccgaagaaaaccatctcctttctggctcccctatctgctgagagctacttatcaataaaaccttgcactctcattcgccaagcccagtgtgatccgattcttccagtacaccaaggcaagaaaccccgggatacagaaatccctctgtccttgtgataagggggcctaattcagcttgttaacacaagccgcctatagatggctaaactaaaagagcacactgtaacacacgcccactggggcttcagctataaacactcacccctagacgctgccgtggggttggagtcccacagcctgcccgtctgtatgctcttctagaggtttgagcagcagggcacggaagaaaccagccactcccccatcacacttcctgcgacaaggaagcctttcccgtttcagtactaattcacagagtccttaactgacattttaaagatgagttgaacctgtgtatctattttgaagcaagttaattaaaaatcaccctaaaattgtcaaggtggttaaaaggctacaggaaatatcaatatttttaataatagccaaaggtagaagcaattgtatgatattatgacagaagaatatgtatttggtcttagtccccagttcctgggatgctaaaacccttgtaatttcctgggcaacaagcatgttagcatggtgcctcttttgttctaatatctggtctttgacctcagctcctggcacagagctcctaatcccttggggtttcctgggtaataggaggatcttttgttctaatgaggcaactttttgtgggttcctggttgggggctggtcaccagaaagaccaaactgtggttagaagcttgaagcttccaggctcatcccccatctgctgggaaaggaagaggagctggagactgagttattataataatcaatcatgcccacgtgatgaagcctccataaaaatccctgaactacaggatgcagagcgcttcggggctagtgaactacagtagatccatgtgccaagatggtgcaacccagccccatggggacagacgctcctgcacatgggcccttccaaacctcgccctatgttatctcttcatttgactgtttatttgaatcctttaatatatcctctgttttttgtttttttgtttttgagacagggtccgtctctgttgcccgggctagaacacagtggcataacatggctcactgcagcctcgacctcccaggctcaagtgatcctcccgcttcagcctcccatgaagctgggactacgggtgcatgccaccatgcctggctaacttttttgttttgtagagatggggtttcactatgttgcctaagctggtcttgaactctgggctcaagtgatccttccgtctagtaggtctcccaaagtgctgggattacaggcatgagccaccactgctggccattaatatatcctttataataatctagtaagtaacctgttttcctgggttctgtgagctgctctagcaaattatagaaccaaaaagggggtcatgagaacctctgatttgtagccaagttgagcaaaagttgtgaaaaacctgggaactcaccacttgtgattggcgtctccaacgggggcagtcttgtggcactgggttggtaacctgtggcatgtcatgctatctccaggcagatagtgcaaatcggtgtctgcagagaagtgaactgcctggtgtgggaaaaaacccctagcatctggtgacagaagcgttctgtgttgagtgtgtagtggtagaaaacagtttgtttttcccctatgcaaacccaaatgttattcaatggatgaatggataaactaaatgcagtctatccacacaatggaacattactctcccataaaaaggaacgaagttctgatccctgctacaatatggatgaacctcgaaaatgttaagtgaaacaaccctgacacaaaggccatatattgtacggttccatttataggaaatgcctagaataggcaaatccaaagacacagaaagcagaaaaggggttgcttagggagaattggggtgggggattgggggacaacagctgaagggtttcttttagaggtgatgaaactgtcctaaaattgtgataatggttatatgtatctgtgaatatactaaaaactattgaattgctaactttatttattcacttagagacagtctcattctataacccaggctggagtacagtggcaagatcatgactcactgcagccttgacctcccgggtttaagcaatcctctggcctcagcctcacaagtagctgagactgtaagtgcatcccacaggccgagggcagtggcccacccctgtaatcccagcactttgggaggccgaggtgggcggatcacctgaggtcaggagttggagaccagcctggtccaacatggtgaaaccctgtctttactaaaaatacaaaaattagctaggtatggtggtgagagcctgtaggtccacctactttggaggctgaggtgggaggattgcttgaacccaggaggcagaggttgcagtgagccgatatcgtgccactgcactccagcctgggcgatgagagcgaaactccgtctcaaaaaaaaagaagctatacttattaaaaagaataatagcattcacttgtataacatttgcctttggaaaggccctgttctaagcatttctgctatgagatgcagaattaaatgtactaacccagaaagatgtccaagatatgtccttaagtgaataaaaacgaactaccaccttgcagcttgtgtggtataattcgatttttataaattaaaatatgatgttttttatttccttgtacgttgttggtgggagaataaaaagttcatttgctgtgggaaacagtctggcagttcctcaaaaagttcaacatagaattgccacacgactcagcaattccactcctaggtatacacccaagagaactgaaaacagagactcaaatactcgtacatggatattcataacagcagtcttcctatagccaaaaggtgatgtgttggtttagtttatgtgttaacttggctgggccatggtgcccagatatttgattgaatactattctagatgagggtgtgttttagatgagattaacatttaaatgtgtggcctttgagtaaagtaggttgcactccacagtgtgggtgtgcctcacctgatcagttgaaggccttagaagaacaaagactgagctcgtctgagcaagaaagaattctgccagcaacatcagttcttcccagggcgtccagcctgctggcctacccttcagatttgggacttgccatcctccatgattgtgtgaatcagttcctcaaaataaatgtctttatagaaacagaaaattctatggtcctgtttctctggaggatcttgactaggacaagtagaaacaagacaaatggtcacctgtgaatgaatggatgaacacatttgtggtatataaatacaatggaaaatattattcagccattaaaatgctgaagggatgaagtgcttttaatggtttaatgaatccttttataaaaaggatgcgtcatgctacaaagtgtatcagtctcaaaatcattattctggttgggcacgttggcccacacctgtaatcccagcactttgagaggctgaggcgggtggatcacctgaggccaggagtttgagaccagcctgcccaacgtggtgaaaccctgtctctactaaaaatacaaaaaattagccggttgtggtggcgggcacctgtaattctaactacttgggagactgaggcaggagagtcacttgaacctgggaggcagaggttgcagtgagctgagatcacgccattgtaatccagcctggacaacatgagcgaaactgtgtctcaaaaaaaaaaattattattgtaagtaaaagaagccagacacaaaaggtcacatacagtatgatttcatttatataaaatacccagaatagatagatcataaagacaggactcaggttagcgtttgccaggggagaatgaggaatgactgcttaatgattttggggtttgcttttggggtgatggaaatgttttggaagtagatagaggtggtgtttgcacaccagatggagatactaaatgtcattgaattgctcactttaaatggttaattttgtgttattgtgctattgtgttatgtgaattgcaactcaattttaaaaattatatatacattttaaaatctggaatacattttaaaatttgtactctggagttaagctgcctggtttaaagttaattctctcgctgagtagctgtgagatcttaggcaagctatttcacctctttgtttcctcctgtgtaaaacaggaacaatattacatcactctaatatgaaggaaaaatgagttaatctgtgtaaagtgcttataacagtgtataacacagaggaggtgctatgtaagttgtagctactattattattatttttttatttttatttttattttttgagacggagtcttgctctgtcgcccaggctggagtgcagtggcgtgatctcggctcactgcaagctccgcctccctggttcatgccgttctcctgcctcagcctcccgagtagctgggactacaggcgcccgccactacgcccggctcattttttgtatttttattagagacggggtttcaccgtgttagccaggatggtctggatctcccgaccttgtgatccgcctgcctcggcctcccatggtgctgggattacaggcttcagccaccgcgcccgccctattactattattattataattatatgaccaaactgtcacagtactctggggagagagaaaccttcattttttactgtatatgcttctgtatggtttgaatattttgcaagaagcatgtaatatttttacaataaaagactaaaatgcattgtagtaagactctcagagtgtctgggagcacagaattagagtcaagctgatcctctgccagtgcttttagtccactgagaatcgacctgtggcgggtcatcccagcttcaaccagtgagatgcgtttatgctgatacttctgatactctgggtccctcatatgagggggtccttggtttgactaagcaaagacaggttttgctgcctgacttaacaaagtgcttatctcatcccgataaaattgtatcatcttttaaaattagtcctcctctacattgaatgtttatgggcctcttgtgacagaactggttgtgtcccttgtcagtcctgtgctgcaagagcaaatgaccttattaaacgtctactttttggagaagcagaacaggttgctttttattaactgctgtggtgccgctcctccctcttcatctcagtcccctaatccttctccctttgagcagggcttctgggatcaagagtgcagatgatggcctatttatgtgttgtttttgtcttcccagcatccaggcactctacttgggcattagcatcctgattttccttgggcaacagattccgccctctccatccatctccgaggtttggaggattggggatttggttccaccccttgcctctaaaaataggcatgtgaccaggtctggccaatcagatcattccatccctgtggccactgtgactggcccagggatgagcacatgactcaaaatgctaatgagacattcacctgagttgttccctggaactgttggaaaagataaatatctctttcttctgggatggttaaactaatagaaaataacgtaagtaagcagtaggaagaaaacatagggatagagccaacagatgaaaagagatagcaaccttaaaaaaaaaaaacttgtaagccgggcgcggtggctcacaactgtaatcccagcactttgggaggccaaggcggccggatcacgaggtcaggagatcgagaccatcctggctaacacggtgaaaccccgtctctaataaaaatacaaaaaattagcccggcgtggtggcaggcgcctgtagtcccagctactcgggaggctgaggcaggagaatggcgtgaacccgggaggcggagcttgcagtgagccgagatcgtgccactgcactccagcctgggcaacagagcgagactctgtctcaaaaaaaaaaaaaaaaaaaaaaaaaaacttgtaaatttgacataatttcaaatgtacagaaaatctacaagaatagtatgaagaaactcccatgtgtttacccaaaatcaccaaacatacacacttctcacatttgttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagatagttcatcacatgaggttgcagtgagccaagatcatgccactgtgctccagcttgggagacagagtgagactcgactcaaaaaaaaaaaaaaattccacagatagactgtgtatttgtttatatactgtggtccttgggagggcaaaccttgtgtctaatggaaacacgtgcaggggacacagactcagaagactataggaatttataaaatcactgctggctcaccaaaaacacaatagccaacccttcgggccagtaggctaccagattaaagactctgattcatcttattttgttaaaatttatatatagacagacaaatacagaatcttttattgggtatgttaatgtgttcatatatctattttttttttttgagacgaagtctcactctgttgcccaggctggagggcagtggcacgatctctgctcactgcaacctccacctcccagttcaagtgattctcctgcctcagcctcccgagtagctgagaccacaggcacgcgccaccatgcccggctaatttttgtatttttagtagagacagtgtttcactatgttggccatgctggtctcaaactcctgaccttgtgatctgcccgcctcagcctcctaaagtgctgggattacaggcgtgagccactgctcctggcctttttttttttttttttgtgagataaggtctcactttgttacccaggctagagtgcagtggctcaatctcagctcactgcccacctcccaggctcaagcgatcctcccacctcagcctcctgagtagctggtaccacaagcacacaccaccacacctggggtaatctttttttttttttttttttttttgtaaagatgggtttcaccatgtttcccaggctgatcttgaactcctggattcaagctatttgcccacctcgaactcctaaagtactaggattacaggctcgagccactgcacctggcccatatacccaattttattttagactactccaggcaaacttagtcctgcaaactttacctgtgctgtaaatatttcaggcttgcaagtcatgcagtctctgtcccaactactcaactctgccttgtagtgacaaagaagccacagatcatacgtaaatgaatgcaaatactctagggtgagaggacagaggcccctggggtgcacactctaaggagacactcatctcaggtcctgaaagtgcaggggtgatgctgagagtgagcgagtggttcagcctctccctagtcctggccctgtgaatagctatgttccaataaaactttatttataaaagactttatttatttttttaaaactttatttataaaaggtggcaggctagtttggcctgtgggctgtggtttgccacccctggtaaagctttttctcatctgactcctggttttccagctcaacccacataagtctcccaacccctccctacaagtaacagatattaacccataggcgttctctatgctttcctgtgtctgcataaagtcctctacatatagatattttttgtttcataaaaatgggagacaatgtacacattttttgtatcatgcttttcacacttcacaataatttgcggaaactttgccagtcagaggcattgatttcttttttttttttttttttttttttttgagacagtctcttgctcagttgccaggctagagtgcagtggcgtgatctcagctcactgcaacctccgcctcctgggttcaagcaattctcctgcctcagcctcctgagtagctgagactacaggcatgcaccaccacgcccagctaatttttttgtatttttagtagagacggggtttcaccatgttggccaggatggtctcgatctcttgacctcatgatccacctgtcttggcctcccaaagtgctgggattacaggcgggagccaccacgcccggccggcattgattccttttatatagctatatgatattccatagggtggaagtagcattattcgttatgccttttctttttgatgggcgttcactttgtggtcagttttctgccacatgcacacacacaaaaacagtgctccaatacacattcttgtccttaagtgttggtgtttttatttctttggatagattctcaagagtgggattagaagatcaaagggtatgtttagtttccattttaacagatgttgccaaattgctttcccaaatgactacaaaacttcatatctgagcatgcccttttctccatattcctgccagcatttgagattttttttctcgttttagcttgatgaatcagtttattctgaggaatgtagagagatgtctcattgctgctttcattcgcaagtgtctgacccctgtaagtttgagggtctcttcatactgttggttacccatttggttttgctcctccgcaaatggtctatttatagtctaagtccatttctgtattggttgattctctttttcagaacaatttgtaaaagctctttatatagtgtccatttgacttttggctttcatctacaaagtgattaagaggtttggtgctggggcaggctgccaaaggttacatcttgactgagccctgactggccacatgacctcagcaaattatttaccttcattatttaacctctgtactcaactataaaatagtgatcatcatcatcatcatcacggtaattcctccttcatagtgctgttagagatgatgagttaatgtgtgtcaggtacgtagaattcagcctggcacacactaagttcatcaatagaagttggtgactattatttgtattacaaatattttttcagctccatcatttgaattggttttatttctggtatcccttgtcacacaaaatgtttcagtgtttatacggtcaaatatatccgtctttttttcccctagcttctgagttcccaggcttggtaagaaggtctccttgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagaaaaaaaaaaagaaggtctccttgtttccttcatgactaatttcctcactcttaaaatgagaaacataggacctactattttcctcactgaagtaccctgtcctctcagctccttgatctcccctcccctcccctcctttccttagcagggtttctctctgttgtcgaggccagagtgcagtggcacgatctcagctcactgcagcctcaacctcccacactcaagcaactttcctgcctcagcctcccaagtagctgagaccacaggtgcgcaccaccacgcctggctaatttttgtatttttttttttttttttttgtagagacagggtttcgccatgttgtccaggctggtttcaaattcctgccctcaaacaatccacctgcctcggcctcccaaagtgctgggattacaggcgtgagccaccgcgcccaaccctccttgatctatttcatccctaaaagaaaaaaaataaactatttttctctacactcacaacactcctgacacccactggggtttccacaccaagcagcactccagttctctttggacactgactgggtgtcctacagttcaaatctgacactgttcagcctggagttagcatcagatcccacaagctaaagggcccagttcacaagacggcttccatccactccagaccccaatcacaagtcccagcttcccacaggtacttttttttttcctttccaacttttattttagattcagagggtacatgtgcaggtttgttccatgggtgaatcgcgtgttgctgatgtttggtgtacagattgttttgtcacaggggtaatgagcacagtatctcataggtagttttccaatcttctccctctgcctccgctccaccctccaataggccctggtgtctgtgtttttctttgtgtccacgcgaactcaaggtttagctcccacttataagtgagagcaggtggtgtttgtttttctgttcctgtgttagttcacttaggataatggcctccagctccatccacattgctgcaaaggacatgttttattcagtctttttttttttttttttttttgagatggggtctcttgttacccaggcaggagtgcaatagctcaatcacagctcacttcagcctcgacctccctgggctgaagcaatcctcccacctcagctttccgagtagctgggactactgcgtgcaccaccatgcttgactaattttttgtttttcatttttttttttgtagagacggggggtctcactatttttgcccaagctggtctagaactcctgggctcaagtaatccttccacctcagctttccgaagtgctaagattacaagcgtgagccaccatgtctggccgattgtgttttttatggctgtgtagtattccatggtgtatatgtaccagactttgtttacccaatacacctgtacttccaactgaccggatataaatcaaaagttcccacagtccaatcctcaggttcagtaatttgctagaatagctcacaaaactcgggaaaacactttacttatatttattggtttgtcataaagaatgcaactaagaaacagctacgtggaaagagatgcatggaggatatagtatggggcgggagtgtgcagagcttccatgcgccctccgatgtgtccctctagcacttcattgagttcaccaactcagaagctctctgaactctgtcctctagggactttgtggagacttcattatggaggtgtgactgattaaatcactggccactgggcccagtggctcacgcctgtaatcccagcactttgggaggttgagacagatggatcgcttgagcccaggagttcaagaccagcctgggcaacatggtgaaactgtgtctctacaaaaaatacaaaaattagctggtggtgtgcagctatagtcctagctacatgggaggctgaggtgggaggatcgcttcaacctggagaagttgaggctgcagtgacccgtgatcatgccactgcactccagcctgggtgacagagcaacaccttgcctcaaaataaaacaaaaccattggccattgatgattaagtcaatctccagcccctctcccctcccagaggtcaaggggtggagctgatagctccaatcctgtggccatgccttggtctttgcagggagcagcccctgtgctaaagctgtctggggactccagctaccagtcatctcatcagcatattaaaagacaatcaccacactctggggatttcaagggtcttaaaagctcttgtgtcaggaaccagagactaagaataaaaataatcgcaaaggatgttcacctatcctcaggaaattgcaagggttttagaggctctgtgttagaaaccaagggcagagatcaaatatacatttctcctgtcgcactccccttctccctcaccccagtgagatgacacctttagagcgctttcgcttcccctctcttccatttcccctgccccctgttccctgagagactcatgaaacacatctattccccaccccactttctgaggtttggctgagataatctagcatttcttataatttcccttatgggatatccgtttggtttcaataatcctcttttctaagggtccttctctattacacaaatccccagtctatcctgttccattttgagttaaaatgtcatctgcctatgttcttttttttttttttttttttttttgagatggagtctcactctgtcacccaggctggagtgcagtggcatgatcttggctcattgcaatctctgcctcccaggttcaagaaattctcctgcctcagcctcccaagtagctgggattacacgtgtgcaccaccacacccaactaatttttgtatttttggtagagacaggtttcgccatgttggccaggctggtctcaaactcctgacctcaagtgatttgcctgcctcagcctcccaaagtgctgggattacgggtgtgagccaccgcgcccagccctgcctatgttttgaacatggttttcgctctctttctttttccctttgttaagtcttcttttcagggctatttgcagcttgatcaggtcttttccaagtagtgccatcagatggagggtgcgccagggttgtctctgaattttcttttttttgagaccagggtcttgctctgttgcccaggcaggagtgtaatggcgcaatcatggctcactgcagcctcgacctcctggactcaagcaatcctctcacttcagcccccaagtagctgggactacaggcacatactaccacgcctggcaaattttttggtattttttgtagagacagggtctcaccatgttgtccaggctggtctcaaactcctgcactcaagtgatccctcccacctcagcctcccagggtgttgggattacagacgagagccactacgcctgcctgatttcttgagtatctttgaaaatctacctgttgcttcaattgatgaaaaaaaaattttttttctttttttttgagatggagtctggttctattgcccaggctggagtgcagtggtgcaatctcggctcactgcgacctccacctcccgggttcaagtgattctcctgcctcggtctcctgaacagctgagattacaggcacctgccaccactcccagctaattttcgtatttttagtagagacggcatttcaccatgttggccaggctggtctcgaattcctgatttcaagtgatccatctgcctcggcctcccaaagtgctggggttacaggcgtgagccattgcgcctggccaaaaaaaatgttttgagaacagaatagaggattcttggattgctgtcctttctctcccttctctgtagataagaagtgtagattactctcatctttcagtaatgcagatgaagtctgattctagtctgagatttttctttcgtatcttctttctctgcttgacacttgtaaactgttgtttttttttttaatctttctgaatttttaccagaataggcctccagaagagtcttctcagtgcagccaggaactcagtgagctcttttaatctgcagtctcaggtctttattagttttgaggaactttacttctatgatttatctgttgcatcttctcattttagaactcctattatgtacatattagttcttcgggaggaaggatatcctcccacccttctttttttttgagacggagtcttgttctgtcacccaggctggagtgcagtggctcgatctcagctcactgcaagctctgcctcccgggttcacgccattctcctgcctcagcctctccaagtagctgggactacaggcacccgccaccacgcccggctaatgttttgtattttttagtagagacggggtttcaccgtggtctcaaactcctgacctcgtgatccgcccgcctcggcctcccaaagtgctgggattacaagtgtgagccactgcgcccggcctatcctcccactcttatattttctcacaagatctccatctctttgtaatgttgctctgttttgagatctttcttgtactttatctcccagactaatttgagtctcagttgaggccctactggcttttaattcttaatggaatttcttagagctaaaataatcatgtattttagctctaaaaggtcatttctttcttttttttcttttctttttttttttgagacggagtttcactcttacagcccaggctggagtgcaatggtgcaatctcggcttgctgcaacctccgcctcccgggttcaagctattctcttgcctcagcctcccaggtagctgggattacaggcatgcgccaccatgcccagctaatttttgtatttttagtagagactgggtgtcaccatgttggccaggctggtcttgacctcaggtgatctgcccgcctcggcctcccaaagtgttgggattacaggcatgagccactgtgcccagcatgaaaggtcattcctatgctgtatttggatttcctgaaggtctcttgtttattactgtttttaattcagagatgcccctgtctgcttcagcactgtgggttctcatttctctgtgggctcctgtgtctgggtgctggggccccttcagtgggtcgttaatcctcttggtcagtcactcggtcagtcaaatccggttgttgatgctttcctacatgggtaaatccccaggtagaagtaggtggaacagcctctgctgccatgggcttgggacatagtgtgtccggaattggtgggttcttggtcttactgacttcaagaatgaagccgcggaccctcgcggtgagtgttacagttcttaaaggcagcgtgtgcggagtttgttccttctgatgttcggatgtctttggagtttcttccttctggtgggttcgtggtctcgctggctcaggagtgaagcagcagaccttcgtggtgttacagctcttaaggtgcatgtctggagttgttcgttcctcccggtgggctcgtggtctctctggcttcaggagtgaaactgcagaccttcgtggtgagtgttacagcttatataggcagtgtggacccaaagagtgagcagtagcaacatttattgcaaagagcaaaagaacaaagcttccacaaggtggaagaggaccctagcgggttgcctttgctgccgctggcagcctgcttttattctcttatctggccccacccacatcctactgattggtccattttacagagagccgagtggtctgttttgacagggtgctgattggtgcgtttacaatccctgagctagacacaaaggttctccacatccccaccagagtagctagatacggagtgtccacacaaaggttctccaagtccccgcccagagtagctagatagagagtgtccattggtgcattcacaaaccatgagctagacacagggtgctgactggtgtgtttacaaaccttgagctagatacagagtgccgattggtgtatttacaatcccttagctagacataaaggttctccaagtccccaccagactcaggagcccagctggcttcacccagtggatcctgccctggagccgcaggtggagctgcctgccagtccgtgctgtgcgcctgcactcctcagcccttgggtggtcagtgggactgggcgccatggagcagggggccgtgctcctcagggaggctcgggccacgcaggagcccacggagggggttgggggaggctcaggcatgacgggctgcaggtccccagccctgccccgcaggaaggcagctaaggcccggcgagaaattgagcacagcagctgctggcccaggtgctaaggccctcactgcccggggcctgagcggccgaccggccgctccgagtgcgggggcccgctgagcccacgcccacctggaactcgcgctggcccgcaagcaccgcgcgcagccccggttcccgcccgcgcccctccctccacacctccccgcaagctgagggagcgggctccggccttggccagcccagaaaggggctcccacagtgcagcggcgggctgaagggctcctcaagtgcggccaaagagggagcccaggcagaggaggcgccgagagcgagcaagggctgtgaggactgccagcacgctgtcacctctcagtagaagctggtagaattcccctggggctcagaaaacagtacctcaaaatgaagccttgatctgcagcctcagaagcaaaagcttttccctgactctcccgtgtcctcctgcctggaagtcccgcttttcccccgaggccagccgtagaaactagaattcctctttcccaacgccagccataaaacctaaaaatatgattctaatttcccctccatctttctgtatcaaaactggccattgaaaaatggcccaccttgtttcactgtagctcataagacccccattccacagcaggtcctgccccataccctgaaggaaggaatgctgttcagagaggccaagaagaatccaggtggacaggccttgccatctctttacactgattgctactgagtccagccacgttaggtgattttttttttagacggagtcttgctctgttgcccagtctggagtgcagtggcgtaacctctgctcactgcaacctccacctcccgggttcaagagattctgctgcctcagcctcctgagtagctgggattacaggtgtgcaccaccatgaccggctaatttttgtatttttgttagacacagagtttcaccatgttggccaggctggtctcgaactcctgacctcaggtgatccgcccacctctgcctcccaaagtgctgggattacaggcgtgagccaccacgcccgacctaggtcatactctttttgtccagttatatttctacacagctgtccatagtttgttaaatgtaagcataaaaatagacaatttcccctgtgtcttttggtctttgttcaaaaggcttctctatctatacgctaaataaatttatatgccttttttcctattaatttgccttttgtgagttgacttttcagaggacctacattttggtgtggcgagcagggtcaccaaagctgctctgctcttccggaagccacagaaaagggaacccaggaaccagatcagctggcaaaaaggtaagaatttcttaccagttagggtcccagcctctctctctgtgcagtatcattgggtgaatggtaaaactcactgtttatcgcttctgcaaggttttgattaatgggagtaaaatatttctgggtggctagtcttgatatctggtgtgcctttcccttccttcctcccttgatccctccctccctccctccctcccttccttccttccttccttccttttctttttttattttcagagtcttgctgtgttgcccaggctggagtgcagtggcacaatctccgctctctgcaacctcccctcccaggctcaagcaattctcatgcctcagcctccagggtagctgggattacaggctcatgccaccatgcacagctaatttttttttttttttttgtatttttagtagaggcaggatttcgctatgtggtccaggctggtctcaaaactcctggcctccagtgagctgcccaccttggccccccaaagtgttgggattacaggcgtgagccaccgtgctcagcctggtgtgccttttctttttcttttttttagagtcgaggtctcactctgtcaccaggctgaattggtgtgatcacagctcactgcagcctcaaaatcctgagctcaagcaatcctcctgcctcagcctcccaagtagctgggactacagccgtgtgccaccgtgcctggctaattttatttttgtttctttgtagagatgagatctccctgtgttgcccaggctagtctagattagaacttctgggctcaagggatcttcttgacttggcctctgaaagagctgggattacaggtatgagccactgcacccggccccatggttttttgcttgctttacttatctattggtacataacaaattagctcaagatgtaatagcctaagccatctctgatggtttctaggagtcaggaattcaggtctctgctatacatatctgggacctcagctggagtcccaaaggctggggctgggaccatctgaaggcacagtcatgtacaggtcagctgtcaggatggcttcataatttgtggttttcagtgaacagtgaaacacagggttctggttgagaaacgataaagaatgtattgggggtagagatggagagtgattagtaatggaaatggaatgtagtgatgtttgcacaattctgtgaatatgctgcaaaccattgaatggttcacttgcaatgggtgaattttataacatatgcgttatatctcaataaagctgtttacagattatgaagaatttcaaaatggtgatggcagagtatttaaaagggccaggggctcttcttagcacacggctctgtgcctgataccaggccacacgtctgtgaagcttgcccactgctctcagctgagggcctagttcaaagtctcaaccagagcagccccacggggtctccccatgagatctgggcttccgcccagcatggcgggccaaaacagagagagagagacagagaagccagtatctttttttttgaaacagggtctcactctgtcacccaggctggagtacaatggtatgatcatgactcactgtagccttgaactcctgggctcaagcgatcctcccacctcagcctcctgagtagctgggaccacaggcactcaccaccacgcccggctaattttttaatttttacttttcatagaggcagggtctccctgtgtgggccaggctggtcttgaacttctgggctcaagtgatcctcccaccttggcctcccaaagtgctgggattccaggcgtgagccccagtgtctggtcccctaccccttttatgcccagcttttaaaggcacataacatcacttccaccacattctactcattaaaagaaagtcactaagtctggcctgcattcaagggggaaggaaatcagactctgtcttttgaagagaggagtttcaaagaaattattgatatatttgaaactaccaaattggccttcatatctaggctaagtgatgtttcatggtctcctgcctagcacataggagacaaagccccatgtgaattttcttgccaggccccaacagaaaccaaggctgcatttacactgtgggaaccaactctggaagaacaagcaggctaaaaccagttggggaaggaagtcttgtttcaggcttttttccctcccctctaaattccccttctgtatttttttttttttttttttttttttttgagacagagtctcgctctgtcgcccaggctggagtgcagtggcaccaatctcggctcactgcaagctccacctcccgggttcacgccattctcctgcttcagcctcccgagtagctgggactacaggcatctgccaccacacccggctaattttttgtatttttagtagagacggggtttcactgtgttagccaggatggtctcgatctcctgaccttgtgatccgcctgcctcggcctcccaaagtgctgggattacaggcgtgagccaccacacctggccccacttccataatttttctaatccttttgtggcatttcttcatttaaaaaaataaatcatgattccagagatagatctactggtgtttgctgggggcggggaagggatgaatggggaatgaatgattgccagtgggcacagcgtttctttttggggtgatgaaaaagttctgaaattagatagtcgtggtgattgtacaagcttgtggatataataaaaatgagtgaatagtatactttaaaagagtgaatttggctgggcacagtggctcacaccggtaatcccagcactttgggaggctgaggtgggaagattgcttaagcctaggagtttgagaccagactgggcaacatagcgagaccctgtctcaacaaaactacaaaaattagttgggcatggtggcgtgtgcctgtaatcccagctactcaggaggctgtctcaacaaaattacaaaaattagtcaggcgtggtggcgtgtgcctgtaatcccagctactcaggaggctgaggcaggagaatcacttgagcccgggaggcagaggctgcaatgagccgtgattgcaccactgcactccagcctgggtgacagagcatgaccctgtttcaaaaaaaaaaaagtgaatgtattgcttcttggcctcttggctaagatgaagtgtagtatttgcttttagtagttgtctgctatggtctgaatctgtcccctcttcctcccaaatttgaaatcctaaccccttaaatgataggattaggaggcagggactttgagaggcgatcgggtcatcagggtgcagcccttaggaatgggagtcatgccctaatcaaagaggcccccagagagctcccttctcccttgtgctgtgtggggacacagagaggaaatctatgcatcaggtggcaggtcctcaccatcctcctcggacgctgaatctgctgccgccttgatcttggacttccagcctccacaaccatgggaaatgaactgttgtttgtaagccatgcagcccatggtaccgtgtcatggcagccctggtggactaagacaatgtcctcggctgaattgtgattgagagctcaatggtacagtccagggggagctttgtggtgttttggtttctcaaagaaccacttggatcgctaggactccggtctgcatttgaagccatctcctgcccaaggacacctggtcaccatggccagcatgcagccagacaccagggacctccctgtggccaccagaattggtggatccatcactcatggggtttctcaggctttgctttcgcaattagttggttctcctcaattgcattctgtttccctctgttggtaatagaggactgaccacaggcagtggtgatgacaggggaagtcttggcttagctcttagtgagagagacatgcagggcattggcagaagttcgaattggtgagcccagcctgtccctctcagacgcctccaggcgtgtgtctaagagaaagtctcctgcatgtaagaaagtattctacaggcaaacatgaccttttgttttgttttgttttgttttgttttgttttgttttgttttgtttttcattttgagacagagtctcactctgtcacccaggctggagtgcagtggtgcaatcttggctcactgcaacctctgcctcctgggttcaagcaattcttgtgctcagcttcctacgtggctgggattacaggcgtgcaccaccactcctggctaatttttgtatttttagtagagacagagtttcgccatgttggccaggctggtcttgaaatcctgacctcaagcgatccacctgcctcagtctcccaaagtgctgggattacaggcgtgagccaccatgcccagccccaattttgcttaaggaggaattttatagtaggtgaattaatatctcaatggaaaaaaaataccagaagtttcaagagctgaaatagtcataggcctctctcactttctttgggttctcagaacccacccaaagagtggtcaagctaaaatttcaacccagagacatctgattccaaaggccatttttcttcacctctgccagccagagagtgaatggtcatgtagcctgggagtgaaagccatgctggggggtttgaactttttgttgtcgttgatgattgaagggttttgaggcagaaaagaaacataattcagtttttgttttagaaagatggagctgggcatggtagctcatgcctgtaatcccagaactttgggagcccaggacagggaggatcacttgaagccaggagcatgagaccagcctgggcaataccgggagatcccatctcttagaaaaaataaaaaaagcaaagaaagataattcttaggagctttatgtgaatattctttattagacataataacagataatattgaggagagtttttttctgggttggctacaataatttttgcagttttgtttaaaaattttttgatacaggctgggcacagtggctcacacctgtaatcccagcactttgggaagccgaggcaggtggatcacttgaggtcaggagtttgagaccagtgcctgtaatcccagctactcgggaggctgaagcaggagaatcacttgaacctaggaggcggaggttgcagtgagccgggatcatgccactgcactccagcctgggtgacaaagcaagactccgtctaaaaaaaatgttttttggctgggcgcggtggctcacgcctgtaatcccagcactttgggaggccgaggcgagcagatcacgagatcaagagatcaagaccatcctggctaacgtgatgaaaccccaggtatctctactaaaaacacaaaaattatggccgggtgcagtgtctcacgcctgtaatcccaggattttgggaggccgaggtgggcagattacctgaggtcaggagttcgagaccagcctgaccaacatggataaacccgatttctactaaaaatacaaaattagctgggtgtggtggcgcatacctgtaatcccagctactcgggaggctgaggcaggagaatcgcttgaacctgggatgcagtgagccaaccaagatggcaccactgcactccaggctggtgacagagcgagactctgtctcaaaagaaaaaaaaaattttttttgatacagctcacgaacagcaaggcaaaataaaaaataatttttaaaaaaagttcaacttttttttgcaggggagatagggtctcactctgtctcccaggccggagtgcagtggtgcaatcatagctcactgtatccttgacctcctgggctcaagcaatcctcccacctcagtctctcaaagtgtcgagattacaggcgtgagcctggcctgaaatcttgactaaaatatcagtgttcagcctctatgggaaccctagagaccagtgcgattttttttttttatctcattcactttttaaattttttaattattttatttcatttcatttcattttgagacagagtctcactctgtcacccaggctggagtgcaatcatagctaactgcagccttgacctacctccccaccatcacctcaagcgatcctcccatctcaacccctcaagtagttgggaccacagatgtgcaccactatgcccagctaattttgttttattttcagaagagacaagatctcactatattgctcaggctggtttcaaatgcctgagctcaagggatcctcctgccttggcctcccaaaatgctgggattacgagcatgagccatctcgcctggccaaaaagattttttttttagtggattttgtgatttgttcccatcattaaacaaaaggtcagtggagagagaagcagcggttgggcaatgtttgcctatgaaaagtccatctgtccttatctgtccttaatgttattctactttattctaaagttgaatttctctgctgtgcagcacagcaggctttatgtaaaattctattcaaatttataggcgataagtggtttttaaataaacacatagggtgttccaactgagctctgaaacctctggctgatggatgcatttaagaaagatggtgagatgctgtaagagccagcccaggccatagcacagttctacagactgaggggcttaatccacagaaacggagtttcccacagttctgaaggctccaagtctgcaataagttgttggcagcgtggtttcttctgaggcctctctccttggcttgtagatggccgtcttctccctgtgtcctcacttggtcatccctctgggtgtgtctgtgtcctgaccctctcttctcataaggacatcagccattctggattagggcccaccctaatgacctcagtttaattcagttcccctttaaagtccctgcctccaaatacagtcacattctgagatgctggggttcttcttcatctctgtaattttatctttctaagaatattatgtaagtacaattatatagtatataacttcttgaaattgaccttttttccagcctgggcaatatggcgaaaccccatctctacaaaaatgctatgatggtgcccctgcactccagcctgggtgacagagtgagaccttgtctcaaaaaaaaaaaaaaaaaaaaaaagcctgtttttcttcccccactcagcataatttttatatttatttatttatttatttatttatttattttttgagacaagatctcactctgtcacccaggctagaaggcaggggtgcaatatcagatcactgcaacctctgcctcccaggttcaagcgattctcctgcctctgcctcccaagtggctgggattacaggcacctgccaccccacccagctaatttttttggtatttttagtagagatggggtttcactatgttggacaggctggtctcaaactcctgacctttggtgatccgcctgcctcagcctcccaaagtactgggattacaggcgtgagccaccacacctggcatccactcagcataatttaatgctttaagatccatccaagtatggccgggcatggtggtgtaatcccagcactttggaagggttagacgggcagatcacccgggtcagaagttcgcaaccagcctggccaatgtggtgaaaccctgtctactaaaaatacagaaaaatagccgggcatggtggtggatgcctgtaatcccagttactctggaggctgaggaaggagaatcacttgagcccgggaggcagagttagtagtgagctgagattgtgccattgccctccagcctggatgacaagagcaagactccatctcaaaaaaaaaaaaaaaaaaaaagaaaatccatccaagttgttgcccgtatcaatcatttatttcttttttattgctaaataggatcccatggtatgaacgtactagtttaactattcacccactgaaggacatttgcagaatcttcttttaaaactaagcgatgctgtgtgcaattgctcacttacaagtgatctgcctgcctttgtggattgcttgagcccaggagttccagaccagtgtgggcaacatggcaaaaccccttctctactaaaaatctacaaaatttgccaggcttggtggtgtgcacctgtagtcccagctactcgggaggctgaggtgggaggatggcctgagcctgggagattgaggctgaagtgagctgtgatcttgccactgcagtccagcctcggtgacagagccagaccctgtctcaaaacaaacaaacaaacaaacaaaaacaaaaactaaagtgaaagtgttatagatacagctgaagcctccctccattccatttcgctccctgggattcctctgcagaattaatttctatcttgaagttagtaaacattcttcttacccatgatttgtatgtgttattacatattgatgtttccagaaacaatgtatggctttgtttcacaagttttaagtatttatagagatgttaccagattgtatgtatcttccagcaacttgctttttgctctagatgttatgctcaagttttagtactgttgatacaaataactgtggttcatttttcttcactgctatagtgtattccattgagcaactgaatctgttcccctactaatggatatttaggttgtttcttgtttttttactataacaatgttctctctctctctctctctctttctttcttcggagttttgctcttgtcacccaggctggagtgtagtgacacatctcggctcactgcaacctccacctcctggattcaagtgagtctcctgcctcagcctcctgagcagctgggattataggcgggtgccaccacgcccagctaatttttgtatttttagtagagagggggtttcgccatgttggccaggctgtctggtcttgaattcctgacctcaggtgatccacccacctcggcctcccaaagtgctgggattacaggcatgagccactgcacccagccacagtgactatctttgacctgcctccttatgaagtggtaccttctttagaaagagaagaacgtttaacaaggaagaaaagggccaacctgcagcgagatttggagaagggaaacagcatttgcaggacatccactcaactctaggcttcgtgccaggcggcttaagtatatgatcacagcctcggcttgggaggggcctgagggcctaatgaacagcctggtacagcctggtacagcctaggacatcctgggaagttctggaaatactgactccaagcaggtcaaggtatttgctctactttttccagttcaagttgcatatctctcactttgcatgttctcagaactttaaaagcaaagactggagtcagactgcctgcatttattcaccgggttcagttcatcacttaccagttgtatgaacttggacaagttactcaaactttctgggcttcaattcccttatctgtgaagtcagaaatagcacctagcccataatgttattgaaatgattaaatgagatcatctatgtaaaacacttagagctgtgtcttacacaccatagtgcaaatcttagatataataattgatgatcgctgggtgcagtggctcacacctgtaatcccagcactttgagcggccaaggcaggaggattgcttgagcccaggagtttgagaccagcctggacaacacagtgagatcccatctctaaaaaaaaaaacatacaataacaacaacaacaacaaaatcaatgaaatgaaattaaacattaaaaaatatataataataattgatggtgatcaaatgatgatcatgttgaatacagcctctctccaaccgtgtgtacatctttgcattcatgttgctttaccaaaatccaaaccaggcaatatcattttcgtactccagcatcatataacttttttttttaactttaatttttttttttttttgagatggagttttgctcttgttgcccagcctggagtgcagtggcacgatcttggctcactgcaacctctgcctcctgggttcaagcaattctaccgcttcagcctcctgagtagctgggattacaagcatgtgccaccacacccggctaagtttgaatttttttagtatagacggggttttaccatgttggtcaggctggtcttgcactcctgacctcacgtaatccacctgccttggcctcccagagtgctgggattataggcgtgagccactgtgcacagcctatgatgtattttgttagcatgctgaaaagaaaccaactttttcaacctgaggacatcagttggtcagttcactttctcttcttttcggagttgcattgagaacatcctgtactgttcctagcacctgttgatagatgtaaatccttgtctaggtgtggccagagctccaggtgtatcaatatttgttaacagctcagaagcacttggctttcatgggacagggccgtgggattgtggactataggccaggccctgatgtttgaaatgccacacacaaactccttgtccctgaagacacagagggtagccaaatgttaaatttgagcccaaagagaatccagcactggttgcaaaatacccctgtctcttttgtctcacagaagacaagaaacagtgaacagaacttcatggcccggtatgagcttcaaccaagcctcccaaggagtattcctttgccctgagcttattaagcaatatataagtaacagagggctgggcgcggtggctcacacctgtaaatcccagcactatgggaggccaaggtgattggatcacgaggtcaagagatcgagaccatcctggccaacatggtgaaaccccatctctactaaaaaatacaaaaattagctgggcatggtggcgcgtgcctgtagtaccagctactcagtagactgaggcaggagaatcatttgaacccaggaggcggaaggtgcagtgagtagagatcgcgccactgcactccagcctggcgacagagaaagactccatctcaaaaataaataaataaataaataaagtaacagagactttaattctccaggaaggccttccaaagggctccagaacacacatttggaggtccacagatgaatgggcctgaggcagagtgaaccccatcgtttcctgaaagttgattgattgcctctctgttctttggagaccacagttttgtagcatggcagattatttatttatttatttattttaatttttgagacagggtctggctctgtcacccaggctaaagtgcggtggcttgatcacagctcactgaagcctcaacctcccaggctcaagcaatcctcccacctcagcatcccaagcagctggaaccacaggtgcctcccaccacgcttggctaattttttttttttttggtagtggagggatcttgttctgttgcccaagctactcccaaactccgggccagactcagtggctcatgcctgtaatctcagaactttgggaagccaaggcagtcagatcttttgagcccaggagttcaagaccagcctgggcagcaaagcagaatcccgtttctataaaaaatacaaaaattagcctagcacagtggtatgcacctgtagtcccagctacttgggaggctgtggtgagaggatcgcttgagcctgggaggcggaggttacagtgagctaagatcatgctactgcactccagcctgggtgtcagagtaaaactgcatctcaagaagaaaaaaaaaaaagtgccgaactcctggcctcaagtgatcctcctgcctcagcctcccaaagtgctgggattacacatatgagccaccagtaattttgaaagcaaaagaactgagataggctccactgaaagcccaaatgtgctcgtgaaatagagggtgatctaaaacattatccaaggagcacctgacagatagcacgtcttcgcacaaatagtaggtgaaaaaaatacccttggcgtggccaccaaggccaagatggccttgagactctgcctttctaggaatgcccagaccaaggagccaagccacccgtgccctgcaccttctggggcctcctgtggttttgtggacctactcctgcacccccctatcatcatggttcaccaggccccaccccacagccacccagtgctcctgcaaaaggatagggacattcacacctgcccagccaccccaggaccccctgggcccaagcttggagtggctgcagaaactgtgagcccctctgttgttagggaggaggtccctttgcctgtggctcccaataatagcatgaaaacaaacgacaaataaaatatcctttatggccgggcacagtggctcatgcctgtaatccctttatggccgggcacagtggctcatggctgtaatcactttgggaggctgaggcaggcagatcacctgaggtcaggagttcgagaccagcctggccaacatggcaaaactccatctgtactaaaaatacgaaaattagccaggcgtggtggtgggcacccatagtcccagctactcaggaggctgaagcaggagaattgcttgaaccccggaggcagaggttgcagtgagctaaaattgtgccactggcctccagcctgggtgacagaccaagactccatctcaaaaaaaaaataaaaaaaaccctttaagcagctgcagcgcgactatcgccttcatgatccttctaatgaaagtgatatggatcaatgggttctctcaggtgagaatctgggaggcgcaggcattcagagcttgagactcattcatggttaggagctgggggaagggctgggttctggtccttaagcccaagcctggcttaatcctccttttccataagaaatgctgccccctctccagttccttcctctttctgcttgttattttttgctcaagctcatctgaagtatgtttcaagtacttgcatccctcaggaccttgagttaagcaaccatactaagacatcgtgtcactataatgagggaaaaaagtggaatttccttctcaggaagtttgtcagtaacacaaacagccccagcctcagtcaacaaagaatttcatcagaaatgcccggcgcggtggctcacgcctgtaatcccagctcttagggaggccgaggcaggtggatcacgaggtcaggagattgagacaatcctggctaacaaggtgaaaccccgtctctactaaaaatacaaaaaattagccgggcgcatgtagtccaagctactcgggagactgaggcaggagaatggtgtgaacctgggagatggagctggcagtgagccaagaccacgccactgcactccagcctgggcggcagagcgagactccatctcaaaaaaaaaaaaaaaaaaaaaaaaaaaaagaatttcatcagaatttcagttccaatttgaagacattgccaatctgaaccaaaagatgggtgtgcagacggcaacccatagcccttggctggtaaatggtcaatttctagttattgatggctccaccaaacaccacccctgtccaaggctcctcagatgatcaattcctcagctcaatctctgattacagaagtaaagtggggaaggggtcaggtggctgacagaccatctgcagagaaaactgttatagttagcagcaaggccagcggatcgatagattgtaatcaggaagcattttgaaaatgaaaccaaacgtcatttgaaggatctgcaatgtgtctgtgcctgaatatgggataccatttagatccttctataaccacccaataggtctccttgcccactacctagagctgatttgtgaagacaagggaattgcaatagagaaagtttaattcatgcagagctagctgtatgggagactgacattttattattactcaaatcagtctcctcaaaaactcaaggactagaggggaggatttgagacaaggtttctgtcacccaggctggagtgcagtggcatgttcacagctcactgcaaccttgacttcctgggctcaagtgatcctcccacctcaacctcctgagtagctgggactacaggtgcacaccactgtgcctagctaatttttgcatttttgtagagacggggttttgccatgtttccaggctggtctcaaactcctggactcaagcaatctgcctgtcttggcctcccaaagtgctggaattatagacatgagccactgtgcccagctggatctgttttgttttttggtttttttttgagatagagccttgctttgtcgcctaagctggagtgcagtggcacaatctcagctcactggaacctctgcctcccaggttcaagtgattctcctaccttagcctcccaagtagtttggactacaggcttgtgccaccacgcctggctaatttttgtatttttgtagagatggagtttcgctatgttggccaggctggtctcgaacttctcacctcaggtgatccacccgcctcggcctcccaaagtgctgggattacaggcgtgaaccactgtgcccggcctggatctgggtttttaaggataacttggccgatagcggttcagaaagtggggagtgctgattggtcaggttggagatgaaatcacagggagtcaaagatgtcctcttgtcctgaatcagttcctgggtgagggccacaagaccagatgagccagtttatcgatccgggtggtgccagctgatccatcgagtacagggtctgcaaaatatctcaagcactgatcttacatctaacaatagtgacattatcctcaggagcagtttgaggaggttcggaatcttgcagccagaggctgcatgactcttaaaccataattgctaatctgtccaatgtgttagtcctgctaaggcagtctagtcccccggcaggaagggggtttgttttgggaaagggctgttaatgtcttttgtttcaaagttaaacaatttcctcccaaagtgagttcggcctatgccccagcaaggaacaaggacagcttggagttcagaagcaagatggagtcagtcaggtcagatctgtttcactatcataattttctcagttataatttttgcaaaggttgtttcaatccctcactttgggtttcataacaaccttattccctttttttttttttagacagagtctcgctctgctgccaggctgaagtgcagtggcacaagctcagctcaccgcaacctccaattcctggttcaagcgtttctcctgcctcagcctcccgagtagctgggattacaggcatgtgccaccacgcccggctaatttgtgtatttttagtagagactggttttcaccatgttggccaggatggtcttgatctcctgacctcatgatccacccgcctcggcctcccaaagtgctgggattacaggtgtgagccactgcacctggactgtaacaaccttattcttcaggtgtgagctgtgagatggaaaaagggcaaagactgctttagctcctttttcctgacaggagtgtagttagggcgggtgttgaccccaaggtaagaggagtggaattgctttgcagctgtctgcctggactcatggtgcctggttggggttttgaggcttgcaggagtaaggtgttagtattcttacctagagttttaacatagtgtttaaatgagtagttaactataaggtatataatgagtcctaggttaaggagtgaaagtcctagcttcagaagcctttgtagagcccgggcgtggtggttcatgcctgtaatcccagcactttgggagaccaaggcaggaggatcgcttgagcccaggagttcaagactagtctaggcaataaagtgagactttgtctatgaaaaaaaagaagaaaaaaaaaaagaagcctttgtagaattgatcttaagctctgagggatccaggtgaatagctccaagaaccaatcagacatgggtcattagcagagagagttgggtcagaggttgttggacaaacatatcgggatagacaagaatgagtgaatttcattttattttactttattttatttggtactgctccttgtggatcaggactaactcattggcaatgcacctatagtcagccaggaaggagcaaatttaaatacactgtcccatatattattagtcagtttcctagtcctgggactagatcagttcagttaaacagctgtttcccatatcaggaggtggcattgcacatgggctaggcctctatatgtgatgaagacaaacagatttttaatacgaggcatttcttgtattaaaatggaggaaatacaagaaaaacaaaagttaatgttgggcacaatttatccagatgtgaaactcaaaatacctttagttatagagcaggaaggcagtcgtaatctgacatgtttttgcctcctatattaaaagaataaacttcagcttacagggtctcaggaaaaaaggtagtagcaattttattgagtccaagtcagaaaagtggaagaaaaatgtgaaagcattagtttggaaaacattagtttggagcattagttcattagcttcaggacagccatagttaaaggtgcagtcaacaagaaaaactggttatctctgtgacacacaacaatttttaaaatttagtttaatttttttgaaacagggtctcactctgtcacgcaggctggagtgcagtggtgtgatcacagctcactgcagccacaaagaattcaggatttagtccaaattgcagaaaataacaaaaactcaagaacagtggactagaatctaacaatgggtgtactatagcttttgaaacatagtttttctctctttagtccccatttttattaaaaacaaataatagtaggacacatgtaattgcaaaataagtcttagtcttattatacttggcctgattatttgtataacatacagcaagaataattatttgccatataggctctttaaaattggctttgctggtcaggcatggtggcttacacctgcaatcccagcactttgggaggccaaggtgggagaaacacttgagcccaggagttcaagaccagcctgggcaacatagcgagatccccgtctctacaaaaattagccaggtgtggtgacgcgtgcctgtagtcccagctacttgggaggctgaggtgggagaatcgcctgagcccggatgacagagcaaggccgtggcccaaaaataaataaataaataaaaacaaaattagctttcctgaaatttcattccctaaggaatctcaccttatactttttaaagcctttagcccagccatggatttatctatgcctgcaaatacctgtatgagttgggagaattttcctcctctcaaggtcccaagataatttgggcttctgggcctgtcagaaagtgacattctttacttacgacaagtcaggaaccctgtatagagactgcatatacaaggtataaggccagttttcttgaagagctttttttttttttgagatggagtcttactcttgtcgcccaggctggagtgcaatggcatgatctcggatcactgcaacctctgcctcctgggttcaagcgattctcctgcctcaggctcctgagtagctgggattacaggcacccgccaccacgcctggctaatttttgtattgttagtagaaacggggcttcaccatgttggccaggctggtcttgaacttcccgacctcaggtgatctgcccacctcgacctcccaaagtgctggaattacagccactgtgcccagttataaatccctttttcaattaatcaaacccttgcagaggagacaaacaatgatgtttaccattcacagagagagagagtgagagagagacagagagagagagaccagaagcctggcttgtcagaagttcttactctctttgctggcataccagatttctgggttccctttccctgcagcttccagaacaatggaaaatcaccacgagtcaggcctgttgcgcttccgctaacagttccttcagggttcagcaaatgtgacagaccagacaaactaggagagcctgttggacttccataaccaatttctgtacatacaccatacactcaagtgaaaaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgctgtaggtataccagtctgaccattatggtgaaatcccgtctctactaaaagtataaaaaaaattagccaggtgtggtggggggtgcctgtagtcccagctacacgggaggctgaggcaggagaattgcttgaacctgggagggggtggttgcagtgagctgagatcgcaccactgcactccagcctgggcaacagggtgagactccatctcaaaaaaaaataataataataggttgagagggctgggcacagtagctcacacctataatcccagcactttgggaagcccaggtgggtagatcacttgggtctgggagttcaagaccaacctgggcaacatggcaaaaccccttctttacaaaaaatacaaaaatcagtcgggcctggtgatgcgcacctgtagtcccagctactcaggaggctgaggtgggaggatcacttgagcccaaaagttgagggtgcagtgagccatggttgcaccactgcattccagctggggcaacagagtgagaccttgtctcaaaaatgaataataaataaataaatatataaataaattaaaaacataggttgaagttttaacacaaatcagaaagaaagaaaaagcaaattttcctacatatggatttgaaaggcacaaaacaaaaaaaaggcacaaaaaaacagaaaatttaagaagtagatatatttccagatacttcacatacatgcagacaaaccctttcaggtaaactgactgtttcattactaaaaatccattctcacatcataccaaggaaatccaatgccaggaagatgccaatcccaactcgtctgttttttctgctgtaaaaaatatctctgccaattgaagtccattttctggccaatttgcctttaaaaaagattacagacagttcaaaacaatgttttatgctgttgggagtgtgcaaaatgtctttttactgttaattaaatcagtattaccttatcagttaattcaaggttcctggctgcttgttccaaccattttgcaagaattatctgaaatagattatttaaaaatgaaattcttaatggataatcactgacataactaaaaacctccacgatttcttttttttcctttaaatatttattttgtccataaacctcttatccacgattgtcttttttgcttgtgtgtgggcacgtagtaggtgtacatacttgtggagtacatgagatgcattgatacaggcaagcaatgtgaaataatcacaacatggagagtggggtatccatcccctttgtgttacaaacaatccaattacactcttttagttatttttaaatatagaattaagttattattgactctcttgtataatcaaatagtatgtcttattctttcttttttttttttttgagacagggtttcgctcatcacccatgctggatctcatgcaatggcacgatctcggttcactgcaacctcctgggtcaagcaattctactgcctcagactcccgagtggctgtgattacaggcatgccaccatgcccggctaatttttgtatttttagtagacacagggtttcaccatgttggtcaggctggtctcaaacttctgacctcaggtgattcacccacctcagcctcccaaagtgatgggattacaggcgtgagtcactgcacccaggctcattctttctaaatatatttttttgtatgcattaaccatccccacctctcacccatcacccatcaccccacaacccttccaagcctctggtaaccatcctcctactctctatggccgtgagttaaattgttttgatttttagatcccacaaataagtgagaacatgtgatgttagtctttccatgcctggcttatttcacttaacataataatctccagttccatctatattgttgcaaatgataacatctccttctgaatcacagttgtcttttaagagacactttaattaacacaggtgttagcttaactaactggtgttaactggtgttaacgtgacttaattctcaatgatctaatgtaaaaaatgaaataaagtcatcaagagtggaaatactgaagacaactcacctgtccttcaggcacagtccttcttacaaatggaatcacatcatttttaaaccatggacacagcttttgcaaagagactgatgcagacattgagttgagcaagctctccagcattttcacatcaaatctgctttcaaagtttgcctaaattataaggagcgagaaattaagatctgacaaatttaaaccaaaggcttccaaatgtttgacaaagatattttaggaagtcattttaaggagtagcctactgatttaataatgagtgctaaaggagattcacactatgcaaatgattctagttgggagctgcatactgtatgcaatgtcacggcgctgagtgccaaatagtttatcatgtagcagaagaaccagcagagagagtattctaaggaaaacttaactgggggtgatactaggaattcaaacaagcaatgcagccattaagggcatcacggcaagttatgactttatggatctaatgttctataccaactttggccaaccttaaagggatcgagacaagcaattttaaggggcaatcttttaccacaatttgagctgcagtagcaacatcttcttcaccaatgctacattacaaagcccactaataaaccagataacatgttgcctttagagctaagattaggagttagactctttttttggttaacttttaagttcagtggtataagtgtaggtaaacttttgtcaagggggtttgttgtacagattatttcatcacccagctattaagcctattaatcattagttatttttcctgatactttcaccctccaccttctgaaaggccccggtgtgtgtttccctccatgcatccacgtgttctcatcatttagctcccaagaagctagattcttaatgattggataaaataaggttctactgtacattcactgtacttcttctgatttaatattatcagaagacaattttctccgggaaaagtaatttttttttttcttttttttgggacggagtctcactctgtcacccaggctggagtgcagtggcgtgatctcggctcactgcaacctccaccttctgggttaaagaaattcccctgcctcagcctcctgagtagctgggtctacaggaacgtgccaccatgcccggctacttttttatttttggtagagacacggattcaccatgttgaccaggctggtctcgaactcccaacctccagtgatcagcccgcctcggcctcccaaagtgctgggattataggcgtgagccatcgcgcccagcccatggggaaagtcttttttatccccttgccctttacaaacaaaagcaagtcatattttaagaaccaatcaaaaaacatcccatcacccagtcagacttgcaccttgttagtctccaacattgattcaatcacctaactcaggagctataaagctgttaaggaaaaaatgtaaaacatgttacccgatgtcgaagccaaagatactgtgcacaaacaaggtttccttcttttagctgtaaaaaaatatctttaagatcatcttcattatttagaaattcaatccaagaactgccactgaatagacaaagaagggaaaaaagtcagttttaaaaaaaattaaggttataccttttaagtggattatctttaaatgcattttaattagttttcttcttcataaaggtaaaaacaaaaaactaaaaaaaacccagttccaaagatcacacaatgcaaagtacatttccttcttatctcagaccctagaactcccgacatcttcctcagagccatgtagcttcctataggaccctcctcagataatcactacacgtagaaataactatttttcactcttgtttgttttatttgtttttttgagatgggatctcactatgtgctcaggctggacttgaattcctgggctcaagcaatcctgccacctcagcatcctgaatagatgggattacaggcatgtttatattattttactttatttttttgagctggagtctcactgtcacccaggctgcagtgaagtggcacaatctcggctcactgcaacctttgtctcctgagttcaagagattctcctgcctcagcctcctgagtagctgggattacaggcatgcgccaccacacctggctaattttgtatttttagtagagacggggtttctccaagttggtcaggctggtcttgaactcccgacctcaggtgatccacccgccttggcctcccaaaatgctgggattacaagcgtgagccaccacgcccagccgtccttccttttcaaggctgaataatacagaaaccgtagttttttgaaaggtgatcaaaacctcctttggatttttatgggtaagtctttaataattttcatccctgaatataattaataaacaacatgtgcttttatttccttcctggtaacacacagaacaataattaaaaatttccttttatttatttaataaagacagtgtcttcctatgttgcccaggctggtctcaaactactgggctcagtcttaaagtgctgggattacaggcatgagccaccgtgcctggccaacaatctgtgtttctttagtgttttcttccttgatagtcaaagatgttagttgtttaggtttttaaacgagaacctagccctctgcctggggccttgaggttttagcaatgttactcaatctcgtgtacttttttttttttgagatgaagtctccctctgtcgcccaggctggagtgcagtcgtgtgatctcaggcccaatcgcagctcactacaacctccgcctcctgggttcaaacgattctcctgcctcagcctcctgagtagctgggattacaggcgcacaccaccacacccagctaatttttttgtatttttagtagagacggggtttcaccatgttggccagtctggtttcgtgcctggccagtctcatgtacattttaattatccctgaatctatagaaaagctacagaatcaacaggtttccaaagtggatgcgagcagctggaagagagattctcaatggtcatttcttcctcttcttttttttttgagacggagtattgctctgttgcccaggctggagtgcagtggcacaatgacagctcactgcaagctccacctcccaggttcacgccattctgctgcctcagcctcctgagtagctgggactacaggtgcccgccaccacgcctggctaattttttgtttttgtatttttagtagagacggggtttcaccgtgttagccaggatggtcttgatctcctgacctcatgatccgtccgcctgggattacaggcttgagttaccgagcccggcccatttcttcctctttcctcttcctttctttggcagctgagtcacaggcagaccccacaggcccctgacagttgtttagatttagctctatgtcctcatcctggcggtccctcagaaagtcagcaggattttgttttgtttccttttattttagcacacttactcattgttttggaaatatctcacattccaggtgatttaagacttttttttttttttttttttgataaagtatctcgctctgtggcccaggctagaatacaatggcgctatctcggctcacgctcactgcagcctccacctcccgggttcaagcaaccctcccacctcagcctccagagtagctgggagtacaggcatgcaccaccatgctcggctaagttttgcatttttagtagagacggagtttctccaatttgaccaggctgctcttgaactcctgacctcaggtgatccacccgcctcggcctcccaaagtgctgggattacaggcgtgtgcccagccaacacctggctaatttttgtatttttagtagagatgggtttttgccatgttggccaggctggtctcaaactcctgatctcaggtgatttgcccaccttcgcctcccaaagtgctaggattacaggcgtgagccaccacgcctgtcctttttttttttttttttttcaaacaaggcctctctctgtcacccaggctggattatagcatggcaatcttggctcactctaacgttcatcttccaggctcaaacagtcctcccacctcagccttccaagtcactgggactacaggtgcctgcaaccatgcccggctatttttgtattttttgtagagacagggtttcaccatgttgctgaggctggtcttgaactcctgggctcaagcagtccacacgccccggcctccaaaagtgctaggattacaggcgtgatccaccacacccagctgatttaaggtgtcttgactaaacaactcacctctttctagataagacccgctgaatgtgaacttccagctgagtagggaaaaaaaaaacaaaactccaagatgtgaagatagagaggaatgtaatttcatagccctattagaaattctcagagagataaatctgaattcatcctggctaatttccttcaacctttataaacaagtataacaccttaatcagcataggcacaggacctgtttcccttaatccatcagctgtgaaacaggtttttattgtaggcgacttaagtcatttattttcatagtttatacattacacaatgacttcggtccaagtgccaagaaacagagcaagatcaattccatcaacacttgcaaagtattaatcccttatatgagcctttttatttttttttttttgagacagagtcttgctctttcgcccaggccggactgcagtagcactatctcggctcactgcaagctccgcctcccgggttcatgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaaaaaattatttattattattattgtttagagactgagtctcactccattgcccaggctggagtgcagtggcgtgatcttggctcactgcaacctccgcctcccgggttcaagcaattctcctgcctcagcctcccaagtaggtgggattacaggcccgcactaccacgtccggctaatttttgtattttcagtagagacggggtttcaccatgttggccaggctggtctggaactcctgacctcaggtgttccaaggagttccgcccaccccttggcctcccaaagtgttgggattaaaagcgtgacccaccacgcccggcactttatattagcctttaaacgccctcatccaaaaaagcccaccccagctacattatcttttctcagaaacttttttttttttttttttaaacagacaaagtcttactctgtctcccaggctggagtgcaatggctcactgcagcctccacctcccgggctcaagggatcttctcacatcagcctcccgagtagctaggactacaggcatgcaccaccatgcccagctaatattattttttgtagagacagggtctcactatgttgcctaggctggtctgaaattcctggcttcaagcgatccttccacctcggccttccaaagcactgggattacagatgggagacaccgtggccagcctgaaacctttctccatgtggagtagagcaggaaacgtagggggcggccacaccaggccttttcagagccatggaaatgtgagggaaaggctgtggagggagcttctttcccctgccccgcacacaacctagagatgcagaaaagacagtatgtggcttgcccacagcacagagcattgcatcctacaccgaggaagcatgggctgtccacggcgcttggtcatgtttcagggtcagaagctctcaaatcccctgagagaagcgacacagacttcagtggcattgccagtgattccatctcacctctagtactcagggctgacaactctaattactttattctatttattttattttattttattttttattttatgtattttatttttttaatttaattttatttattttatttttgagaccgagtgttgctctgtctcgcaggctggagtacagtggcacaatcttggctcactgcaacctctgcctcccaggttcaagtgattctcctgcctcagcctcctgagtagctgggattacaggcgctcaccaccacacccggctaatttttgttttttttgtttttgtttttgagatgaggtttcgctcttgttacccaggctggagtgcaatggtgcgatctcagctcactgcaacctctgcctcctgggttcaagcgattctcctgcctaagcctctggagtagctgggattgcaggcgcccacccccatgcctgctgccatgcccagctaatttttgtatttttagtagagacggggtttcaccatgttggccaggatgctctcaaactcctgacctcaggtgatccccctgccttggcttcccaaagtgctgggattacaggcatgagccatcgcttccagcctgtaattattttaatattgtacctaaagccagtccgtcctgtgttttggaacactaaggctggttagagatacctggaaatatgagacctgggttcatcttgggaatcacacacacacacacacacaaacacacacacactcacaatcctttcctaaccctgagaagtaaatactgttgagaattcttcatcattagttatttacctacaagatgaaaaagctcagctgggcacagtggctcacgcctgtaatcccagcactttgggaggccgaggcgggcagatggcttgagcccaggagttcatgatcagcctgggcgacatagcaagaccctgtctctacaaaaaaaaaaaaaaaaaaattaggccgggtgcattggctcacgcctgtaatcccagcactttgggaggccgaggcgggcagatcacgaggtcaggagatcgagaccatcctggctaacatggtgaaaccccgtctctactaaaaaaatacaaaacaattagccaggcgtggtggcaggcgcctgtgttcccagctacttgggaggctgaggcaggagaatagcgtgaacccgggatgcagagcttgcagtgagccgagatcgcgccactgcattccagcctgggcgatagagcaagactctgtctcaaaaaaaaaaaaaaaaaaaagaaagaaagaaaagaaatagaaactcagttcctattcccgatttccagagctcagtggctgcatgcatattacagaatatttccatcacggtagaaagctctattggaagaggctggtctagactgaggcctacaaaagagcagttagccctaggaggaaggaagagcgtctccagggctccctgtaaggtggcctttgcagactatcgcagttatgactcttgctggagctgttgaggccagttcctgtagtgtcttgcctgccatcttgaattccctgctaaagacaacgagaaggcattggagtgttgcgcaaggtaagtgacatcatcagatttgagttttggagaatgagctggaggaggagcaagacaggaggcaggggaccaatcaggaggcagttgctttcctcccagaccttaggccagtcaaaatggtagaaatgtgcgtggagacatgcatgatgtacgatctgcagactgcagattctagttgggcctggaaggagcaggactaacggcaatggcttgaactatttggaggatggtactaacagttcccttttaggcggaatctgaggacgagaatgagaaactgtttttttttttaacgtgttgctgcttaagggagtgggcttcagtgatctgcagggcctcattccctgataacatcaccgtgacagttcaccacggaaaactctagaaagacaaaacagcatacaaaggccctgaacctgcagaattcctacatgactacaatgggctttcctttgctctctttcagcctttcccccagtcctttacaatggcacctgcttctgtctccttctgccactgaattcaaggtcccctgcaaaacagccccactcttcgtggttggttgatatggactccaaattccgaactcctcaaatgttccttagacgccctccagtcttaacttctcccatgctcttccctttgtctggaaatgtctgttccttcttttattcctctagaaatttttcttttcttttttctttttttgagatgaagtctcactctgttgccagggctggagtgcagtggtgcaatcttggctcactgcaacctccgcctcccaggttcaagcaattctcatgcctttgcctcccgagtagctgggattataggcacccaccaccacacccagctgattttcctatttttagtagagatgtagagatggggtttccccatgttgcccaggctggtctcgaactcctgagctcaggcaatactcccacctcgcattacctaagtgctggaattacaagcgtgagccaccacacctggcctaaaataaagttatacctatgaaattaaaatatgtggctgggtgtggaactcacacctgtaatcgcagttctttgggagaccaggtgggagtatcgcctgagtccaggagtttgagaccagcctgggcaaagggcaagacctgtctctacaaaaaataattaaaaaaaccaattagccaagtctgctggcgcatgcctgtagttccagctactcgggaggcggaagtgggagaatcacctgaacccaggaggtcaaggctgcagtgagccaagatcacgccagtgaccccagcatgggcaacagagtgggaccgtgtctcataaaataaaataaaagccgggcgcactggctcacgcctgtaatcccagcactttgggaggctgaggcgggcggatcacttgaggtcgggagtttgagaccagcctgaccaacatggagaaaccccatctctactaaaaatacaaaattagccgggcgtggtggcacatgcctgtaatcccagctactagggaggctgaggcaggagaatcgcttgaacctgggaggcggaggttgcggtgagccgagatcgtgccattgcactccagcctgggcaacaagagtgaaactccgtctcaaaaaataaaataaaataaaataaaataaaaatatgtgtatacattactctgtatcacctaatatcatttcacatatcatctgtggtgtgtctaattcattgtggaaaatattactttaaaccacgtattctatttgttttactttattgttatgtatcctaggccttccttatctgtggttttgctttccggggctttcagttacctgtggtcagctatggcacaaaaatattcagtggaaaattccagaaacaaacacaagttttaaatggcatagcattctgagtagcatgatgaagtctctcgccatccctgctcgggatgtgaatcctctctttcccagcgtatctacactgtagacgctaccgacctggtagtcacttagtagctgttcccagatccaaaacccacagggcacatagatctcggtgccgtctgcagtttcagtcatccactggggtcttggaacatctttcccacagataaggggggactactgtgcttgtcttatttccccgactcaacactcagctccaggtgacagataaactcttcctcattttgggtgtcctgaagcatctagaaaacactttagaggtcgcttcaataaatatatatattttttgagacaggatctcattctgttgcccaggttggtgtgtggtggcacagtcttggctccctgcaacctccacctcccgggttcaagtgattctcctgcctcagcctccagagtagctgggattgcaggcacccaccaccacacccagctgattttcctatttttagtagagatgtagagacagggtttcaccatgttggccaggctggtctcaaactcctgatctcaaatgatctgcccacctcagcctcccaaagtgctgggatggcagccatgtatcaccacacccagctcatttttcttttttttctttcttttttttttttttggtagagttggggtttcgccatgttgtccaggctggtctctaactcctgggctcaagagatccacctgcctcagcctcccaagatgctgggattacaggcatgagccaccgcacccagccctttcctttctttttaagtcagaatagtgttccattgtgtgtatagaccacattctgtttatctgtttatcagctgatggactcctgggctgcttctgccttttggctattgtgaccatactgctatgaacatgagtgtacaaatacctgttcaagtccctgctttcaattctttcaggcatatatccagaagtagaattgctggatctcaatatttttagtaactgccgcattgttttccatattttgcattcccaccaacaatgcacaagggtttcagtttctccacaattttgccaatgcttattttctgtgtttttttgtttgtttgtttgttttgttttttagagagaatctcgctctgtcgcccaggctggagtgcagtggtgtgatctcggctcactgcaacctctgcctcccaggttcatgccattctcctgcctcagcctcccgagtagctgggactacagttgcccaccactatgcctggatcatttttttgtgtttttagtagagacagggtttcaccgtgttagctgggatggtctcgatctcctgacctcgtgatccgcctgcctcggcctcccaaagtgctgggattacaagcatgggccaccgcacccagccttttttctttttttttaaccaataaccatcctaatgtgtgtgaagtggtatcttgtggttttgatttagatttccctagtgaaatagtaatattgagtatcttagtggcaaatgtgtttattggccatttgtatatctttggagataggcctattcaagtcgtttgcctttttcttcttttcttttttttctttctcttttttttttttttttttttgtgatggagtctcactctgttgcccatgctggagtccagtggcacattcttagctcactgcagcctccgcctctggggttcaagcaattttcctgcctcagcctcctgagtagctgggactacaggtgtgtgccaccacatccagctaatttctttatttttatttttgttttattttatttatttatttttttgagacagagtctcactctgtcacccaggctagagtgcagtgactcaatttcggctcactgccagctctacctcccgggttcataccattctcctgcctcagcctcccgagtagctgggactataggcacctgccaccatgcctggctcattttttatatttttagtaaagacggagtttcaccatgttagccaggatggtctcaatctcctgaccttgtgatccactggtctcagcctcccaaagtgctgggattacaggcgtgagccactgtgcccggtctattttttaattaggttgttttttgttgatattgtacttgatttgtaagagctctttgtatatttcggatattaatcccttatcacatatatgtggtttgcaaatactttctcccatcccatggattgccttgtatattagtccactttcacactgctgataaagacatatccaagactgagcaatttacaaaagaaagaggtttaatgggctcacagttccacgtggctggggaggcctcacaatcatggtggaagctgaaaggcacatctcacatggcagcagacaagaaaaaggagcttgtgcagggaaactcccctttacaaaaccatcagatcttgtgagacttattcactatcacaagaatagcacagaaaagtcctgccccctggttcaattacctcccactgggtccctcccacatcatgtgggagttatgggggctacaattcaagatgagatttgggtggggacacagccaaaccatatcaccttgtctatttttttgtttgtttgttttgtttttatttttaatgtggagtctcagtcacccaggctggagtgctgtggtgcaatctcagcttactgcaacttctacctcccaagttcaagggattctcctgcctcagcctcccaagaagctgagactacagatgtgtgccaccagacccagctaatttttgtatttttagtagagatgaggtttcaccatgttagccaggctagcctcaaactcctgacctcaagtgatctgcctccctcggcctcccaaagtgctgggatgacaggcgtgagccactgcacctgacctcaccttgtctgttgatagtgagtgtcctttgaggcacaaaggttttacttttggtggagtccaatttatctattttttcttttgttccttgtgtttttggcatcatatccaaaaatcattgccttagtcaatgtcattaagcttttcccctatgttttctaagagttttatagttttagcttttacatctagatcttggatatattttgaattaatttttagatttatttatttatttttgagacggagtctcattctgtcaccgaggctggagtgctgtggctgcaatctcagctcactgcaacttctgcctccccagttcaagcaattctcctgcctcagcctcccaggtagctgggattacaggtgctcgccaccacacctggctaattttcatatttttaggagagatggggtgtcaccgtgttggtcaggctggtcttgaactcctgaccttgtgatccacccacctcacctctcaaagtgctgggattacaggcatgagccaccgcgcccagcctatttatttttttagatggagtcttgctcttgtcctccagactggagtgcaatggtgcgatctcggctcactgcaacctccgcctccaagcttctagcaattctcctgcctcactctcgcgagtagctgggactacaggtgcttgccaccacactggctaatttttatatttttaatagagatggagttttaccatgttggccagactggtcttgaactcctgattccaggtgatctgccctcctcggcctcccatagtgctgggattacaggtgtgagccactgcctggccagttttggtttttttttttttttttttctgagacagattctcactctgtggcccaggctggagtgcagtggtgcaatcttggctcactgcaacctccacctcctgggttcaagcgattcttgtgactcggcctctggaatagctgggactacaggcatgcaccaccatgactggctaattttttttttttttgagacaaagtctcactcttgtcccctaggctggagtgcaatggcgctatctcggcccactgcaacctccgcctcccaggttcaagcgattctcctgcctcagccccccaagtagctgggattacaggcacctgccaccacacccggctagttttggtatttttagtagagacagggttttcaccatgttggccaggctggtctcgaactcctgacctcaggtgatccacccacctccgcctcccaaagtgctgggattataggagtgagccaccactcccggccacgaccggctaatttttgtagttttagtagagttggggtttcaccatgttgggcaggctggtctcgaactcctgatcgcaagtgatctgcctcccaaagtactgggattacaggcatgagcctagatagatctaaatttggtgcacaaaggaatagggcaccacagcatgatcttgagcaggaagtccaagaagagagagacagcatcttcttgaagccctggggtagaataagatcagattgtacgtgaaaaaccagtaggcttttggggtgggtgcggtggctcacgcctgtaatcccagcactttgagaggctgaggcaggcagatcgcttgaacccaggagttcaggaccagcctgaccagtatggtgagaccttgtctctacaaaatatacaaaaattagccaggcatggtggcacgtgcctgtggtcccagcaacttgtgaggctgaggtgggaggatcacttgagcctgggaagcacaggctgaaaggagctacatttgtgccactgcactccagccttagcgacagagccagactctgtctcaaaacatacaaaccaaaaaaaccagtagactttcagaggaatagatgccatttttttcttccttaatcctctgccttacagctaattctacagccacaaaaagaaaaaaaaaaaagagagagaagaaggtgatttgacaagacaaaggatttagaaaagaaaggcaggtgttagtcatgtggaaaaaaaaggaagtatttgtgtttacaagaatcccgacagtatctgagaatgtagaatgaagaatattttccatttgttaaaaaatccaggctaagcatgtgaagtactcagggttacccctctgacctcatcttggggtgtttcaacctaccatggttacccctgttagttaacaccttatcacagaatcacaaaggcccacagagtgaaagtggttacaatgagctctcatgaaaagtaggagttaggcttggcatggtggcttacacctgtaatgtcagcacatttgagaggtcaaggtgggtggatcacttgagccccggagtttgagacctggacaacatggcaaaaccccgtctctacaaaaaatacaaaaattagctgggcatggtagcatgcacctgtagtcccagccactcaggaagctaaggtaagaggatggcttgagcctgggaggttgaggctacagtgagccaagacagagccactgcactccagcctggacaacagagccagactctgtctcaaaaaaaaaagaaagagagagagggagggaggcagagagggagagagagagagacagagagaaagagagagagagaaagaaagaaaagaaagaaagaaagaaagaaagacggaaggaaagaaagaaggagaaaagtaggagttagtcatccaggccaagagtatgaagtttgtcttcaaagaactcctgaatttgtgggggaactagatatagacgtttgacgaacacgtttttatttattagaggttatgagactagcgagtagggtggaaggaggaaagtggcaggaaaatcatactggaaaggtaggttgggaaccaactgtgaaggaccttgtacgtcaatccaaggaatgtgaccttcaacctagagcaagaggtgacaaactcaaaatcccacagagactaggcttgccaatgaggaaagccaaccaggtgtaaggcaatagggagtggtggggactgtggcaaacagtaaagctcattctctgtctacaggggctcattctctgtctctactccatctactctaagctccagctgattgtttccatgtgggagtgtcggtccagtgtggccagatcttccagtgttctaagagacaacagaaatccaggtttttataggactgcaccaggttttaaaaacatatcggccaagccaggctggtttttaaaccagatatggtccacaggccatcattctagccccttggcagattgaagggagctagtgaagatttttaagtgaaaaaaggtatatgataatatctgtgcttcagaaaaatcagattattgtgtagaagatgacttacaggaaatagatgagaggaagggaaaccagttaggaaactgtttcaacagttcaggtgggaagtgactgcggtctgtgctagggcgaggcaggggagaatgtgggtggacagatttggagtccagcatccagtgggaagaatttagcttcagtgtgcatctagaagacagacacattctttcaatgcaccccctcttttccgccccattttttttttttgagacagagtttctttctgtcacccaggctggagttcattggcacgatctcggctcactgcaacctccacctcccgggttcaagtgattctcctgcctcagcctcctgagtaactgggattacagacacatgccacaacacctgactgatttttgtatatttttagtagagatggggtttcaccatgttggcaaggctggtcttgtactcctgacctcaagtcatccacctgcctcggcctcccaaagtgctgggattatagatgtgagccaccgcgactggcctccaccccattttcttctttctttcttttttctttttctttttcttgttgttttgtttgtttgtttgtttgtttgttttagacggagtctggttctgtcacccagactggagtgcagtggcgcaatcttggctccctgcaagctctgcctcccgggttcacgccattctcctgcctcagcctcccgagtagctgggactacaggcgcccgccaccacgcctggctcatttttttgtatttttagtagagacggggttttaccgtgttagccaggatggtctccatctcctgacctggtgatccgcccgcctgggcctaccaaagtgcttggattacaagcgtgagccaccgcgcccggcctccaccccattttctaaactggaagctgaaaggcacagggcagattaataatccttaaagccaaaggacaggaaattttagcaaagactccaattttttgtgcagtctaatgttactcatgattgctttagagatggactccttaatcaactcctccaatcctcttccgcccccagggggcagttttaattgatgggctcagcacataattgaaattaaaaacgtacatctcatggtgtttggctcattcaacagccaatggaaactcagggccaaatctttgtaaaagttctaggctctgcttcccagcagagggggaaaccggctcccaaagaggccgttttgtggagacagacatatgagaagtgggcttcagatctatttcatggtcttggtggttgtgcaactggccactttggttcacggaaggatgtaaagggcagggaggtgggaatagagcgggggaaaggtgactcccgtcaaagaatttttctaacatccatcaagtatcgtgattagaacttttctctccgcagactcctccaatttttgagcgcggtatttttcggcacaggaaatggcccggaggagctgcagagcaaagcctcccctctctggcaccgcatgggagtgccccgtgggatgagggagaggacaaggcagtcaggcaaaggttacgggaggaaagcaaaggcaggagcccagaaccactccaggaaatgtttggatttctccaccaggagggaggacaaacaagctttcttcttgccttctgggcagctttgtgtgctctccagcacggagtccgaggaggaacagcgaagctgaaaatgaaaattactctggcgctggacccaatcgctcctctacggcatcaatctcatcggacccccccaccctaccgcctctcagaaatgaccacttttgcaaaattgcatgcatttccaagcttcatccggctccaggcttggcctctcccagaggcaggcggcttgtgagacgggctccagagaaaggacctccctgggtctctcatttcctggctgaagtttctcttctcgctgctgtggcagcatccaacccacacacacaggacccgcatcctgggtgatgaagtcagacacgcagcagctgggtgagtgctaacgctcagataagcatctgtgccattgtggggactccctgggctgctctgcacccggacacttgctctgtccccgccatgtacaacgggtcgtgctgccgcatcgagggggacaccatctcccaggtgatgccgccgctgctcattgtggcctttgtgctgggcgcactaggcaatggggtcgccctgtgtggtttctgcttccacatgaagacctggaagcccagcactgtttaccttttcaatttggccgtggctgatttcctccttatgatctgcctgccttttcggacagactattacctcagacgtagacactgggcttttggggacattccctgccgagtggggctcttcacgttggccatgaacagggccgggagcatcgtgttccttacggtggtggctgcggacaggtatttcaaagtggtccacccccaccacgcggtgaacactatctccacccgggtggcggctggcatcgtctgcaccctgtgggccctggtcatcctgggaacagtgtatcttttgctggagaaccatctctgcgtgcaagagacggccgtctcctgtgagagcttcatcatggagtcggccaatggctggcatgacatcatgttccagctggagttctttatgcccctcggcatcatcttattttgctccttcaagattgtttggagcctgaggcggaggcagcagctggccagacaggctcggatgaagaaggcgacccggttcatcatggtggtggcaattgtgttcatcacatgctacctgcccagcgtgtctgctagactctatttcctctggacggtgccctcgagtgcctgcgatccctctgtccatggggccctgcacataaccctcagcttcacctacatgaacagcatgctggatcccctggtgtattatttttcaagcccctcctttcccaaattctacaacaagctcaaaatctgcagtctgaaacccaagcagccaggacactcaaaaacacaaaggccggaagagatgccaatttcgaacctcggtcgcaggagttgcatcagtgtggcaaatagtttccaaagccagtctgatgggcaatgggatccccacattgttgagtggcactgaacaagcagaccaacaacactgaggaagatagagtggtgacttagaattaactcgtgctaaggggtcgggggctttgaaaatgccacccccctttcttattgcaagacggcttctcgcacatgaactgcatccttctcattctgtcggaaatgaaattcacacaactataccttttggggaggttccagttgattgaagtgagttggctgcattttcttatctgatcacaatggcaggggacagaatgtgcatggagtggagcatgtgtgtgttgggaggggggctaggaactgcacagcccttgtgtaattttcgttgtttgtttttgttttgagacagagtctcactctgtgtcccaggctggagtgcagtggcacagtctcggctcactgcaacctctgcctcccgggttcaagcaattctcctgcctcagcctcccgagtagctgggattagaggcgccagccaacacacccggctaatttttgtatttttagtagagacagggttttgccatgttggccaggctggtctcgagctcctgacctcaggtgatccgcctgccttggcctcccaaagtggtgggatcacaggcgtgagccaccgtgcctggcctcccctgtgtcattttaaatggctaagtaaatgggtatatgtgtttgaatggggcatgttcactctcttaggggctatggggcagttagcagcatttcctatcctctgaccttaaatcattccttatctcagaaaacagaaaccgggctcagtcaatcaatgctttatttcaggccgaatgaggctctttagattgggatctattgatctatcaattttcatctttacatttctttgtacatctgtacattttgtccaaatgtacatctgtacgtctgtcatcattgtgacttcctggtagcccaagaagaacaacaacaaaacaatctgctctgaccttcttcaaatctttgtatttcaaagaaggtgctgagggatctgtttccttgccctggcttctccagtgggatgtgctgagtccaatacaattgcttttataattgcttttgacaacttgtcatgtgactgtgaattgaaattattcacttattttccaagtatttactgaattcgtatttggtggcaggcagtatactgtgtaatttttagtggagggtcattagtcaactcttatgtgacagtaaagttttttgggggggtggggacagagaagttaagagctttcatcctttcacggaatacagtttctagaccgattctgtgtgaacatcagttttgtcctcttattgcaagactccctcatacacatgagtttcccaaatgtgtacctggacccctcgaaacagaggactctacgaaatgacaagctgcccctgccctgaattagggggaaacattccaggccaactctagctcctttctcaagctacaaagtggtgaacatggttctcaactccttaatttatactctctcaaatgcccaggatactctacccacttaagaaccttgccaacttctgggggttgggcatggtggctcacgcttgtgatcccagcactttgggagactgaggcggatcacctgaggtcaggagttctagaccagcctgaccaacatggagaaacctcgtctctactaaaaattcaaaattagcctggtgtggtggcgcatgcctataatcccagctattcgggaggctgaggcaggagaatcacttgaaccgaggaggtggaggttgcggtgaggtgacatcgtgccattgcactccagactgggccacaggagtgaaacgccgtctcaaaaaaaaaaaagaactttgccaacttctagttctttggcctcaaaacacccctctaggctgtccctattattccttttttcagaggcactgtgcagcctagtgatgaaaagtacgagctatagagcattagaagcatcgaagtttgaatctcagctcaagcatttactaggcctgtgatcttagggcagcttgtgtttttagacactgaatcttgctctgttgcccaggctggagtgcagtgagtggcatgatcatagctcactgcagcctcaaactcctgggctcaagtgttcctcccacctcagcctcctgaatagctgggagtacaggcataagccaccacactcagctaatttttaaattttttttatagagacgaggtctcactcactgtgttgcccaagctggtctcaaactcctggcctccagcaatcctcccaccttggcctcccaaagtattgcgattgccagcatgagccactgctcccagcctggcatatatatagatatatatagagatatatagatatctatctatctatatatatatatatttttttttttttttttgagacagagtcttgctctatcacccaggctggagtacagtggcccaatctcagctcactgcaagctctgcctcctgggtccacgccattctcctgcctcagcctccagagtagctgggactacgggcgccccaccaccacgcccggctaattttttgtatttttagtacagacggggtttcattgtgttagccgggatggtcttgatctcctgacttgtgatccgcctgcctcggcctcccaaagtgcttggattacaggtgtaagccaccgcaccccgcccagcctggcagattttatttaatcatttgtagcttcattttcctcgtctgtcaaacagggatactgtaatacaacctcagtgtgtcattgggcagtttaaatgaatgtacattcctgaggcatcagaactttgttcactgttatatacccaatgcctagaagaggacctgcacatagcaggtgctcagtaaatgtttgttgaatgaatgattaagtgcatgtaaagcattaagcatagcgcctggcagtaagtgctcaatattatgacttcttatattaacacgttttacatataaagaaatggaggcaagaaagcatttcctttggggtttagagcgcttaagttgttcctctgttatcatgcctgaattcccccgcccctcacttacctggggaagagtaaaggcaagaattctttccagcattagtcatacatcctcctgataggaatctgcgaaaacacacacttctgcttttagttgtattcttagaattctctcctgggctgttgctcctttgttccttcattgtaataaaaatggattctgaaagcaaatctgtgtcctgtgtgtgactctaggtcaaaggacccctaggattttgccctccaaggaaaaaaagctaaaatatcttgatctgcatggcaggcaggcaggcagaggttctcaccaaaaaaacagcatgcacatacaaacagaccgctcaaattcaaactgaaatacagtcttgattctaaatttgcttccctttttacgttcgcagaatgcgacgaaaaatacatcttagcaagaagtttttttggacatctgcaagaagtggagtatagctttgctgcccccctttgtttacactttctgaaacaggaacatgatcgttttagaggaaaatgtgatctccctcttccccccccctcttggtgagacgggcctctccctcgtgtttcccacggtgccgtccccgccttgaccttgcccccttgtccttccacttccagcacaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctctctctgtcacccaccctgaagtgcagtggtgcaatcttgtctcactgtaacctccacctcctgggctcaagcgattctcctgcctcagcctcttgagtagttgggattacaggcgcatgccaccatgccgggttaattatttgtattttagtagagaccgggtttcaccatgttacctaggctggtcttgaactcctgagctcaggccatccacccgtctcgacctcccaaagtgctaggattacaggcgtgagccaccatgcctggcctaatttttgtatttttggtagagatggggtttcaccatattggtcaggctggtctccaactcctgacctcgtgatccacctgcctcggcctcccaaagtgctgggattacaggcgtgaatcacgtgcccagcctgattttttttaaatttaaaaaaaaagaacggcgcagctttttggccaggtatggtggctaacgcctataatcccaacactttgaggggccaaggcaggaggatcgcttgaggccaggagttggagaccagccttggtgacatagtgagagccccatctctacaaaggtaaaaaaattcactgaagtgttgtggcgcatgcttgtagttccagctacttgagaggttgaggtgggaggattacttgagcccaggaggttgagactgcagtgagccttgatcatgccgctgcactttagcctggggaacagaatgagaccctgtctcaaagaaacaaaaaaaaatccaatttttgttttgttgatccttggtattgtttttgtttcaatttcatttatttctgctctgatctttattcttttcttttactaattttgtttggtttgctcttccttttctacttctttaagatgtattgttaggttgtttatgaattttttctacttttttgatgtgtaggcacttatagatataaactgttttcagcttttaatcattacaaagagttgctgcagaagacatccttactaacatgtatatttttcttcttaggtgaaatttgtaaatgttgcatttttatactaaagagcataaatattttcaattttattacagatttctctccaatattctaacagtttacacacccaccaggaataatacctgattttttttttttttttttttttttggagatggagccttgctctgttgcccaaactggagtgcagtggtgcgatcttggctcaccgcaacctccacctcccgggttcaagcaattctcctgcctcagcttcccgagtagctgggactacagccatgcgccaccatgcctggctaatttttgtatttttagaagagatggggtttcactatgttggccaggctggtctcaaactcctgacctcgtgatctgttcaccttggcctcccaaagtgctgggattacaggtgtgagccactgcacccggcctaatatctgatttttaaaaggcaataattagctttgatgacaggtagtttgtctgattttgagactggacaatgacaaggttaaatttcaacaatggaagcatgtacccaagtgttttgtcagatactttgcatggaaatgcctgcagtttgggagactggtgtgtattgaatgcttcttttagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataaggtagacacacagtgaaatgaatcgggtcatctcagccatccctcccacccttaataattagatacattagtaacaaattggatgtataagtctatatttttatcaacttttaatttgaaatattctcttgatttctatatttttaacacagttaaatacaattttcccatttttcaaaatagaaatagcttttcttccccagatttttgaaaaccttacacattctttgaatttatatgagctagagagaaatgtataaatcaaaacaagcaatttccctataactccactccctagagatgaagatgttaatagtgtggtgtagtaactatcttaaactaaatatactcttctgtgaccctcttttttcacttaacatatggtcattatatgtcattacatacacatctatctcaaaagaaacaatttctttttcatctttttcatggtcctgccggaaatgtcttttttctttttcttttctttttttttttttttttgagacaaggtcttgctctgttgcccaggctggagtgcagtggtatgaatgtgactcactacagcctctatgtcctgggctcaagtgatactccagcctcagcctcccgaatagctggaattacaggtgtgcaccatcatgcctggctcatttttgtatttttagtagagatggaatttcaccgtgttgtccaggctggtttcaaactcctggcctcaagtgatcctcccaccttggcctcccaaagtgctaggaatacagaggtgagccacgaggcccagtgaaccgtcatttttgacagatgcataactattattccattatatggataaaacatgccgtatttaaccaggcttttatggttagacatttaaacttttttttttttatttgagatagggtctcactgtcacccaggctggagtgcagtggtgtgaacatggctcatggcagccttgacctcctgggctcaagtgatccttctacctcagcctcccagatagctggaactgtaggtgcatgctgccataccccagtaatttttttaatttttaaaattttttaaattaaaaaaaaaatttttttgtgcagatgaatctcactgtgttgtctgggtatggctgggtaaattttattatcataaattgttataattaatatcttcatacatatttttatacttttgtctgatttgttttttagttttttttaagagaagggggtctcactatattgcccaggttggcctctaactcctgggctcaagtgatcgtcctgttcagcctcctgagtagctggaactacagggactacacctggcttctgctcagtatttgtttaggagatcttctgatcttctgagaattggaatgtttggtcagggggtagtttaatggagaaatgaaggtgaatggcagggaaaaaaattttttttttttctgagatggagttttgctcttgttgtccaggctggagtctaatggcgcagtctcggctcgctgtagcctctgcctcctgggttctcctgcctcaaccttccaactagctgggattacaggcatgcgccaccacgtccagctaattttttatatttagcagcaatagggtttcatcatgttggtcaggctggtcatgaactcctgacctcaggtgatctacctgcctcagcctcccaaagtgctggaattacaggcatgagccactgtgcccagcctggaaataaaattttaagcctgaaataaatatttcagttttatattttgcttgcaattcagccaaaaattacatagattgctcaaaatttctaggtaacaatatttcatcttcccactttgttcaatgttgtttttcacgcgacttttgttggcatttaaaaaataggccagcctggggaacatagtaagaatttgtcactacaaaaaatttttttaattagttaggcctagtagtacgtgcctgcagtcccagctatttgggaagctgaagaggggaggattgcttgagcccaggaggtcaaggctgcagtgagttgtgattgcaccactgcactccagcctgggtgacagagcgagactctgtgtcaaaaataaaaaggaaaaaagtaatggtgtgtgggtagaaagaaagaacaaagagaagacttcctttttttgtttttgtttttgttgttgttgttgttttgagatgaaatctcaccctgttgtccaggctggagtgtaatggcacgatcttggctcactgcaacctccgcctcctgggttcaagcgattctcctgcctctgcctcctgagtagttgggactacaggcacgcactaccatgccggctaatttttgtatttttaatagagacaagatttcgccatgttggccaggctggtctcaaatgcctgacctcaggtgatccacctgccttagcctcccaaagtgttgggattacaggcatgagccactgtacccagcctgacttcctttctttttgtgttaatatgtatatatgccacacaattaattcttgcactatagtatatagttagagctaaaacagaatcctttgagaaacttgcttggaggcccacagttttactcatgtcatttctaagaaaaggatcagtttctttctgttccaattttcccatcgtaaatgaaagaaagggaactttaatttcaaaatcttataaaattttgaccatacccctaccctttctatgcttttagtatcttaagagcttccttcttttttttttttgagacatagtctggttcttttgttcagcctggagagcagtggcgtgatctcagctcactgcaacctccacctcccaggttcaagcaattctcctgcctccgcctcccaagtagctgggactacaggtgaatgccaccacacccagctaatttttgtatttttggtagagatggggtttcaccctgttggccaggctggtcttgaactcttgaccccaggtgatccacccgccttggcctcccaaagtgctgggattacaggcaagagcatccttctttattaaaacaagactgccttgtgcagcttttaaaaacagcctttgatacctttttttagcatgtatgtttatcctcacaggtaattttagaggtgagaaaattgtagctctttatttttttatttttattatttatttttgagatggagtctcgctctgtcacccaggctggagtgcagtggcgcaatctcagctcactgcaagctccgcctcccgggttcacaccattctcctgcctcagcctcccgagtagctgggactacaggcgcccaccaccacgcccagctaatttttttttgtatttttagtagagacggggtttcaccgtgtttgccaggatggtctcgatctcctgacctcgtgatccacccgcctcggcctcccaaagtgctaggattacaggcgtgagccaccgtgcccggccgattgtagctcatttttaagggagtaattaatttaacaatgtagtgcagtgacatttttatatttgtaatctgtgctgattattgtaattgaataaaatttcaacatggcaaagtcttatcaagttttgatatatttttgtttttatacagttggatccttatgactatgaaatgattgaagttgtcttgaaagttatagaacgagctgatgaaaagataaccaatattaatattaatcaggtataacaaatatatcaaagatgtaaaaatcatctttctgcttttatttggatcataaatcatatcattatccagggcctttccaaattatccattgaattccctttaaactctgtggtttattttaggtttttaaaaatctttacaaatctttaaaaaaagaaaaagattttcatgacattcctattttatcacttatcttcatcctttttttgctgttttgaggtgatttaaataacctctcctgctgtcgaagagtatgaagtcactacagaactaattgtgaagaattaaggaaacatttgccatgtaggaagtgaaaaaggccatgggactgagagttaggtcagctctgtgtattaatgggtaggtccaagacctactcaattatgtctcagtactttcattaacttcttcatcgtttctgaattttggtcatagtggcttttatactttttaatttgattttagaaattaatattttagaaatattttaatattatgttaataagacttattatataagaaaatatatcaattcaaaagattatacaaagtgtcctaatataaaatataaacataggaaagataagagcgtagagaatttagatctgtagcctctatatttaaaatgaaatcaagtattttgaattatatctcaaattatttgaagagcagataactgtcaagctcttatttacaaaacatctaccaacaacagggcaccagtggtttctcctcataggattcctttaatcattgtatataaattatagtttagatgaataatgttaaagagaatactagaaaaggttttgatcctctttctgaaaacaagatggtctcaggaatggaaacttttgatggtatactattagatgattttatgacagtttaggattgggttactcttactggacaaaagttttttattttaatataggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctgtatgtgttcattaactttttatgaattttactggatagccaaattttttttcttaagcaaatcgtactttccttgtttcctttctagctacagaactcagtgaagaatctttcccaacattgctcttaatttcgaaattaatgaaggtaatggattaaaacattgtaagacatttctgtatcctgcaattaattctgaccccgtatagaagatttttctgctgctttcatgtaaaaccttatatgtgaatatgtgcttcagccataaccttccttttctttgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggtatgagctcttcttttaaaattgtagttaaaaaaaaaaaaaaagtactctttttgcatctttaaggagaagcaggatggtagttttcaaatgtatttgcttgctctcttaactgtggtgaatgctgaaacgctcaagggcagtgggcatgggcagggaggcaggcaatttccaacttgtccttgtgccgcctttggggtgtgacctttgctaggaataggcagtgatgggtacttttaatatccaatcacactttctttttttttttgagatggagtcttgctctgtcgccaggctggagtgtagtggcatgatcttggctcaccgcaacctccacctcccgggttcaagtgattctcctgcctcagtcccccgagtagctgggactacaggtgcgcgccatcatgcccggctaatttttgtatttttagtagagatggggtttcaccatgttggccaggatgatctcgatctcttgaccttgtgatccgcccgcctcggcctcccaaagtgctgggattacaggcgtgagccactgcacctggcccaatcgcactttcaatgaggaatctttagatagtctcacataaccaaacaggtgcacaagcataggcactcactgctacatttttggttgtaacaaaagttgaaagtgactttttaaaaaatgctcaggtcaggaactggttagaaaatagggtgtattcatagaacgaaatattatggggctgatttggagagatatccaagatatgaagtgagaacagcaaattatactagaatatgtatggtattacccattagggttaagatgcacatgcatgcatgtgtgaacacagactgacacacacacacagaaaactcctaaaggcatataagaatttagagaataggaatggaatctgatgagagggccccggtgggcttttttttttttttttttttttttaacagagtcttgctctgtcgcccagtttggagtgcagtggcgtgatcttggctcactgcaacctctgcctcagcctctcgagtagctgggactacaggcatgtgccaccatgcccagctaatttttgtattttcagtagagacagggttcttccgtgttggccagggtggtctcaaactcctgacctcaggtgatccacttgccttggcctcccaaagtgctgggattacaaatatgagccactgtgcccagccatgagtatgcatttttgtaatttttaaaaagttgctaatttgaccaaaatacattttcttgaaaagattaagatttgcctgtaaatctttatttatttatttatttatttattttaggttccttcaagatatctgctttgaaattctgcctttatttagctgagagatggctacagaatatcccatcgcaggtgtgtctgaactatcagattggcggcttctcttcttcctaattaaattgtactagcttaatttaccttctcatgctgccctggtgcctaaaatggagaaggaagaccaaggctttatgtagatgcttaggaacataactgaggaaggggggagggattgtgattgataaagatggatgcttggcttcaactgaggcttacaaagtaagattttctttttgcttggaattgtttaaaaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctggtgaggacaaaacaatttttttgttgtccaagaaaagctattattttgattctcagttttatgtatatatgtacgtgtacatatatattacttacatatgcttatatatgtatatacttatatgtgtatgtatgtgcatatatacacatacacatataagtattcaatataaatatttaaaacttgagtttttcttttctttattttgaatatcttagatattcatgcagcagctaaagaaatagccgaagtcaatgaaattaatttggaaaaagtctgggacatgttgttggaaaaatggctatgcccttcaacaaaacctggtgaagtaagtacttgctgcccaagagtatctgtagttgagtatgcactgatggcttcttctcaaaggctaaatatttatcccacatgatacagccttctaattaggagcgcagactcttcaaagaaggaagtttctttgtttgttttgtttttgagatggagtcttgcttgttgcccaggctggagtgtaatggcgcggtctcggctcactgcaacctctgcctcctgggtgcaagtgattctcctgcctcagcctcccgagtagctgggattacaggcgcctgctaccacacccggctgatttttgtatttttggtagagacggggtttcaccatgttggtcagactagcctcgaactcctgaccttgtgatcctcctgcctcagcctctcaaagtgctgggattacaggcgtgagccactgcacctggcctcttttgtttgttttttaaagacagagtttcgctctgtcaccctggcaagtgcaatggcacaatcatggcttactgcagactcgaattcctaggctcaagcagtcctccccacctcagcctcccgagtagctgggactacacgtgtgcatcaccatgtgtggctaatgttttgttttttttgtttgtttgtttgttttgtagagacagggtctctcactttgttggctaggcgggtctcaaactcctggcctcaagtgatcctcccgcctcgatttcccaaaatgctgggattacaggcataagccactgtgcctgtctggaacttttgttcattatagtaccctctgttatctgataagttttaaagagattgtttacttttttttttttttttttttttggatacagagtcttactctgtcatccagtctggagtgcagtggcgtgatctcagcaacctctgccgaggttcaagagattctccctcctcagcttcccgagtagctggggttacaggtgtgcgccactatggccagctaatttttgtatttttagtagagttggggtttcaccatgttggccaagctggtcttgaactcccgacctcaggtgatccgcccgccttggcctcccaaagtgttgggattacagacatgagccaccacgcctggcctgtggttgcttactttttgtttaaatattgttttgtagctgttttacctttcagttgatgatttcagatgctgtcttgtatgaaagaaatggcctgttcttttactcagattcatgtgattaactttttgttttgaaataatttaaaatgtacacaaaaatgcaaaaatagtaaaaaaagaattcctatatacacctttcaccgagatccatgaatttttaacattttgccatatttgcttcatctctcctctataattgatactcttacgatatttttctgaaccattggagagtaaattgcacgtggcatgcccccttaccccctgaatattttaaaggtgtatttcccaagaacaggattttctctaatccaaccataatataattatcaaaatcagaaatttaatggtgatataattgaatttatggtccattttgcagttacaccaattgtcctaataacgttttttatataagcagttttctcccccaggtccaggatcttgtctaggactatgccttgcatttgttggtcatgtctctagtctgtttttgtttttttgacacagagtctggctccattgctcaggctggagggcagtggtacaatattagctcactgcaacccccacctcctgggttcaagcgagtctcatgtctcagcctcccaagtagctgggattacaggcgcccgccaccatgcccagctaatttttgtacttttagtagagatggggtttcaccatgttggccgggctggtctcgaactcctggcctcatatgttccttccaccttggcctcccaaagtgctggtataacaggcatgagccaccgtgcttggcctctagtctgttttaatctgtaacagttctgtgactttttcttgtcttttatgatattgacatttttgaagagtgaaatccagctgtttcataagctgccctccaatttgcgcttgtctaatactgcctcatggtaatattcaaattacttatttttagcatcatactgcataagttgtgttgtgccctcctcagggtatgacatttggaggcacatgaggtccctttgccctcacaggtgatgttaatttaggtaacttggttacggtgttgtctgtttctctactccataattactatttttccttttgtaattattagaggaaatattttaggatgatacaatattccattcctcttccaactcctttcctctacccctgcacacctgatttattgatgtttttgaagagcacaggccagttggtttataaaatatttcattttgggtctgctaatgtttcttgtgatttgattcaggttatgtgcttttggcaacaatactgtataggtgatgtattactttcaaaggatcacaccaggaagcacataatgtcagtttttaagaaatagcatcattaacaactaaaatttaagataggattcagcaaatccagatcttctgtatcatttcttctgaattttcaggcagaacttgaggtagattctataattcctatatccacctaggcagatattcttgggggaacaaaatctatttgtaaacaaatagtgtaatatgacattagggttttgtttgtttgtttgagatagggtctcattcagccacccaggctagagcagtggcatgatctcagttcactacagcctccgcctccccggctcaagtgattgtcatgcctcagtctccagagtagctgggactgcaggtgtcccagctacttttaaaaaattacctgtgcccggctaatttttttagtatttttactagagatgggttttcgccatgttgcccaggctgatctcgaactcctgagcttaggtgattcacccacctcggcctcccaaagtgctgggattacaggtgtgaaccactgcacctggccaccattaggtttttaattagcaatttttatatcatttggcatttgattcaacaaggatttttaaagtatttaccaagagcatggactgtgcttcagtggaaacaggagttagaaacatcttggccacgtagaatatgtggttgacttttagaaaccagcctttacagatgttttaacttacatgtaagttcaaggtacacactaaaagttccttgaggccagaaactgcatgtatacatagcacctagtacagtactttgtaaatcccaacagatatatactgaattaacaaatggctcatttaaaattcatggagtcttttccttttacaaattatctaatacggggctgggcaaggtagctcatgactgtaatctcagcactttgggaggctgaggtgggaggattgtttgaggcgaggggtttgagaccagcctgagcagcatagtgagacccccatctctacaaaaatttaaaaaattagccaggtgccatggtgtgcacctgtggtcccagctacttaggaggctgaggcaagaggattgcttgagcacaggaggttgaggctgcactgagccgtggttgtgccactgtactccagcctgagtgacagagcaagatcctgtctccaaaaataaaaataaataaaaataaaaatccaatgcatgtcagctccaggaggacaggaacatttgctttatttactcaggcaatctatatacttagaattgtgtctatcatatagtaagtgctcagtgaatatttgttgagtaaacaaatatgagtagacccatcagttaagcaaaaatcttttcataatttatgttataatttttcaatgtaaacataatatcgtatattaggttttttatctaatagattttcagagagatgaatgtttgtttagtcataaactttttcagtttttgacctttttttcctaccttttcaaagaaaccatcagaattatttgaacttcaagaagatgaagccctacgaaggtactcttttcctttacttatattcacctatatcgtgatgcaaaatagaaatcttaccagtacatttttcagcagttgatttttttaaagggctttcttgataaaactcaggtcagagtctatgagatgaatcagttcactaatacgtggctaggagtctgcagtggaaaacatcagagccagccaagatctagaatttctgaactcctgcgagggcgagggttcctagcacacctttagctgaaaggtgcctctcaagcagaagaaaactctttcttagctaggactttggccccagacccttttatgttctcttaccatgctaaactgggttggttcagatatgggccaccagattctttttgctcttctaacctacgactgaggcctagaaaggcacattgattttatctaatgtgctagatctgattggttatggcttgtattcttgagaagactctatctgggctcaagtcagaacgaatgtggcaatccattaatgatgcctggcacaggcatggataagggagcatggtggttcacatgccagccagctttttgtctttctagcctaaaccaaaagtaagccaagtggcctggggaggccctatgtccagcctcagccttggagagctgatagaaaagatgtggaaagacaaccccaagaaacggattccttctggtttggaacaagcaaagctgtcctaatcacccataccatgccctctttccctctggacccgcaccttggcctcatttagtcttttaagggaaaggccacctttgttcaaacaagaagtagctcctggtatgtctacctgaactaggcacgtggaaggtcttggagggaagcgatttaaagaggagagaaaaaggaaatcccaaaaggctacttaatgcaaaattcataacgtgctgctttttccactaaaagctctgccccacccctcctccagctggcctgattcatcctcccttcccggagaggggccagcctgccctgggtctagaggttgaaatgggctgctaacaaggtcctgcataccaaacacagaatttcccatgtgtagcattcaagggactttacagctacagtttgtattaatttcttaaataaaatttaagggatcagagattgactagctattctatagatgaggaggctgaagcctggcgtttattgtgtgtattatcatctttagcaatgaaagaactcaagaaaaagattaagcattctttaaagggggaagcgcaaatgtcattgacccattatccttctgatctgcctttgagttgtctaatgaccgttccatggatagaaagataagtctgttgttttggtaatccatcactaaattaaaaaatgactgtaattaaaattttttttccagagtgcagtatctcctcctgtctcgtccaattgattatagttcaagaatgctgtttgtatttgcaacatcaactacaaccgtaagctctagaaacttaatccaaactcttctgtgcatctcagcttaacatttttttcctgtttatttaccatgcttgattgcattaacagatgattcagataatgctcacgtacatatgtattcaaagtctgtctcatctcctaagcaagcattgtcttgcaccatgctccatttagttctggtctctgtaacatctgcttagcgtgctgaatggtgcacctattgacagtttccactggctgtctgcattcacagtggttaactccctggtcagtccacattcctgaagccaggagccaaacaaactgtccacaaacaagtctccaccaaggcctaatctggctgcatgctctggtcagaccaccccttctgcccactaaattctagctagattgaacttgcaatttcccctaacggcaatatgacctttagcttcaggttcttgcctatagaaatgtcctctgaggcagttggagcagagagaggagaaggggatggagccagtaggcaaatgattctcagagaaaaggaagaaaaggaagtctgaggtgctgattttaaagtccgtgacaaaaaggaaaaagcctccccttatattctctacatataaagacttacgacctaaaaatggtattccatgaaaggtggctagtgcagctcacagctcagctgtgtacatgcttttctttgcagtctgccttatgtgtacttcccattaattagtattagcatgtattcaaatgggaattcacattagtatgatatacagtaatctttccgtatctgtgggaggactggttccaggacccccaaggataccaaaatctgaggacgctcaagtctttcatataaaacggtgtcatatttgcatgtcacctacatacatcctcctatataccttaaatcatctctaggctacttataacacaatgcctgcaaatcacttcgtccccatggattcagtgtagtacttggcatgcagcaaattcatgtttggtttttagaactttgtggattttttttttttcttgagtatttttgatccactgttggttgattccacgaatacagaacccatggaaatgggggctgactgtggattcaaaagttgaggtttagtaaaattaatttttactacttcatcaagaacattctggtttttttttgtgttttttttttttgagatggagtcttgctctgtcacccaggtcggagagcagtggcacaatcttggctcactgcaacctccgcctcccgggttcaagcaattctcctgcctcagcctcccgagtagctgggattacaggcgcacgccaccacgcctggctaatttttgtatttttagtagagacggggtttcaccatgttggccaggctggtctcgaactcctgacctcaggtgatccacccacctcgggctcccaaagtgctgggattacaggcgtgagccactgcacccagcccatcaagaacattaagtgaaatttgtctttggttttctttttctttttctttttcttttttttttttttgagagagagtctcactctgttgcccaggttggagtagtgcagtggcgcgatctcagctcactgcaacctccgcctccgggttcaaatgattctcctgcctcagcctcctgagtagctgggattacaggcacgtgctaccacacccggctaatttttgtatttttagtagagacgtgggtttcaccatgttggtcaggctggtcttgaactcctgacctcatgatccacccgcctcggcctcccaaagtgctgggattacaggcgtgagccactgtgcccggccacctctttggttttcagtactgccagggcatgcctgtaaatacaagggctgcaacaacagttgggggccctccctccattctgcctgcaatttcacccaccattgcttttgcacagtcagtgcaaatatcaacacagtgtaaaggcaaataacatcttagtatcatgaaaacagctttgaccctttccctcttgaaggagtctcaggaatgccccttcaggggtccatggaccacatgttaagaaccactgttacacacagtgcgttccgtaactgtagagattgactttacattttaaaataatgacgttgtttatgttgcctatgttgaaactcatttacccaactacaatgtgcaggtgttcaactctccaaacctcttttggtttttcagacattaggtatgcatcagttaacttttgcccatagaactcgagctcttcagtgtctcttctatttggctgacaaggaaactatagaatctctctttaaaaaacccattgaagaagtgaagtaagtagaaatgtttaaattgtattaagaaataggaaacagatcattttttggagctgtaccttttaagccctgaattcagaagagcatagtagagtagctgtgtgaatacagttctgttgccctgaatatccttgacattttggcaaagggaaaatagggctttgagaacatcttgtttccatcgtttcttggagacatttagaaactgaatgttttatttatcttgttcaaattgatttctatctaatgttattatatattcagtgaatatatttggaagtccaaaatggacatttaaaacaaactggcctaatatttccatatggtagtttttattttaaatgtaaatgtggcctatgagaatgattcttagaaacgtttctgttttccagatcttatttgagatgtataacttttctggcatcatttgagactttgaatatccccatcacatatgaattattttgcagcagtcctaaagaaggaatgattaagggtctgtggaaaaaccacagccacgagtccatggtaggtacacctcactgccccattcccaattccctgcccctactcagaatcctgaaagagaaaaccaggaacagtctttttgttgttgttgttgttggggacagagttttgctctgttgcccaggctggagtacagtggtgtgatctcagctcactgcaacctccatctcccgggttcaagcctcagcctcccaagtagctgggattataggcgcccgcccaccacacctggctaatttttgtatttttagtagagatgaggtttcaccatattggccaggctggtctcgaactcctgacctcaggtgatccacccacctgggcctcccaaagtactgggattacaggcatgagccactgcacccgacccaggaacagtctgtatccctgagcaactctactgctctgagacctttctactctcctgtcacagcgtgtggatggataaggcagtgtggaaggtccttttacctcttttgccttaaagtccaccagctaaagtcatccctgccaaccagagagagcacttttataatctcttccacggcttatctgtccttatctggacagggagaggagactgtccggtagacagaggatgtcatttctcttcctcttagttgcctatgggatttagcctctgagtcagttggaggctggggcaggaaggttttttggtccaacaggcaaactttttcaatagaagaaagaaagggggagacatccgaggtggtgtctgagtccatgacagcaagaaaaataatcttttttgtcatgtctttcattagaaagatgggggtcttcgatagacattcacagattagaagcatattttgtggccgggcgcagtggctcatgcctgtaatctcagtactttgggaggccgaggcaggtagagcacttcaggtcaggagttcgagaccagcctgcccgacatggtgaaaccccgtctctactaaaaatacaaaaattatccaggcatgatggcggccgcctgtaatcccagctactcgggaagctgaggcaggagaatcgcttgaacccaggaggtggaggttgtggcgagctgagatcatgccactgcactccagcctgggcaacagagtgagactccatctcaaaaaaaaaaaaagcagcatattttgtattaagctgccctacttttccaaagatggcttgatttactggtgtcttggaatagcatgatttttttctttttttggcttcaggcagtaagattggtgactgagctgtgtttagaatacaaaatctatgacctgcagctttggaatggactcttgcaaaagcttctgggcttcaatatggtaagtaagactcaatgccctcgactaagtatatttgaaagcttttgcacagcatcccctaaacattttggattgatacttgttatggaacagatttatgctgaaaacacagtcactctcactgagctcatgccaaacttaaagaacttggtgttagaccagagagtgcaaaatccaaaatgacataaatttcattggaaacaaatggaaggttccctagccttttttgatatttatgaacttgtaagtgaacttctctggcagttatcatggaagataacgttttaccagtacttcttctggaactttaacatctggtatttcacattgaaattttccattttggtggtctttagaacttttttatttttaattttttacagattccttatctaaggaaagttttaaaagccatctccagtatccattctttatggcaggtatgtagttttttaaaataaattttattgaatttagtctttatactttctggccttgtgactgctggggacactggattaagcagtcagctccttcttaaataacagaactgagccaagtacagtggctcactcctgtaaccccaacgctttgggaggccaaggtggaaggatcacttgagcccaggagtttgaggctgcagtgagccgtgattgcaccattgcactccagctccggcctggggaacagagctagatcctttccctaaaataaagaaagaagaaacagaactaatcagctgtaggatgattaaagttgtgcccggacccgttaatactcagctcacatcacctcctgaagatactgttttcctgagttttccaggcctcacgagtcacatctttatttatgctctcaagacattttggctccactctgacttttgtcaccatataattagttttaattatatgttggactgcccctcacagactttgaagatctttcatgtcagataccctggcttgttcatcttttctacatttcacataagttgtgtacccatataatcataatatatattacgcagaaatatataatttattctttgtttgataaattagaacaatatagaagtatgctgagtaaaacatgaaaattcccccttactctttcccttcataattatctccctaagggaacgactgcttacaatttcctatgtattctagagatttccttttttttttttttgagatggagtctcgctctgttgcccaggctggagtgcagttgtgtgatctcggctcattgcaagctccgcctgctgggttcacgctattctcctgcctcagcctcctgagtagctgggactacaggcgcatgccgccacgccctgctaatttttgtatttttaatagagacggggtttcaccgtgttagccaggatggtctcgatctcctgaccttgtgatccgcctgcctcggcctcccaaagtgctgggattacaggtgtgagccaccgcacccggccgagatttcctgttttacaggcatgtatgctatgtgtgtgcatatctacagtgtatatatgcatttttgcacacataaatgcaatcacattctaaacaaagtgttgttttcacataacagtggtctctggagattgttccatatcagcacatgtagatctatctaattgttttattgagatacaattcacatgtaaaatttatccttttaaaatacacaatgaagtagtttttggtatatgcacagagttgtacagcctcaccattatctaattccagaacattttcctcaccccaaaaagaaaattcatatccattagcaatcattccccattccccactccctccagcccccagtgaccactaatttactttctgtccatggatttgcctattctggacattttgtatcaacagaatcccacactatgtgggattttgtgtccggcttctttcactcagcatccacattgtagcatggatcagaacttcattcgtctttattgccaaataatgttccattatatggatataccacttttatttatccatttgccagttgataaagatttgagtttctatttttggtcattataaataatgctgctatgaacatttgtgtacaagttttcactgaacatgttttcatttctcctgagtatatacctagaagtgggcttgttgggtcttacagtaactctatgtttagccttttgaggtattttattatttttaatgcttgattattctccagaatatgtggtaaaatatacctgaagttacttaaccactcctctattgatggaagtttacattttctttcctcttttttttctttaaatgtatagagatggaggtcttgctatgttgcctaggctggtcttagaactcctgagctgaaacaatcctcctgccttggcctcccaaagtactgggattacaggtgtgagccaccgcgcctggccagtgttctttccttattcaccttcttgaaattctttctcttgtccccttccttctttcctgtggccctggcacataaccggctaaggattaattttcttttctgagttgggttctgactttttgccaaatggaataatgaatcagcaaggattgtataatgagatcctgaaagatacagttatgaagaacattatgctagaaccttaatcatctcaaacagggagatatcagcttatgattttagtcatctggaatataaactataaatgtacagttttgtgaccatttaacagcggcctctagagagtgttccgtatcagcgcatagcgatttatctaatttttttgttgagatacaattcacttgtaaaattcatccttttgaaagtatacaatcaagtagtttctgctatattcataaaattgtacaaccatcaccattatctaatttcagaacatttaggctgcaatttaaagagagttcataatacctttttcgagatggagtttcgctctgtcacccaggcaacctccgcctcccgggttcaagcgattcttgtgtctcagcctcccgagtagctgggattacaagcatgcaccaccatgcctggctaatttttgtatttttagtagagacggggttttgccatattggccaggctggtttcgaactcctgacctcaagtgattcacctgcttcagcctttcaaagtgctgggattataggtgtgagccaccgcgcctggcctagactgcaaattaaagagagtttgtaatatccttaacatgaatatcccaaacgtggacttgttttcacaggttccctacttcagcaaagcgtggcagcgtgtgatacagataccactgctttcaggtatttcgctctctgaaacattggctacagcattttatagttgagtgtgtgtatatcatggttgtttttttgttttgttttcagcctcttgtcctttaagtcctgatcagctgtcagattgttctgagagtctcatcgctgtcctcgagtaagcaaaatatttgttctaccaaaaaaaaaaaaagtttgttgcttataagattcccttctaatagatatctctaatgagtaattcctttttgttaggaagttaagcataacacgtgtttgttgttgttgttgttgttttgagatggagtcttgctctgtcatccaggctggagtgcagtggcacaacctcggctcactgcaccctccacctcccagattcaagcgattctcctgcctcagcctcctgagtagctgggattacaggcacgtgccaccatgcccagctaatttttgtatttttagtagagatggaatttccaaagtgttgggattacaggcatgagccatcccgtgagtagctgggattacaggcatacgccacgcaccaccacgcccggctattatttgtaattttattagagacagcctcccaaattgctgggattacaggtgtgaggcactgcgcccagcaacacttgttttgttttttgttttttgttttttgtttttgttttgttttttgtttttgagacggagtcttgctctgtcacccaggctggagtgcagtggtgcgacctcagctcactgcaagctccgcctcccaggttcacgccattctcccacctcagcctcctgagttgctgggattacaggcacgtgccaccatgccaggctaatttttgtatttttagtagagatggaatttccagagttttgggattacaggcatgagccatcccgtgagtagctgggattacaggcatgcgtcatgcaccaccacgcctggctaatatttgtagttttagtagagacagcctcccaaattgctgggattacagatgtgaggcactgcgcccagcaacacttgttttgttttgtttttgagacggagtcttgctctgtcacccaggctggagtgcagtggcgccatctcggctcactgtaagccctgcttcccgggttcacgccgttctcccgcctcagcctcctgagtagctgggactacaggcgcccaccaccatgcccggctaattgtttgtatttttaatagagacggggtttctccgtgttagccaggatggtctcgatctcctgacctcatgatccacctgcctcggcctcccaaagtgctgggattacaggcttcagccaccgcgcccggccaacacttgtttttataccaaaatatcttgattatttttacaatgtctacttccacatgtgttgtgcgacatagtaaacatgagcattctctataacatgcatgatgaactaactttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccattttttttataagcaagtgatttcttggttttctgtgagttctatttcaaagaaatgttcatattgtcttttgcagagagtggttagatacattctcaaacaagatgtcccatcttctttagaagatgctttaaaggtagcccaagcgtttatgttatctgatgatgagatctacagtctaagaattattgacctgattgatagagaacaggtttgtaagttttatgttgtcatttcatatggcttctttgtttctgtgttgttgttgttgttttttgagacagggtctcgctccattgcccaggctggagtgcagtggctgtgtttcaccatgttggtcacgctggtctcaaactctcaacctgaagtaatccacctgccttagcctcccaaagtgctgagattactggtgtgagctaccatgcttggcctgttgtgtttttaaatgtcattatttttatatgattctataatcatagcaatgcctaggaattaactcttcagtatctaggatcgtattttaaatttattttattgtttgctgtcatcaaaaatggattttcagcatcaggatggatagctgatgcatgcagggcttaaaatgtgcatgacaggttgatgggtacagcaaaccaccatggcacatgtaacaagcctgcacttcctgcacatgtaccctgaaacttaaagtaaaataaaataaaaatggattttcggattattaaaacattgaaccataatctgtttttccaaatgatgtattttcatctttaaatagaaaagaaagaggtaaggccacaccgtcctttgcaaataccagctgttttttcttcctttcaaaccctgtttatagggtgaagactgtctccttctgttgaagtctttgcctcctgctgaagctgagaaaactgcagaaagagtcatcatatgggcacgactggcattacaagaagagccagatcattctaaagaggtgacattttcactaagtaaaatataagtaaatccaatttttatggctattaatcaataggatagaaaagatggacttacacatatgaagatctgctcttctcactgctagggtggcctagtgaaaaaattcctgggtaaatttactactaggagaaaaaaaacaattgtggctgccttggagcggctgcttgagcccacagagaatgacctgggagctgtgggttagcaggtgtcttggagcagctgttgtacacgaaaggtttctataaagcgttgcaatataaacaatgttttgtgttatataggacataattattgtcaaatagtaatgtcagctacaaaaccaatataaatctatataatcttataacattgaaacttagaaatggttttaagagagtttacttttttgcagatgaggaatacttggtttttccagaatagctggattcttactgatttttaattttttctctttttttaaatattatatataggagatgaggtcttggtatgttgcccaggctggtcttgaactcctgagtttaagttctcttctagccttagcctcccaagtagctgggattacaggcatgcaccaccatgctcaatagttgggttttttttttcttttcttttcttttttgagacaagagtcttgctctgttgctcaggctggagcacagtggcgcgatcttaactcactgcaacctctgcctctcaggttgaagcgattctcctgcctcagctgggagtagctgggattacaggcgtccgccaccacacctggctaatttatgtatttttactagagacgggtttcaccatgttggccaggctggtctcaaactcctgacgccaactgatctgcctgcctcggccttccaaagtgctaggattacaggtgtgagccaccacacttggccaatagttggatttttaaacccctaaggatagatacctcccaacttctctcagtccatttcagtaatgttttttgctgttggaaaatgaagttattgttgtttttaacacctaatatttgctatgcaataggcattaggttaaatagctacttcttgttcataacaaaggtgtaaagtagttcctattgttgtctccttatgtattaagttcaaaaaccaaaatatgaaagtaaatgacttttttccaaggttgttagaaaggggcagaacctcagctcaaactgtttaataccatagtctgtattctttttttttttttttttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcctgcctcggcctcccaaagtgctgggattacaggcgtgagccaccgcgcccggcccgtagtctgtattcttaagtaccagtttgaattgctcccgttatgaaaatatttgaatttttttattggcgaggcacttactaaacattttacatacatcatgtcttttaattaaagcatctcctttttttccttctcttaaaatttttttaaataatcactggaaggtagtgattatttattagacttctgttctctaggccattttttagacttctattctttttaacttttccaaatgttttttcaaatagtaaataactctaaaagcgaataaggatctattaatcataatgtagttgaaaggttatttgggagagttgcatattctttgatatttctaaatcatatatccaggagttcatactggagtttttcaggtctaccctgtataacgctcattaaccatccatttctcagctgcccaactcctccacgattgttttttctgcttctgtggtttttgtgtatttgtatatgtactactgaagtggtcagaaaaggaagtagattttatttcgctttatttatttatttttagggcaaggcctggagaatgtctgtagcgaagacatccgtggacattcttaagatactatgtgacattcagaaaggtagcttttacttctgttttctcatctcagttttgttccaaagctcaccctcttcagaaagaggcatcgaagacaactctcaccgtacccgcagtttttctggttctgattgtctttattgatcttacccattttgcttcatgaaaagtcttcctttattcctttatcagcaattcaagaacagatgcatgcaaaatcaacctatcatttgtttatatgctcacttactatttagtgctagactagatttccttagcgtctcgcactcattgctcatttttctcatttatcagttgcttatgatggtggggagaagccatttgactggaagttaaataaaacagtgaagaaagtaactttccagggaaaaaaaagaagctacaatttacttcagaaaaataacttttttgtaacacataaacttctgttttctacctcctgaaagaataattagatttttttcaaattagatcttttgtacttagttactgtatattatcatttgagaagaactactgaagacttgagatgagagaaccaaagctaattaaaatttcttctttttaaaattctgataatatgagaatttgcatgagtgctataacttttaaaaatttaattacagacaatctgcagaagaaggacgaatgtgaagaaatgttgaaactatttaaagaggttgctagcttacaggtaaacatattgagccatgttaaacattattacttgaccaatcagtgcatttttccctccttaaagttttctgtatggctgggcgcagtggcttacccctgtaatcccagcactttgggaggccaaggtgagtggatcacaaggtcaggagatcgagatcatcctggctaacacggtgaaaccccgtctctactaaaaatacaaaaaattagccaggcgtggtggcactcacctgtagtcccagctactcgggaggccgaggcaggagaattgcttgaacccgggaggcggaggttgcagtgagctgagatagcaccactggactccagcctgggtgacagatcgagactccatctcaaaaaaaaaaaaaaaaagttttttgcactagcctttagggactggagatactggttttccttctctctctctctctctcaacagctgtattgagatgtaatttacataccatataattcatccacttaaaatatacaattcaatgatttttttgttatgttgtgttattaatttttttttttttttttgagatggagttttgctcttgttgcccaggctggagtgcaatggcgtgatctcggctcactgcaacctccacctcccaggttcaagtgattctcttgcctcagccttcccaagtagctgggattataggcatgtgccaccaagcccggctaattttgtattttaagtagagttggggtttctctgtgtgggtcaggctggtctcaaactcctgacctcaggtgatccgcccacctcggcctcccaaagtgctgggattacaggtgtgagccaccgcgcctggccttttttctttttttgagacaaagtctcactctgttgcccaggctggagggctgtggcatgatctcagcttactgcagattctgcctcccaggttcaagagattctcctgtctcagcctcttgagtagctgagactccaggcatgtgccaccacacctagctagtttttgtgtttttaatagagacggggttttgccatgtttgccaggctggtctcaaactcctggcctcaagcgatctgcccgcctcagcctcccaaaatactgggattataggtgtgagccaccgtgcgtggatgcattattaattttgttaaaatacttataacaaaatgttccatgttaacagttatttagtttgtaattcagtggtgttaattacattcacagtgttgtgcagccatcacctctatctactttttcatgaccctgagcagaaactccgtagccatgaaaaaataactcccctttcctctcttctcgcagcccctggttatctctactttctgtcgctgtgaatttgcttattctagctatttcatataagtggaatcatacaattaagcatgtaaaggagtcctatgacccaaaaatttgagaccagctgtaaatagctttctctgtgaaaaccatctggaggccgggtacagtggttcatgcctgtaatcccaacgctttgggagaatgaggctagaggatcacttgagctcatgagtttgagactaccctaggcaacatagtgagacctcgtctctactaaaaataacaaaaattagctgggcgtggtgatgcgtgcctgcagtcccagctactttggaggctgtagcaagaagatggtgtgagactagaaggtggaggctgcaggagctgtgtttataccactgcactccagcctgggcaacagagtgaaaccctgccttaaaatgaatgaatggatggatgtaaacaactgggaactaccttgctgaggtggggaggggaggagggcaaaggtcgaaaaactacgcatcaggtactatgctgggtgatgggatcagttgtacctcaagcctcagcatcacacaatatacccaggtgagaagcccagacatgtacccctgaatctaaaataaaagttgaaattatgaaaaaaaaaactaatgaaaatgattattttaaacaatagattaaacagacttgggactttgtcttgcttacctttgctacaggagaactttgaggtctttctttcatttgaagattatagcaatagttccctggtagcagatctccgtgagcagcacattaaagctcacgaagttgcacaggcgaaacacaaacctgggagcaccccagagcccatagctgctgaggtgaggagcccaagcatggaatcaaagctgcacagacaggcactggccctgcagatgtccaaacaagagctggaggcagagctgaccttgagagccttaaaagatgggaacatcaaaacagcactgaaaaaatgcaggtgacattccagatccctgaattgcatagcttctctgaaattgcggctgggcacggtaactcatacctgtaatcccagcaatttaggaggccgaggcaggcggatcacaaggtcaggagatcaagaccatcctggctaacatggtgaaaccctgtctctactaaaaatacaaaaaattagccaggcatggtggcatgtgcctatagtcccagctactggggaggctgaggcaggatcgtggcgggttgcagtgagccgagatcacaccactgcactccagcctgagctacagagcaagactccgtctcacaaaaagaaagaaagtaacaactgcctgatttcttcagtcataagggtagggccagtgacactcttttttcacagaagcaattcttgatttctcaccttcagagcatattttgggcctcagtgtcagaaagtagtagcataaaaggcaagtaagcaatactgcagagttaggtaacataaccattaaatttaggttactgtgcacttcagcatttaatggtatccttagtcatttgaaaaacaggctggggccaggtgtggtgactcacgcctgtaatcccagtactttgggaggctgaggtgggcagatcacttgaggtcaggagttcaagaccagcctggccaacacagtgaaaccctgtctctactaaaaatacaactgttagtcgggtgtggtggtgggcacctctaatcccacctactcgggaggctgaggcaggagaatcgcttgaacctgggaggtggaggttgcagtgagcccagatcgtgccattgcactccagcctgggcgacagagtgagactcagtctcagaaaaagaaaaacaggctgggcacggtgactcacacctgtaatcccagcagttttggaggccaaggcaggaggattacttcagcccaggagtttgagaccagcctgggcaacatagtgagagctcatctctacaaaaaaaatttaaaaattagccaagtgtggtggcacacacctgtagtctcagctacttgggaggctgaagtgagaagattgcttgaccctggaggttgaggctgcagtgagccatgattgtgccactgcactcctgcctaggcgatagggctagagcctgtctcaaaaaaacaaaagaaaaactacactatataccatgagaacatttaaaagacatttaatgtgttgatggtggtggtgatatattaatccaagaaaggccatgcgttcactttcaatgtgagtattctaactaccaatactttctttcttccaaagcgacttgtttaagtatcactgcaatgctgacactgggaaattgctatttctgacatgtcagaagctttgtcagatgttggctgataatgtcccagtgacagtgcctgtgggactgaatcttccttccatgatacatgatctagcaagccaagctgccaccatttgcagtccaggtgacaatatttataatatacgtagttttatattctctggttcatgtcatacttgtctcccaaatgctgtctctttacaattggacatcacggtaatcagactagagatagtatctgcatttcacaaagggatgcttataattgattctctttgaggattattgtttgaaagtatttcaaaatactaacaatgtcatttctgactgttgacattactcacttttgtaggattatgaaattccttgcctcccatatctgatcttattttcaagtcaagcttgagaaaaaatttaactttttagggtagtcaaagctatatggaacctttctatctacattgtggccttccttagaattttaaatggtaattattaaaaggttgttttcattatcctaaagacatgaaatatgagtttaatgatttttctccattttgtttcagattttttactagatgctttagaactatgtaaacatactttaatggctgtagagctttccagacaatgccaaatggatgactgtggaatcctcatgaaagtaagttacttttgagttttttcccttaaatcctgggcaacgcattatgcaccttttttttttttcggacagggttttgttctgtcacccaggctggagtgcagtggcatgatcaaggcttactgcagtcttgaactgggcttaagcagtcctcccacctcagccttctgagtagctgggactataagtgtgtgccaccacatctgactaattaaaaaaaaattttttttttgcagagacagggtctcaccatcttgtctaggctggtcttcaattcctgggctcaagtgattcccccacctcagcctctcaaagtgctcggattacaggcatgagccactgcacctgggccgttttttaatcatttgcaaagtttatgaaaatactgaatccacctcttatgttttcttaccctagaccggaaaacaacgtaagggcatgaggccacttctctgttccagtcacttgattggctttaatttgcactatctttcaaaacattgggcctccagcaaggcctccctcgacattgtccttctgttagagtttaacttaaaatgaaatttctataagccatagaccagaagaaacaatgtgttgtgcagcgtactgagttctctcttttttgtatgatttggcacctaggcttcttttgggacacataaagatccatatgaagagtggtcttacagtgacttcttcagtgaagatggaattgttcttgagtcacagatggtgcttccagtgatttatgaactgatttcatctcttgtgcctctagctggtaagtcttatttgtatcattattttctatgtgtttctgtcttatgtaaatttaaactgtagaggtttggagctagaactacacacagtaatgtgggcgaaccttataagcgtaatgtggagctaaagaagcagatacaaaagaataaatactgtgtgatttcatttatgtaaagtacaaacacaggctaggactaagctggtgctgtttgaagtcagggcagtggttacccttgagggtgggaaagggaaaggagggagctggggagctggcaatgttttgtttcttttttgtgtgtttgttttgttttgttttgttttgtttttgagacggagtcctgctctgtcactcaggctggagtgcagtggcatgatctcagctcactgcaacctctgcctcctgggttcaagcaattatcgtgcctcagcctcccaggtagctggaattacaggctcatgccaccacgcctggctaattttgtatttttagtagagatggggtttcaccatgttggccaggctggtctcaatctcctgacctcaagtgatctgcccgcctcagccttccaaagtgcagggattacaggcgtgagccaccgcgcccggccgatgttctatttcttgatctggatgctgcttcttcagtttgtggacgtttatcaggttatacacttacctgtgcattttcctgtgtatatttatttttaaagcatcagttcgctttagaactttttttataatagtgaaatatttacacatctgtgagagtatgtgctgtgtgagggttatttatttatttattagttgtatgaatttaaggggtccaagtgctattttgttacatggatatattgcatagtgatgaagtctgggcttttagtgtggccatctatttagtgttgtttaatgttttattatcttttgtagaaagcaagagatatcccttggagtctaccagtttgccatactgctcccttaatgaaggtatttggcacaagaaatatatagcattctattaatatttatttatttatttatttatttattttatttttttgagacagagtcttgctctgttgcccaggctggagtgaaatggcatgattggagctcacaacaactaaccacctcccgggctcaagcagttctcctgccttagcctcccaagtagctgggattacaggcgtgtgccaccacgccgagctagttcttttgtatttttagtagagacaggatttcaccatgttggccagcctggtcttgaactcctgacgtcaggtgatccacccgcctcagcctcccaaagtgctgggattacaggcgtgagccaccacgtctggccttaagatttcttaatagaaagaaatggtggtgtgctcctgtagtcctggttacttgggaggctgaggtgggaggatctcttgagcccaggaggtcagggctgcaatgagctatgatggcactactgtactccagcctgggcaacagaagaccctatctctaaaaaaacaaaaaatcgtagttctagaaatttcttgaaattctaaatatgaatgtgatttaatatccttaatgtaattgtttagttattatttttacattgttatttgtttaaaagttcagtagattatgtgatttggcttatagtgttaacttctatgaatttgtttataaatttttatctttcaaatggagaaatggtttttcttcagctaaaataggcaagttacaatcaaaggatctcattaactagtagacttagttattttctggtttaagtcaagcctcatgttaacttctcattaactaactgagaacaaactccatgactattatctgtattgaagaagcaggctgtccctgaaaacagttttcaataatatgatctttctttgtttaaaaaatctaaatattaaaatcctttatcactctgcaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaaggtatagtgtcaagaacaaatactttgacttggggtgaatatagatgtaaaagcgctaacagaggaatttggagtccacgttttcctattgtctttgtagcaaggaaattggtaattcgtcagatttaagaacatttgttgagcatctctaagaatctggtgtgggaataaggtgcctgcacacattttcatactcattctttgcaacagccctgagagtttccagtttacaaatgtggaagctcagctcagattcagggaggtggaataagttaaccaaggttttatattgtagtggtaagtcttcacactctaagcttagtgcagtgtccactataccacatttggtcaaaatatctgctgtttgttttgttatcacctaaatggccaaattattataattatttctgagagtatcattgagcatcattgaagagattctagaagacaaactaactgttgataactcgcttatgaaactgggcctcagagggagttgtcttcatttctactactctgttgatatgtattaaatgctgactcttttttaatgaactgtattgaggtataactttcaaaattaaaatgcacattttaagtatatcaaccaatgtactcaccttgtcaccaacaccacagtgaagacttagggtatttttaatgcttcctctttgctccctcccagtcagtcccccacccctttctagcactataggttaaattctgatactttttggatataatgatgaattttcaccaaagttccttaatatttgaaaaaattttcagaatgttatatagaactagacctaaatatttttttcttcttttctaaaagttatttggagagactacattagttaaatcaaggcatgttgttatggaattgaaagaaaaagctgttatatttatcagggaaaatgctacaacactactgcacaaagtaagtatttgttctgggtaaaaattttgtttgttttttttttgccttttacctcagttaattgcatatgactcaatagtttatgattcagtacagtagtattttactattcaaaaacttcaagaaactgtcttatagctaatcaattatatttttattatggtaattgacatgctatagagcttttatgaaatagtagtcaatcttgtccactgtcgtatcctgattttggttacttatatttatatttatttattttttagagatgaggtttttctctgtcacccaggctggagtgcagtagtatgatcatagtttgctacagccttgaacttctgggttctagttatcctcctgcctcagcctcccaagtcactgagattataggcatgagcaactgtgccccactctgtagttatttattttacagattaaagcattccaatgatcctttcacttatttctattgcagaaatcctaattttccattaccctttattttttaaaagattctaatattttaaatattagattttttattagatgtttttaaatattagaaatatttaatgtttcatcaactgtatttggtgaaaatatagttgcattaagcatttaatttcatttgtcagattacttctttaaaaaaattgtgttttttttttttttttggagacagggtctcactctgtcacctaggctatagtgcagaggcaccatcatagcttactgcagccttgaactcatgggctcaagcaaccctcctgctgctcagcctcctgagtatctggggctgctggtgttttaccatgcctggccaatttgtaaaaattttttgtagagacaggtctcactgtgttgcccaggctggtcttggactcttggcctcgagcaatccttccaccttggtctcctgaaatgctgaaagtacaggcatgatattgtgcccgggccccccaatttttttttttttttttttttttttgagacggagtctcgcactctcatccaggctggagtgcagtggcgcgatttcggctcactgcaagctccgcctcccaggttcacgccattctcctgcctcagcctcctgagtaggtgggactacaggtgcccaccaccacgcctggctaatttttggtatttttagtagagaccgggtttcactgtgttagccaggatggtcttgatatcctgacccttgtgatccaccctcctcggcctcccaaagtgctgggattataggcatgaaccactgcacctggcctaaaattttttatttggagataatttcaaagtttcaggaaaattttaagaatagcacaaagatctttggtataccgtttactgtttcatcattttctggcatgctctttctctatttttctatttatatataaaatcatttcatattttgtatatattttttgtatttaggatttagttacatacattatagctctttacccctaaatatttcagtgccctatagaacttgtagttgctttccttactcttcagatagtcataaaggacattaaacctaagcaaacacattagaactatgttactataacttttcatgaaacacttcttctgtagtgtctataattcaatttagtggtaaataaaccttgagacactgaattctgtttttttttctttaaaaagttttttttaagtataaattaaaattattcctctttatttgtatttctgccctttgtgaacaaagttaattctgttttgattgtgaagaatttgcttcttttgctggtttcttcctgtaggtatttaattgtcgcttggtagatcttgacctggcgttgggttactgcactctcttacctcaaaaagatgtgtttgaaaatctctggaagctcatagataaagcatggcagaattacgacaaaatcttggtatgtcctaaggaagcacaccttcaattcttgaagtattcaagattgggggggagaaatgaagttggttttgccacctgttcttaaagatttagtagaagaaatgttgagctaactcgtgatttctaccagcttctgcttgactggtgacatactgttgcctgtatatgcaagttatgagcattgttcaacccaaagaattacagttttttaatttcttaaaatctgtgtacacccttagaacctcaaatcttattttggtgtagttgaaaccctagacccatgaatcagtttgtttttgtaggataagtttaacagatagaaaatttctcttggatattgtgttaagggattttcttgcaagataactaaaatttggccttttattataaaggaaagccaggctaaatgtatagcattatacgaaaacctgaattacctaaatattacgtaagaagtaacgactgtgtacaaaataatatgtaacattctacacggttgatcacaaagttatgatttttattgttgcgtttcgtctaaaaggtgttataagaatacattctacttacgattgaactttaattctcttttaattttttaggcaatatctctggtgggctctgagctggcaagtctctatcaggaaatagaaatggggcttaagttccgtgaactcagtactgatgcccagtggggcattcgtcttggtaaacttggtgtgagtattctttgtactgctgtcatcgattctgttaattacccggttggaaaatttaaaacaaagattctgttgttctttacttttgggaggagagtgtatgtgtactgcctcatacattttattaactacacacataggtgctttcaaagaaataaggaactttttgcctcatttccttttttctgtatttttaaggaaattaaaaggggcctgacattttcagctgcttaactttctcatttataggtatatatctagtatcaattgacatttatgctatttcaggcctagcctttagcctcatacttttgttttctgctgctgttatttaaagataatattaaaatgtatatacagctatataccatgcttcaagaactcctagtgagaggtgacagtgtgcgggcagtcctcacagccctcgctcgctctcggcgcctcctctgcctgggctcccactttggcggcacttgaggagcccttcggcctgccgctgcactgtgggagcccctttttgggctggccaaggccagagccggctccctcagcttgcagggaggtgtggagggagaggcgcgagcaggaacccgggctgcgcatggcgcttgcgggccagctggagttccgggtggatgtgggcttggcgggccctgcactcggagcggccggccggccctgccggccccgggcagtgaggggcttagcacccgggccagcggctgcggagggtgtactgggtcccccagcagtaccagcccacgggcgctgtgctcgctttctcgccgggccttagctgccttcccacggggcaggccttgggactgcagcccgccatgcctgagccttcccccgcctccgtgggttcctgtgcagcccgagcctccccgacaaatgccgccccatgctccacggcgcccagtcccatggaccgcccaagggctgaggagtgtgagcgcacggcacgggactggcaggcagctccacctgcagcccttggtgcgggatccactaggtgaagccagctgggctcatgagtctggtggggacgtggagattctttatatctagctcagggattgtaaatacaccaatcagcaccctgtgtttagctcaaggtttgtgaatgcaccaatctacactctgtatctagctgctctggtggggccttggagaacctgtgtgtcaaaactctgtatctaactaatctgatggggacgtggagaacctttgtatctagctcagggattgtaaacgcaccaatcagcgtcctgtcaaaacaggccactcggctctaccaatcagcaggatgtgggtggggccagataagagaataaaagcaggctgcccgagtcagcactggcaacccgctcgggtccccttccacactgtgctttgttctttagctgtttgcaataatcttgctactgctcactctttgggtccacgctgtttttatgagctgtgagactcacatgaagatctgcagcttctttcctgagtggagaccacgagcccaccgagaggaaggaacaactccagacgctctgccttaagagctgtaacactcactgcgaaggtctgcagcttcactcctgagccagcgagaccacgaacccaccagaaggaagaaactcccaacacatctgaacatcagaaggaacaaactccagacgcgccaccttaagagctgtaacactcacctcgggggtccgcggcttcattcttgaagtcagtgagaccaagaacccaccaattccggacacactagcagaggggacgtaaatggcctttatttttctttctttttttcttttttttttttttttgagacagagtcttgctcttttgccaggctggagtgcagtgggacgatctcggctcactgcaacatccgcctcccaggctcaggcaattcccctgcctcagcctcccaagtagctgggactacaggcatgcaccaccacgcccggctaattttttgtattttagtagagacagggtttcactgtattggccaggatggtctcccatctcttgacctcgtgatccgcccacgtcggcctcccaaagtgctgggattacagacatgagctaccgcgcccagccttgagctttatttttgacattgtaaaagaacagacaagcaggcagggcgcaatcttgtctttgacaggatctcattctgtcacccaggctggagtgcagtggcattatcatggctcactgcagccttgacctctagggcctaagtgatcctcccagcttagcctcctgagtagctgggactacaggcatgcaccaccatgcccagctaattgttttgtatttttttgtagagacaaggtttccatgttggccaagctggtctcaaactcctgacctcaagtgatccacccgcctcagcctcccacagtgctgggattataggcatgagccaaaaccctgttttctttaccaaaaatataagacattttatttgccaacagttgacttatcagaaaggtaatcagtacagaaatgctatatgttttgaagcttaattcttctgcagtaatggaactggtgttctgttgacattaacaatcaaacttttcagatgaagaggcaatggttaggatgactaagaggagtttcggacccatgtacacctcaaatctcagaatgatggctgggttgggtagtgtgaggttggaggagctatagacaaatgtttctttttgaaaaaggatactaagaaggcaagtcatgatgttgcccttactctgatacatttcagtgtagagggtttttttgctttgtttttttctttttatttctagatttcttttcaaccagttttcaggcaacattttctcaccaagaaagacctcattaaagctcttgtggagaatatagatatggacacaagcctcattttggaatattgcaggtaattctttaaacattaacggtatttttgctgttaacaaactggtaattcttttgcaagaacacagtaataacgatgattattttatgaggtccatagaccactattttcttttgctcattcccaaactgagtaaatatgaaatcagattagagtctcttatgataccaccatttaaattcaccatttagtgtttcccaaacttgtctcctgataagcactgcttagggcacttgatttcaaatgcaggtttctgggcctctctggcagttctgactcagtgggtctggaccaaggcctagaaatcgctggtctctaataggagctcaggtgattcctatgatcagaaaagttggagaatattcttctgagtaataaacttctaaatcaggttaactagggagcaaagtaatcttaaaaattaatgaaaagtatgatttagggagaatttctaatttcctattaaaaatgtttataaaagaatttttatttttatttaacttctttctttatttgagacggagtctccctctgtcacccaggctggagtgcagtggcgtaatctcagctcaccgcagcctccaccttcaagccattctctggcctcaacctcccaagtagctggaattacaggcatgcaccaccacgcctggctaatttttatatttttaatagagatggggtttcaccatgttggccaggctggtcccgaactcctgacctcaagtgattcacccgcctcggcctcccaaagtactgggattataggcgtgagccactgcgcctgaacaagaatttttagaactaagataaaatgtgttatttatagattccgctgactttgataagtagggataaatgatttgtaatttatatctcagatgtttctgtctagtaaatacaaggactcgttttctggtttcagaatgctttcagatctgtcacctcatttaatttttatagttcttattgcatatgttgccagttgatatatgagaaaacaacatagtatgtgacctgctcaaggtcaaattattaatgactgcttctaaaatattatgggtgctataacctccatctgatttgtaacagattaatggaatctgagttattgagaatgaaactgcttggtgcatttcctgcactgggcaggcatctagttctttgtctctgtggatagtggggaaagaccgtggctgtcaccatctagtacctgtaagtcaaggactataggctgcgcatagctcgaaggagcactgacttaaaagagtagtttgaaataacaaaactatgtcattcttcagtttagagtgttataaatccagaatagggtatgcacactcttatcttttttattaatttgaactactgctagattcttctgtgatgttttatggtgcaggacacttttttgaaatttaaatagctataatgtcaagttcatttcataattattctacttacgtggcattgatgatttgtattcatatgatagtgacacttctgcctcaggcagtgtatctgaataaatttagataaactttagaatatcagagagtgacttgaaaatggtggtacttaagccttttattgatattttagttatgctgtatagcaaattaaactatcactgtgttattaatagggtctaaaaaggcatttcagttgtcattttgtctatagtaaccangatttgatgaacntactttggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagctgctcttttgcagcctcacgcatctttttgtttatttttcttttggggctgagcatcatgcctcttgacttttttttttttttttttttgagatggagtttaattttgttgcccaggctggagtgcaatggtgcaatctcagctcactgcaacctccgcctcccaggttcaagtgattctcctgccttagccctccgagctagctgggattatagggtgcgccaccacgtccggctaattttgtattttaactgagtttcaccatgttggccaggctggtctcaaactcctgacctcaggttatccattcacctcagcctcccaaagtgctgagatcacaggtgtgagccaccatgtccggccaagttatttcactgttcaattacaatatacatttattggggtgaaagaaaattgaatgtggataggcagtctaattttgtttttttatgatatgaacttatccaatattgaatttacaggcattaaaaaaatcaggttttattctgcaaactgttggtggcatgttaaatgttttgttttagtggtatctggaagactggttggggtttctggatgggccaagaacatgttttcctcatttaaacataggctaggcacggtggctcacgtctgtaatcccagcactttgggaggctgaggcggacagatggcttgaactcaggagttcaagatgagcctgggcaacgtggtgaaatgccgtttctactaaaatacaaaaattagccaggcatggtggtgtgtttgtaatcccagctacttgagatgctgaggcacgagaagcacttgaacccagaaggcggaggttgcagtgagccaaaattttgccactgtactcagcctgggtgaaggagattctgtctcaaaaataaataaataaatgatatgtaaataaataaataaaaataaaatcatagacagctactcaggaggctgaggtgggaggactgcttgagctcaggagttcaaggccagcttgggcaacatagtgagactccgtctacattaagtcaatcaatcaaggcaggtacttccattatctaaattttgtcttccaacacattttaggggggctaataaaggatgccagtctgtccagaaacttgtatagaaggactgagtacttcctcattctgtatatggccacatgcagttagcccattcccttctttaaaaaaatttttttctttgtagagatgaggtcttactatgttgtccagactggtttcaaactcctggcctcaagtgatccttccaccttggcctcccaaagtcctatggtaacaggtgtgagccatcatgccaggcctacattcccctcctgatgagtactttggttgtttccaaacgtttcctccgagaataatggcatagtgagtaacttacaagtgtgtgttcctagaagtggaatagttgggtcaaaaggtatgcatatttgtaattttgaagagattgtcaaattgtcctccaaagaacttatacaaatttaaatttccaccaagatatgagaataaattttctgataattttgtccagttatcaaactttaatttttgccattctggcaagtaaaaaatggaatctaaggtagttttaatttgcatttttattagcattagggaggttttcttttcacatgttccaaagccctttgggccatgcacagtggttcacatctctaatcccagcaactcaggaagattgcctgaggccaggagtttgagaccagcctgggcagcataccaaggtcctagctctacaaaaaaaaaaaaaaaaattggctgagtgtggtgacatgcacctgtatggtcccagctactcaagaggctgaggcaacaggattgcttgagctcaggagtttgaggctgcagtgagctatgattgcttcactgcactccagcctgggtgatagagcaagactccatctctagtggggaggaaaaaagccctttgtatttttttctatggtgtatttatttgtattattatttttattttgagacaggggttcactgtcacccaggctggagtgcagtggcacaatcttggctcactgcaatctctgcctcctggcctcaagccatcctcccacttcagcctcccaagtagctgtgacttcaggcgcacaccaccatgccaggtcaatttttttgttgttgttttttagtttttagtagagacaaggtttcactatgttgcccagtctggtctcgaactcctgggcttaagcaatccgctaacttagtcctccctaagtgctgggattacaggtatgagccaccatgcccagcccagctattttttttttttttttgagatggagtctcactctgttgcccaggctggagtatagtggcttgatcttggctcactgaagcatccacctcctgggttcaagcaattctcctgcctcagcctcccaagtagctgggattacaggtgcctgccaccacacctggctattttttgtacttttagtagagacggggtttcaccatgttggccaggctggtctcgaactcctgacctcaggtgatccacctgcctcagcctcccaaagtgctgggattacaggagtgagccaccatgcccggccagcccaactattcttatttgttatgatatgatctttagaagtctgtctaagacctatgtaaatagttattggacaatgttttaaatataggtcaaacgtcattaaaatatcattgcaaattaagtaacttgcatttttaaactaattattgtggagaaacagtataacaccttcaaagtgtaaaataattttattattgaaactgcaatttaaaaacttgcaattagctaaatagaagcctatatactcgtaataactagcatttttggcactcgggtactgtgctagacgcattttttttttttttttctttttagacagagtcttgcccttgccctatcatccaggctggagtgcagtggcatgatctctgctcactgcaacctctgcctgctgggttcaagtgattctcccacctcagccccctgagaagctgggattacaggcatgcatcaccacgcctggctaattttttgtatttttaggagagatggggtttcaccatgttagccaggatggtctcgatctccagacctcatgatctgcccaccatggtctcccaaagtgctgggattataggcgtgagccaccgtgcctggcctagatgctttatacgaactgattcaaacctcctgccactagaaggtagatacttttactgtcctcagtttgagggaattaagatggtgagaaattgggccaagcaaggtggctcatgcctgtcataccagtacttagggaggccaaggtgggaggattacttgaggcctagagttcaagaccagcctgggcaagaaagcaagaccttatctctacaaaaaaatttaaaaatcaggaaagcatggtggtgtgtgcctgtagtcccagatactcgggaggctgaagcaggaggatcccttaagcacaggggttcagggttgcagtgagctatggtcataacactacactccagcctgggtgacagcaacaccaccctgtttctctctgtgggaaattaaataacttgttcaggcccacacagctagtaagtgatagaactagaactcaaatccagacttattttacttcgaaacctgtgttgaatcatgtttcattgagttttttagaaatcttttttttcaactggcaaaataaaggcaaactaattccagtaacatcaaattcacttaagttattcgcaagtatggcaaaggactacaaagtcagaataacaggtgtaattaacacttctgtgtgctggctttttgctccacacgcctttctaggccaccggctgcagtgctgggggtttacagttgcggaccactcctcccagacttctagccaggtggcttccagtttggttctgctatttcttggcactggggtaaaaattagaagcttggagaaagtgcagagatgtttcttcttttggtggtgggcttggcagcctggacagcagcagtgttaagttgtcagcagcactggcaaagagactcctgggcttctgagcactgcagtggccacagcagctccgacagctcagtggcaaatgtgggctcggggctccaagccaagggccggagcagctcctgatctgtggctgcaaagcccttcttcccttttgtctggctcccgcttctacctcccttctgttctttcagtcttttgaagaactttatagccaatccctggcatgaaattcttctctgcttggcatatctagagtggcttttatttttctgactgataaactctgccactaaaattataccaatattttcttagaataacattaaaaagactgatattcttacttttttatatggaagacataggctataagcactcaattttcttaagggagagagcaaactttttgcactttgtttccttcatatatggtgcaaaaaagttgatagtctctataaattgcacaagtgactggcaatgaaaagacttattaattcaggacatgagttctttatggggcaattatgctcatattgttttatttattacatgtggggtaatgttagacaaatagctataatacagagattgtacaatttaaaaactgtaataaatatggtccattaatagcagactccaaaattcttgtccttcttgaaaaaaaggttcagtgatttacgataatccactaagaaacatctaaatgggaagaaacacagaagtgatttttataagtcacttagtttttcaaattgaaaatggtcagataaactacagaacttaagtgaagtgatacaaatctacatatcaaactatttggcattttagattagagagaaacagattttaaacgccacaaatttatctcccgaatcaatactctccccttctgaaaaaaaaagtaatcttatggcattgagcacaaccacctggaggtaagccctgtaagttattaatgggcggtaacaaaatgcgggctcattctaatatgcctgatctggaccaaaggaagaaaaaagccacgatacttaggtttactaaagctaccaaaatattccgatctgaaaaacagcaaataaaaaataaagctaccaaaatatgatcaaagtaaaaattttacctggcacttaagttcaaaatgggagtaaaaataaattatgtgcacattttacatacaaaaaatttggaagaatgtacagcaaaatgttaacagtgatcctatgtctgggtagtgagattttgaagatcagtttagtatttttctctttcttttggctctttcatatttctctttttcctttgttttttttttttgttttgttttgttttgattttttgagatgagttttgctcttgtcgcccaggctggggtacaatggtgtgatcttggctcactgcaacctctgactcctgggttcaagcaattctcctgcctcagcttccctagtagctgggattacaggctcccaccaccatgccaggctaatatattttttttttggagacagagtcttgctctgtcagccaggttggggtgcagtggcatgacctcagctcactgcaacctccgtatcccgggctcaagcaattctcctgcctcagcctcccgagtagctgggattacaggcgtgtgccaccacgcctggctaatttttgtatttttagtagagacggggtttcaccatgttggccaggctggtcttgaactcctggcctcaggtaatctgccccttggcctcccaaagtgctgggattacaggtgtgagccaccgtgcccagccatacttcttttttttctgcagtgaatatacgttttaggtaattaaagaataataattaatttaaaaagcaattaatacccaagcatgacaataatcaacaccttttagaattcagtttttcacctgcttcaatattaaaaacaccaccttatgaggaatggtaatgctggaaagcacctgagagaccatggggtccagatctgaagactaagcccacattaggctttgctgcccagtggcagggctgagattagaactgtggtctcttgatttctagtttagaactctctaacacaaaaagtaaaatataaaaattacagttacacataaaaatacatttatctccagaacactagaaaaggcttgtcaattttaaggccctaggaatataaacaatgtcaagttagaacctaagaactttccatcagctttaccttcagaatttcacagggagcagtgtctggaggcacaggtttcccgcagtgctttgaatattcagttatcaagactgaagcttcatctaaactacaaaatcaaaaagaaaaagaagtgttaggccaagcacagtgccttgtgcctacaatcccggcactcagggaggccaagatgtacagatggcttgggtccaggagtttgagactagcctgggcaacatggcaaagccctgtctctacaaaaaatataaaattagccaggtgtggtgttgcacacttgtagtcccagctactctggagactgaggtaggaggatcgcttgaacccaggaggttggggcagcagtgagccacgtttgtaccactgcactccagcctgggtgacaaagcaagaccctatttcaaaaagaaaagaaaagaaaagaaaaagaggcattgaagtcaaaattaaaatgtaaagaccaatctctgaatttaatgttttatttgggaagaaataattccaatttggggcatatacatagactgggtagtctctggattgtccaaagaacaaagagaaggttagaggttttatgaaaaagagacatgttacacattgttcttttttttcttttttgtgagacagagtttcactcttgttgcacaggctggagtgcaatggtgcgatctcggctcactgcaacctccacctcctgggttcaagcgattctcctgccttagcctcccgagtagctgggattacaggcatgcgccaccatgctcggctaactttttgtatttttagtagagacagggtttcatcatgttggccaggctggtcttgaactcctaacctcaggtgatccacccgcctcggcctcccaaagtgctgggattacaggagtaagccactgcgcccggccagaattatgtttttggagcaatgttttgtactctgagtgcttttcccctgggcccctcgactctgatgaatttgggtatcacaagaatgacctaattcatgtaatcaacttcacagagggcatgaggaaactttcagagaattatgttcactctcttgattgtggtgatggctttataggtatacatatgtcaaaatttactaaattgcagacttcaagtatgtccagcttattatatgtatcaattataactcaaaaaatacttgctcaaaaatgacaatatctaattatggctggatcacaagagataaacaagcagatggaaatccatggagtggtaatgagaaagaaagacctctcaagcgccaacatggctagaccacatgcagggatggatctggtgtgtactgcggtcttgaacttccctttctttagtgtcagcccacttcttccttctcccgttcagtttccatatccacccccagctctatcccaagaagcttattgtttctaaacttgtgggtgctggaaaattagataaccaggtttaacaaaagtgatgctacataaagtcattaatgttctgagcaagtgtctagacataaaattgtaatgtaggatttagaacagggctgtgagacacttgatttgggggttcagatgacctgtttaattgtcagattctaaggtcatattccaagaaattgggttattaaatgattaacttttggatatgtgcagtaatgagagatgtaatattttgagcttttaattacaaccaaatagctctacagttgacattctgctccaacataaagatagatttttttttttttgagacagagtttcgctcctgttgcccaggctggagtgcaatggtgcgatctcggctcactgcaacctctgcctcccgggttgaagagattctcctgccttatcctccctagtagctgggattacaggtatgtgccaccatgcccggctaattttgtatttttagtagagacagggtttctccatgttggtcaggctggttttgaactctcaacctcaggtgatccacccacctcagcttcccaaagtgctaggattacagtcgtgagccatcgtgcccagcttataaagatagattttaaggaaattccacagtaagtttttttttttttaattaacttaccttaagtcatttgccaaatagttcactagctcagtgatattgttggtattcatcgcatgcatcttcaacatttgaaagtatttggtctttgccaaaatcccaaactccttcttattgatgatattattcaaaatcagacttctaatctatagaatgacaggtatcattaagatcagacttctaatctattagaatcagacttctaatctatagaatgacaggtatcaagcctttattcaatatcaaaacatttctgacaatcggaagcccaattagcactgcattgtgactgcgcctcctttttgagggggtaaaaagggaaaggaggcctgtcagcatcagtcaataaataaagtaattgttgttgtgcactttgagactttttatgaggaagaagatctgttttcaattaaaagcacttaaggctacaaattttccatggagtacagcagtcaacaagacgctcagggtccctgcctcttaaaaaatttactgaggttttagtaaaagcaaaataattctatacataaacaaacagctagacatagcagttttcagcttactcttggtttgggaaaatgactaccttctagtatcaacattttcatagcaaaaaggagatgaaatcgcctcttacttgatgtgaaaatcctgctagctggcccgtgttcatatgctcttccaattgctttaaaataacctgagggtcacaggaacccagaaaattctagagaaaaatcaaagcagaattaatagaaaattgttattatttattccaacagcaagagccgttgatcaggtattttgctcttctaagtgccaaaagaaatctatttaaatactgaaacactgaacgacatcaaggaatgagtgtatgaatgatgaaaagaggggaaaaagtcaaagacaagaacagatggcttttaaaaatgtaattaataagccaaatgacaaataaaaaatatgcatgttcagctgggcgcagtggctcatgcctataatcccaacactttgggaggccaaggccagcggattgcctcaggtcaggagttcgagacctgcctggccaacatagcaaaaccctgtctctactaaaaatacaaaagttagccgggcgtggtggcaggagcccgtaacgtcagctacttgggagtcacttgaacccgggagggaggctgcagtgagctgagattgcaccactggactccagcctgggtgacagagactctcaaaaaacaaaacacaaaaaacaaacaaacgaaaaagcctgaatgcatgtatgttcatttatgtagatctctatctactggtatatctacctgcagggaagataactgtaaaacattcccaaaatgctttgttctacttgttctctattataaaggaaatgagagttatttttaaaagttctatccccaaaatgcttgtggctccttctgatgggcacccacacataaaatctgactctccccctcttctatctcccacattcaattgctaagtctgctgccttccttgtagccttcttgtcttgttcaagttcattaccagaccctatcatgggtacttaaccctcaagccttccctgcctatgcacaaggttgctatgaagagatcaagtgggataaaattctactcaaatgcaacatcttcccaactgtttcacttcttgtcctctcctctgtccaagcctacatgggttaatgggttattccttttaaaataattccttcatcatttcagtttgctgttctaaaataatcacttgtttccccactgatagacaataaggcccaaaccccttgtaagacagccctcagctggaccttaatctatctttcagtcttacctcccactaagcccccatacaagcttcacacatatctgatgtattcatgctttacaggtttgctgaaatgaaaatgcgaccttttgcaagggacatgcaagatgaaaccttctatttccttggcagcccagaggaatcatgtgcacgataccttaatttgctggtgtcttttctctgagtggggcatgagcatcagacaagctaatgcaaaagccggaagttctaactggatatactgcctggcgactccgatcaggtcaagatcacctgagactggacatcttcgagagagaacattaattagttaataatctggcagattcactagattatattggcctttctagctttccatagtcatctgcctgtccaagttttcaataattttaaacactaaagtgctggtgcatgacatatgcttaggaatgagtaacacaagtctttgacagcactctacacagaataaaagaatttacccatgggaacacggactactgtttgctatcatgattatgtctgaaagcctacagatgcctaaagataggcttctaaattctcagaagactcaaaaccttttttttttttttttttgagaaacagtctagctctgtcacccaggctggagtacgatggcatgatcttagctcactgcaaccaacacctcccgggttcaagtgattctccctcctcagcttcctgagtagctgggattacaggcatgcgccaccatgcccagctcatttttatatttttagtagagacggggtttcaccacgttggccaggctggtctcgaactcctgacctcaagtgatccactcgcctcagactcccgaagtgctgggattacaggtgtgagtcgccgcacccagccagaagactcaaaatatatgcgacaacgctgtatgatttagggtagtcaccaaaagtactctatgctcatacagtaggtactcattttagagaatgctcagtttactagtcgcacaacagttgggcagtgaagatgaggggtagtnactgaagtggcttncaaaacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatctctccccgcaagtagtcggttactcactcccaaactggggtgcagtggcgcgattttggctcactacaacctccacctacctcccaggttcgtgtgattctcatgcctcagcctctcgagtagctaggattacagacgcgcaccaccacgcctggctaattttttgtatttttagtagagacggggttttgccatgttgctcaagctggtcttgaacttctgagctcaggtaatccacctgcctcggcctcccaaaatgcaaggattacaggtgtgcgccaccacgcctggctcttttagcaattttgaaatatacattattactaactacagtcatcatagacctctgaaactcattcctccttctaactgaagctttgcagccttgaaacatctctgacacctctgtatcctcccgccccttcccctgggctctagttgtcaccattctactctctactttttttttttttttttttgagatggagtctttctctgttgtgcagtggcacgatctctgctcactgcaagctccgcctcccgggttcaaggattctcctgcctcagcctcccaggtagctgggattacaggcgcccactaacatgcactgctaagttttgtatttttagtagaaaccatattggccaggctggtatcgaactcctgacctcaaataatcctcctgcctcagcctcccaaagtgctgggattacaggcgtgagccaccgtgcccgacctctactctctacttttatgagtttgactattttaagatttcacatgtaagtgagatcatatagtgttttttttttattgtgtctgacttatctcacttaccataatgtccttcaggtttatctgtgttgttgttggaaatgacaaattttccctctttttttttttttttttttttttaaatagggtcttaccatgttgcccaggctgggctcgaactcctgggctcaaatggttgtcctgcctcggcctcctgagcaggctggcactacatctagcttctagactgaacaatattttactgtgcaaatataccacattttatttattcacttatctgttgatggatatttagattccatatcttagctcatataaagctcttagtaagtgtactgcttgacacgtttagtaaggactcaacagaaatggttcccatacctgctaataatctggttcacctctcagatatctgaatgttactttctttaaatctcattcctggagcgcatgaggattcacctttttgaagtagtttgtttcactcagcttactctgagaataagccatccacaggtattattgtacttcaaattgcttgatgtggcgtgtttatattacagcttgtttacaaggtcaagtcaaatcatatattggagaaactggcattgagttctgtggatgccagtgaacagaccgaatggcaacaacttgtagacgacgctaaggaaaatctacataagatccaggtatgtttttcttgtcacatactacagtatttagattgacgtgttgatcaacattaggttgccttactgtgtctggcatttgtgaaacaggatgatgaatttgtggtgaattactgcctgaaagctcagtggataacctatgaaaccactcaagagatgctgaattatgccaaaaccagggtaggttcgtttttttgtattttgtttttttggggcaggggagaatttgctttaatctctcataatcctgcctcaaatatatcttttcctcctatccgctatgtgtattattaataaaaaagtttttataatagcttaatggagataattcacatcctatacaattcacctatttaaagtatacagttcagtggtttttaatatattccttgagttgtgcaagcatcattattgtcaattttagaacttttaaatctccccaaaagaacctctatcccagaccggacgtggtggctcacgccttaatcccagcaatttgtgaggctgaggtgggtggatcacctgaggtcaggagctggagaccagcctggccaacatggtgaaactccgtctctactaaaaataaaaaaattagttgggcgtggtggcacgtgcctgtagttccagctattagggaggctgaggcacaagaatcactggaatccgggaggcagaggttgcagtgagctaaaattgttccactgctcttcagcctgggtgacagagcaagactgtgtctcaaaaaataaaattaaggctatgtgcggtggcttactcctgtaatcccagcactttgggaggccaaggtgggtggatcaccctgaggtcaggagttgaagaccccagcctggccaatatggtgagacctcatgttgtctctactaaaaatacaaaaattagccgggtgtggtgtcacgcgcctgtagtctcaactgcttgggatgctgaggcaggagaattgcttgaacctgggaggcggaggttgcagtgagctgagatcacgccactgcacttcagcctggcgacagagcaagactccgtctcaaaagaaaaagaaaaaatattaaattaaaagataaaactcttaaatggctgggtgaggtgtctcatgcctgtagtcccagtacttagggaggcagaggtgagtgggtcacctgaggtcaggagttcaccagcctggccaatatggtgaaaccccatctctactaaaaatataaaaatgagctgggtgtggtggtgcactcctgtagttccagctacttggcaggctgaggcatgagaattgcttgaacctggtaggcagaggttagggtgagccaaaactgcgccacagcagcctgggcaacagagtgagactcttatcaaaaaacaaaagaaaacaaaacctctatgccattaatagtcattccccatttgccccagtcccccagcttcaggaaaccactaatttacctcctgtctctctagatttgcctattctgaacggttcaaataaatggaatcatatatgtctccttcatgtctggcttctttcacttagcataatattttcagggtttgggctgggcacgttgtttcacgcctgtaattccagcactttgggaggccgaggtgggcagatcacgaggtcaggagatcgagaccattgtgacgaacatggtgaaaccccgtctctactaaaatacaaaaaatacaaaaaattatccaggcatggtggcacgcacctgtagtcccaggaggctgagggaaggtaatcgcttcaacctgggaggtggaggttgctttgagctgagatcgcgcttccagcctggcaacggagcaagactctgtcccaaaaaaaataaaaataaaaaaaaatcttcagggttcatccatgctgtagcacatgtcagtgctgtatttctttttattggcacataatattctattttatggatataccacgttttgtttctccatttatcagttgatggacatttgggttgtttatacttttttcccccaattttgtttatattttgttaaaaaatacataacatgaaatttaccattttcacctttttaaaaaaaaatattttatttttgagagggagtctcgcactgtcacccaggctggagtgcagtggtgtgatctcggctcactgcaacctccacctcctgggttcaagtgattctcctgcctcagcctctcaagtagctgagattacaggctcccgctgccaccacacctggctaatttttgtattttagtagagacggagtttcaccatgttggtcaggctggtcttgaactcctgacctcaaatgatctgcctgttttggcctcccaaagtgccgcaattataggcatgagccactgcgcccggcctatcttaagcatttttaaatttaatggtattaaatacattcataatcacattcggccatcgtccatctccccaactcttttcatcgttgtgaaactgaaactctgcccattaaacacagacttcccatttctccgtctccccagcccctggcaaaccatatgctgtctatgtatataattttgactactctaagtaccttatattaaatggaatcatttaatcatttaagacagtacttgtcttttgtgactggcttatttcacttagcataatatcctccaggttcattcatgttgttgcaaatgacagaatttctttcttttttgtttatccatggtccctgactctgaccctaaccctgacttctttagttatttccacatttttgctgctgtgaataattctgctatgaacatgggtgtacagatgtctatttgagtccctctttcagttcttttgagcatatacccagaagtggaaatgttgggtcatatgctaattctgtttttttgagacagagtctcactttgtctcccaggctagagtgcaatggcgtgatcttggctcactgcaacctctgcccaccccccaggctcaagtgattctctcgcctcagcctcccaagtagctgggattacagacatgtgcctccacgcccagctaatttttgtatttttagtagagatggggtttcaccatgttggccagactagtcttgaaccctgacttcaagtgatctgcctgccttggcctcccaaaatgctgggattacaggcgtgagccaccacactgggccctaattctcttttaaattttttaaggaactaccatgttttccatggtgactgtgccatttcacatttccagcaacagtgcataagtgttcagatttctccacctttgctaacactttttgtttttgagacaaggtcttgctttcacccaggctggagtgcagttgtaatgcattgcagcctcaaactcctgggttcaagcaatcctcctgcctcagactctcaaagtgttgggattgggccaagcacagtggctgtaatccctccactaatgtatgtaaggtgggaaggtatgttttgataccgtttgtatatattagtcttatgccaaagaaataattttttaaaaaatggattcttggctgggtgcagtggctcatgcctataatcctagcactttgggaggcccaggagagcagagcacttgaggtcaggagttcaagagcagcctggccagtaagatgaaaccccatctctactaaaaatacaaaaataattagccaggcctggtggcgcatgcttgtaatcccagctacttggaaggctgaggcaggagaattacttgaacccagaaggtggaggttgcagtgagcagagattgggccactgcactccaacctgggtgacagagcaagaccctatctcaaaaaaaaaaataataataataataaataaaaaatggattctttttctgtcatagaccttttttggcatgcaatttttgcaattgcaaataatgtcatttttgcaatgacctatgagtatttttgctatttatttatttatttgtaattttttttttgaaacggagtctcattctgtaccccaagctggagtgcagtggtgggatctcggctcatggcaacctcagcctctcgggctcaagggattctcgtgcctcaggctccttagtagctgggactacaggtgtgcgcaacagtgcctggttaattttttatattttagtagagacagggtttcaccatgttgcccagggtcatcctgaactcctgagctcaagcagtccgcccgcctcagccttccaaagtgctaggattacaggcgtgagccactgcccccaggcaaatgcattattttaaaaaacatgtcagttctttatagtttactattcatttcacacttaaatgcaatttatttaaaaaaattttttgttatttcacagaaaatccatcatttaggaaataaacagtagatattcttctaactgtatttcttattattcttacttagcttttgaagaaagaagataaaactgctctcatttattctgatggcttgaaagaggtaattacactagatttctaggttaatatgtgggtgaatatacctttataatatgttttccattcaaaatagacccgtattttatcaagagcaagttatttcaataccttacttttcttatctgcaaaatggtaatattaataggtacttactttataaggtcattttgagatcaaaggaaataattcatataaactgttgtacatagtacctggtacctgctaaacattcaaatgaagataaactgcgatgttgattatgatggtgctaaaatacatgtgtgtgtgcatgtgagcatataaatattcaaattcttagttcaaattaagtattgtaatccagctggattttaccataagaatttagaaatcagtgaaaaaactgattttaaagagttcctacaattaatgtgtatgtgcctttataattggatgtaattggaaatgtttttcttatcccatgttttgtgtgtgtgtgtgtgtgtgtgtgtgtgtgtgtgtgtgtgtatgtgtgtgaaataaaggcagtcctatgggaattgagttgtgatgtgagataaatgtgaatgtgtatagacatgtgaaatgtaatgattcatttttaatgttttaatttcaatattgttgcatataaattcagattattaaattattttttcttcaggtgctaagagctcatgcaaaattgactactttttatggagcatttggaccagaaaaattcaggtgtgtacatttttgttaaaactttttaggccaggcatggtgtctcacgcctgtaatcccagcactttgggaggctgaggtgggcagatcacccgagatcaggagttcgagaccagcctggccaacatggcaaaaccccatctctactaaaatacaaaaattagccaggcgtggtggcgtgcatctgtaatctcagctactagggaggctgagacaggagagtcacttgaacccgggaggcagaggttgcagtgagccgagatcgtgccactgcaccccagcctgggcgacagagcaagactcggtctcaaaaaaaaaaaaatttttttttttagattataagttacatagaaatttggaatgtcataacaggtatagcagtcctcttgctgaatttgtgtttctatgaggggtgttgagtgatagaaaatactagtttttcagcaacaaaaacgggctgaacatccttgttgtcatttcttcttttttgagacagggtctcactctgtcacccaggttcgagtgcagtggtgcgatcatagctcactgcagcctcaactttttaggcttggtaaaaatctaactattctggataaatcaagtatttggttccttatctgcaaagaagtaaactctcttaaaaccatttctaagtttcaatgttataagattatatagatttatattggttctgtagctgacattactatttaacagtaataattatgtcctgtataatacaaaacattgtttatattgcaaggcattatagaaacctttcatgtacaacagctgctccaagacacccgctaacccacagctcccaggtcattctctgtgggctcaagcagccgctccaaggcagccacaattatttttttttcctagtagtaaatttacccaggaattttttcactgcgccaccctagcagcgagaagggcagatctccatatgtgtaagtccatcttttctatcctattgagtaatagccataaaaattggatttacttatattttacttagtgaaaatgtcacctctttagaatgatctggctcttcttgtaacgccagtcgtgcccatatgatgactcttccacagttttttcagcttcagcaggaggcaaagacttcaacagaaggagacagtcttcactctataaacagggtttgaaaggaagaaaaaacagctggtatttgcaaagggcagtgtggccttacctctttcttttctatttaaagataaaaatacatcatttggaaaaacattatggttcaatgttttttatatattttttgaaacggagtctcgctctattgccaaggctggagtccagcgatgctatcttggctcactgcaacctttgcctctcagtttcaagcaattcttgtgcctcagcctcccaagtaactgggattacaggcacccgccaccacgcctggctaatttttgtatttttagtagagacggtgtttcaccatgttggccaggctggtctcgaactctgacctcaggcaatccacccacctcggcttcccaaagtgctgggattacaggtgtgagctactgcacctggccttatggtttaatgttttaataatctgaaaatccatttctgatgatagcaacaataaaataaatttaaaatataattctaagtaatgaagatttgtttaattcttagtcattgctataattatagaatcgtataaaaataatgacatttaaaaacacaataaaagagaacccacgctccattctagaattaaagggtcctaaaacatataaaactgagtctggcccaggtgcagtggctcacgcctgtaatcccaacactttgggatgccaaggatacctggtatcctccctggtgatcctcctacctcagcctcccaagtagcttgggactacagatgtgcaccaccacatctggctaatttttttaattatttttttagaaatgcagtctctctgtgttgtccacgccggtcttgaactcctgagctcaagcgatctgcctgcctcggcctcccaaagtgctgggattacaggcgtgaggtaccacgcccagtgctcatttctttaacacaaatatttttacctttgatcatagtcagattcttaccatatcttctaattgctcatttcccttcattgttaatttattctgataaatagatttaaagtaagtatacctctaattttaagtaatgatattttggtgccacatggaagtatatctgtggattcaatttctggaggtgcagttgctaaggcaaaaggttattcatccaaacttggcttccaaagcaccttttccaatagaatgagtaggggagggcccattttctcactcattcaccaacagtatgttatagaacttgtttttttgctaatctgatgtatgcaaaaaaattttttttaaatattaccacatggatttgatttccattcttaattttggttgaaatatttactttctcaaggtgaaaagccttttgtttttctccttacatccttggtccctctttctcttgagttgttttttttttttaaaaaaaaaaaaacagagctatttctgtggttttattattgttgtgtttttagagacagggtctcccatgttgcccaggctagtctcaaattcctgggctcaagtgatcctcctgcctcggcctcccaaagtgctgggattactggcatgagccaccacgcctggaccgagttgttcttttcaaaattgactttaaagttctttgtgggtatttcaaattttcctctaatttggcatttttttaattgattttgttattattattttttttttttacaaaaaattcagaagtttgtatttttatgtctgtttggaaaaatattacccaccgcaagattaaaaataaattcttggccgggcacagtggtttatacctgtaatccaagcactttgggaggctgaggtaggcggatcgcttcccaggagttcaagaccagcttgggcaacatagtgaaaccctgtctctacataaaatactaaaatttgccaggcaacttggccaggtgcttgtagtcctggctactaaggaagctgaggtgggaggatcacctgagcctgggaggtcgaggctgcagtaagctgtgattgtgccactgcactccagcctgggtgacacagtgaaactcgcctcaaaaaataaataaataaatactttctcttgtattttttcaaaaaaacagtttctttctacgtttcaatctttttttcttttttttttgagacagagtctaggagtgtggagtgcagtggcatgatctcggctcactgccacctccgcctcccagattcaagtgattctcataaacaaaacctcctgaggagctgggattacaggcgtctgccaccacacccagctaatttttgtacttttagtagagatggggtttcactgtgttggccaggctggcctcgaactcctgacctcgtaatctgcccgcgtcagcctcccaaagtgctgggattacaagcgtgagccactgcgcccggcctaaatcttttttttttttttcaatgagacagagtcttgctcttgtcgcccaggctcgagtgcggtggctcgatcttgactctggctcactgcagcgcctgcctcccaggttcaagtgattctcctgcccagtagctgggattacaggcacgtgccactgcacctggataattttttttttttctttaaatacggactctcactttgttgcccaggctggagtgcaggggcatgatctcagctcactgcaacttccgcctcctatattcaagtgattctcctgcctcagcctcccgactagctgggattacaggcatgcaacactacgtctggctaatttttgtagttttagaagagatggggtttcgtcattgggagcagactggtttcaaactcctgacctaaagtgatctgcccgccttggcctcccaaagtgctggggtacaggagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattctcctgcctcagcctcccaagtagctgggactacaggcgcccgccactacgcccggctaattttttgtatttttagtagagacggggtttcgccgttttagccgggatggtctcgatctcctgacctcgtgatccgcctgcctcggcctcccaaagtgctgggattacaggatgagaatcacacgaacctgggaggtaggtggaggttgtagtgagccaagatcccgccactgcaccccagtttgggagacaaaacaacactctatctcaaaaaaaaaaattgctaaaagagtaggttttaaatgttctcaccacaaaaaaagataagtgaggtgatagttatgttaattagcttgatttaatcattgcacaatgtaaatgtataaaatcaccacattgcacatcgaaagtatatacaatcattcttgtttttctttttatttatttttatgagacagagtctcgctctgtcgcccaggctggagtgcagtagcaggatctcggctcactgcaacctctgcctcccgggttcaagcgattctcctgcctccacatcccaagtagctaggactacaggtgcctgccaccacaccaggataattttttgtatttttagtagagacggagtttcatcgtgttagccaggatggtctcgatctcctgaccttgtgatctgcccgccctggccttccaaggtgctgggattacaggcgtgagccaccgcgcccggcccttcttttttatttttgagacagagtcttgctctgtcacccaggctggagtgcagtaagtgtaacctcagctcactgcaacctccgccttctgattcaagcgattcatctgcctcagcctcccgagtaactgggacaacaggcatccactgccatgcccagctaatatttgtatttttagtacagacagcgttttgctatgtgggccaggctggtcttaaactcctggcctcaagtaatccacccaccttggcctcccaaagtgtgggattacaaaggtgagccactgcacccggccaagtatatatgattatttatcaaccgaagaaagatatttatatgaattgtctttttaaattatcataacctaagaagtaaacttttacatgtcatcatgacactatggggtaagtactaatatccccattttacaaacaagaaaactgagacccaagaaaggttaagtaacgtgtctgaaattatgcagtccaaaagttacagagtcgattttgtttgtctgtttagagacaagatctcgctctgtcactcaggctaaaatgcagcggtgtaatcatagctcactgcagcctggaactcccgggctcaagcaattctcttgcctcagcatctcaagtagctgggactacaggcgcacaccaccacgcccacccagctcatgaaacaggtttttaaagacaaccaattttctaagtctactaaaagttctttaaaggttagagttacaaatactcaaatttcaggttctgtttcctatggacacaataccaactttgacagggactctctggttctgaaaactataaatgataacaaagagtagtttaattcatgaatattcccctcatttctttcacagattttctgttttggtttgatttttttgctccactgtctctttttaaacattacttctaaaatctttcagatgttcaaaaaagtaataatgtaaattataaatactataataataatgtactcatcacctttagctttaaaaataaagcagatgttaccaatagtttcagatcccactgttgtctttccaaatacatcatcctcttcctcccaaccagaagtatacattattcttgtatttagtactaattccattaattactttgtctcttaacttgtatacatttctaaacaatacacagaattattcttgctgggtatggtggctcacacctgtaatcccatcactttgggaggctgagaagggaggatcacttgaggtcaggagtttaagaccagcctgggcaacatagcaagaccctgtgtttacaaaatatatataaaaataaatatatatttttcggccaggcatggtggctcatgcctgtaatcccagcaccttgggaggctaaggcaggtggattacttgcggtcacgagttcgagaccagcctggccaacatggtgaaaccccgcctctacaaaaaatacaaatatatatatatatatatatatatttttttttttttaaggaagtattctgtatgtttaaaaccgttatattttttaaaacaagcacgagtagcaagcacccacttagtaaatattaattctttaaccaactacagtaaggctttctctcttattacttccccaaaaactgacttttcaaggattatcaatgacctaattgctgtatcctccagatgtctttcagcttttatacttgatcttctctgtagtagttgaaactgctgatcactccccagtacatttaaaacttactgcttccttggcttccataatcatacattcttacagtttttctcccttatttcttcccaaatatgtgtacagcccttcctcctccatccctgatatgctattgcccccacatcacatcctcagatgtcttttcactctctgcatttgctggagtcatctgagccattacactggtgtctccgacccttagaagcagtgtaggccactcctcaacttcccactagacatctctatttcaccagacccctcacatccattttttttttaattttaatttagagatgagaggctcactatgatgcccaggctggggtgcagtggctattaacaggccaatcttattgcagtatagcctcaaacacctgacctcaaggaatcttcctccctcagcctcccgagcagctaggactaccagcatgcacgactgtgctcagctcacatccaattttcataaagcagaacttttcatcttttatccctaaactgctcttccacacatattcctcatttcaggtcatgccatcgtcacccaatgtgtatgcttagccagagtaaagcaagtcaacctcaagtcccctgcccttccttccatttgatcactaagtcctgctgattccacccactatattcctctttttttttttttttccctgagacagagtcttgctgtgttgcccaggatagaatgcagtggtgtgatcttggctcactgtaacctccacctcctgggttcaagtgattctcctgcttcagcctcccgagtaggtgggactacaggcatgtgccaccacacctggctaatttttgtattgttagtacagtatttttaggtttcaccatattgcccaggctggtcttgaactcctgacctcaggttatctgcctgtctctgtctcccaaagtgctggaattaaaggagtgagccaccgcacctggcctatattcctctcttatcagccttctctctcacctatatctgtacttcattgccctggttcaggtctcctagagaaaagtacttagttccaatgtatttacccttctccaaattctttgtctttctaaaatgacaacctaatcaagatactctcctgcttaaaactgtcagcaggttcctatcacctgcaaaatcaaatctcactcctggccacaagtggtggcttaggactgtaatctcaaaactttgggaggccaaggtagacagatctcttaagcccaggagttcaagaccagcctgggtaacatggaaaaccttgtctctacaaaaaatttaaaaattagttgggcatggtggtatgcaactatagtcccagccacttgggaagctgaagcaggaggatcacttgagcctgggaggtcaaggctgcggtaagctgtgatcgccccactgtactccagcctgggtgacagaggcccctacttctgcatcatcatcatcttcttttactctgctgcccatataacctacattctagtcccacctaatcagcaggagttcctgaagcatcacaagtccccctcattctatccatgctgaccttgtacccagaatcccttcccctccctggtctgtcaggaacaccttcaagacctgacctgaggccaggtgcagtggctcacacctgtaatcccagcactttgggagaacaagacaggcagatcacgaggaggttaggagttcaaggccagcctggccaaaatggtgaaaccccatctttactaaaaatacaaaaattaaccgggcatggtgatgcatgcctataatcccagctactcggtaggctgaggcaggagaatcgcttgaacccaggaggcggaggttgcagtgagctgagattgtaccactgcactctagcctgggcaacagagtaagactccatctcaagaaaaaagaaaaaaaaaagacctgacctgaaaacgacctcctcagtaacatctttctgcccaactatgggtcactctttcctctgaatctctaatcaacttcagtcatatcttaattacagccttaatcacactaaattccaattatatattacatgtctgtcctctcagcctctagcccatgacgaaatgcttgtttggtgaacaaatgaatacatgaatgattacctcaacatctagtccaaactgaatggcaaaactctcagcttcagcaaatctgtgtttgtgaagtaaccgactcaatctgttaagttggaagagaaattttgttaaatgcttattattcagggaatttaagttattcactaaaggataaagcttaaaaaaaaatgagaagttacctgttttctggtaaagcttccgtaagacatctgagtactaacacagagactgagtcttcagacaatctagaaaaaattttaactataaatgcgcttgtcttttaatattaatacgtaaaatttaacatagctattacttaacacggtaaaacatgacctactttggatcatttttgcaaactccttctaaaaggtatatggtatcctacaataacaaaaaaacatgattaaaattccaatataagagcaatgcattttataattactagagtaactactggttcaggcatgaattatccatcaatggactttaaaacaactgggtatcccataaatacctactatgtacccacaaaaatttaaggaaaaaaaaacactgggaaaaaatggctaggaaatataaatcccatagactcaaaataatatcacataggttactttctattaagggaaaaacactttataaatggggaaatctgacagaactgccttaaccaaatgatcacatttaaaatcacccataacaggacaaatggataccatgagcctcttaacgtgatgtggttagaaaacaatattacctgtgcagtatttgtgccaaaaaaagcttaacatgaatctaatcatgatgaaacaatcaaatccaaatagagaaacagtctacaaaaccacagggtggcgactcttcaaaactgtcaatgtcttaaaagacaaaaaatggaccagatgcaatggctcacacatgtaatattaacaatttggggaggtgagccaggaagctcacttgagctcaggagcttgagtctagcccaggaaacatagtgagaccacctctctacaaaaaatgtaaaaattagccaggcctggtggtgcacacctgtagtcccagctactcaggaggctgaagcaggaggaccacttgagcccaggagttggaggctgtagtgagctatgattgagcgacggtactacaacttgggcaacagagcaagaccctgtctcgacaacaacaacaacaacaaaaacacagagacctaaatttgatgagtgattcttgattagatcataagaaaaaaaaatagctttaaagtaattggcccaattggtaaaatttaaatctagaagagtttataataaataatactgtatttgagttacattttctgagtatgataattgcattgtagaagaatgcccttatttttaggagatacctgctgaagatttaggcgtgacagcatgatgtctacaagtaatttccaaaatgtggaaaactacagtgtgtgtgtaaaaagaaattaaacaaatgtggtaaaatatttttaaaatatgtaaattagttacataaatatgtaacagcaatagtctccatctcccattatcatctatacttcctgtagagacacaagaaagaagaataagcagatgactgatgttttgactttttttttaatatgatgactaaccttagactatcaagtaagtatatttgaggatctctattaataaatatagttataaacctgaaatttatccaggtttccactaggttccactaatgcttagcttaattattaaggcttttaatcatccctgattagataccagataaagaaaaaagtagttaaaagaatactttaaaatgcaaataaacttactgtgctaattcctgtttggaccagagaagaaacactagatacttccaaagaatatagtatttccattgtaggtaatgaataaaccatgaggtttttcatctaagaaaaatagcagagcaattaatttagcagatcaatttaaacatgcaagtacaaaacagcacttcacaattaagagcagattaaaacacatgggagcggctgggcgtggtggctcatgcctataatcccagcactttgggaggctgaggcaggcggattgcctgagctcaggagttccagaccagcctgggcaacacagtgaaaccctgtctactaaaatacaaaaaattagcctggtgtggcggtgtgcatctgtaatcacagctactgggataatcacagctactggggaggctgaggcagaagaatctctggaacccaggagacggaggttgcagtgagccgagattgtgccactgcactccggcctgggcaacagagcgacactgtctcaaaaaataaaaataaataaaaaacaaaaaaccaaaaacacatgggagcactttgggaggccgaggcaggcggatcacttgaggtcaggagttggagaccagcctagccaacatggtgaaaccccgtctctactaaaaataccaaaataattagctggaacatagtggtgcacatctgtaatcccagctacttgggaggctgaggcagaattgcttgaacctgggaggaagaggttgcagtgagccgagattgcaccactacacacactcctgtctgggtgaaagagtgagactgtctctaaataaataaataaataaaacacacagtacaaagctaaatgcaaaaaataagcatttataagtaagtctgttaccgtatgacttattttattttactttttttgagatggagtttcgcttttgttgcccaggtggagtacactggtgcactctcagcttaccgcaacctctgcctcccaggttccagctattctcctgtctcagcctctcgagtaactgggattacaggtgcacgccaccaagcccggctaatttttgtatttttagtagagactgggtttcaccgtgtgtccagacagtctcaaacttggtacctacagcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccccacgtggtttttatttagccctctcaattttctttcacttaaaaaatactattctagtggctgggcccgtggtggctcatgcctgtaatcccagcactttgggaggttgaggtgggtggatcacctgaggtcaggagttcaagaccagccgttaacattatgaaaccccatctctactaaaaatacaaaaaattagcccagcgtggtggtggtggacgcctgcaattctggatatctgggaggctgagacctaagaatcacttgaacccaggaggaggaggatgcagtgagctgagatcgcaccactgcacttcagcctgggcaacaagagtgaaactccatctcaaaaaaaaaaaaaatactattacaggcattctttttaaaattttatttttatttttattgaaattaataattttttttcttttagaggcaaggtcttactctaatgcccaggccggtctcaaatttttgggctttagcaatcctcccacctcagcctgctgggattacaggtgcaagccaccaggccccaccaaaaaaaacgttatttttagagatagagtctcaatatgttgtctagattggacctgaattgcttggctcaaaagatcctcctactccagcctcctgagtagctggcactacaggcatgtgccaccacaccgagactttatttaactttttttgagatggggtctcgctgtgtctcccaggctagagagcagtggcacaatcttgtctcactggaacctccacctcccgggttcaagccattctcctacctcagcctcccaagtagctgggattaaaggaacctgccatcatgcctggctaatttttgtatttgtgtagagatggggtttcaccatgttggccaggctggtcttgaacttctgacctcaggtgatccacctgcctcggcctcccaaagtgctgggattacaggcatgagccactgtgcctggcctacttaacttttttttttttttttttttgagacggagtcttgctccatctcccaggctggattgcagtggcacgatcttggctcactgcaacctccacctcctggattcaagcaattctccttccttagcctcccaagtaactgggattacaggcgtgcgccatcacgcctggctaattttttgtaattttaatagagatggtgtttcaccatgttggtcaggctggttttgaactcctgattgcagctgatccacccgccttggtctcctgaagtgctgagattacaggcgtgagccaccgtgcccggccttaactttttattatgagaaatatatacaagcggagagaacaggacaacgaatgcccatgttccctccatccaactacaacaatcaaaaacttgtaacctctctttttctatttctactccccttccctgccagactactttgaagtaagtttgaaatgttatataatttcatctacatatattcagtatttatttgtaaaagataaggactctttctttaaacataaccaaaatatcagtatcacacctaacataagtaacagtaattccttaatgtatacaattagccagtcagtgttcacatttccacgaatgtgtccaacttttttttttttctttgagacggagtctcgctctgtcacccaggctggagtgcagtggcacaatttcagctcactgtagcctctgcctcccagattcaagtgattctcctgcctcagtctcttgagtagctgggactacaggtgcgtaccaccacatccagctaatttttgtatttttagtagagatgggattctaccatgttggccaggatggtctggatctcttgacctcgtgatccacccatcttggcctcccaaagtgctgggattacaggcgtgagccaccacacctggccgatgtctccaactttttaacatttggagttaactgagtcacagtatggacaattggttgatctatctcttcaatctctttgaatctatagctccccctttttaatttttcttgcattttatatatagaagaaactattatttgcaattttcttctctcttttttttttttttttttgagacaaggtctccctccgtcaccaaggctggagtgcaatggcgtgatcttggctcactgcaacctctgcctccccgattcaagcaatcctctcacctcagcctcccacgtagctgggcctacaggcatgcaccaccatatctagctgatttttgtgtttttaggagagaaagggtttcaccatgttggtcaggctggtctccaactcctgacctaaagtcattcacccaccttggcctcccagagggcaggggttacaggcatgagccactatgcccagactgcaattttaaagtcattttgaaatagcaagaacttccccatcagagcccgtgtctggtccgcgtgacacctgggtcactgtgtgaggcaatcctcatctctcccctcaacctttcggtcccagccttctcctgggctgtagccccttcaggcagaatcaaacaaacaaacaaatacaatgaatcacttcaacattaaatttggtcagtaattcctcctcacttccagagaaggcatgttgaaattgctgggtagagaggaactctagaactcaaaaactgacgttgaaaagtcattgtaggccgggcgcagtggatcacatctgtaatcccagcagtgtgggaggccaaggcaggtggatcacttgaggtcaggggtttgagacctgcctggctaacacagtgaaaccctgtctctactaaaaaaaaaaaaaaaaaaaaattagccaggtgtgctggcacatgcctgtactcctagtactcaggaggctgaggcaggagaattgcttgaacccgggaggtggaggctgcagtgagccgagattgcaccactgcactccagcctgggcagcagaacgagactgtctcaaaaataagtaaataaataaataaaagtaattgtaggccaggcacagtggctcacgcctgtaatcagcattttgtgatgctgaggtgggaggatcacttgagcccaggagttcaagcccaggagttcaagactagccctggcaacatagccagctcccatatctacaaaaactagccaggtgtggtgtcacgcacctgtagtcccagctattcgggaggctgaggcgggaggattgcttgagcccaggagttagaggctgcagtgagccgtgatcgtaccactgcactccagcaccttggagacagagtgagactctgtctaaaaaaaaaaaaaaaaatcactgtagtgggttaaatagtggcctcccttgaaaatctgtgttcatatcctgtcccccagaaactatgaatatgaccgtatttggagaaagggtctttgcagatctaattaagttaaagatccctagatcgatgagatgattcatgattactgtgccctaaatccaatgacaaatgtccttaggagagacacatgggagagaagtccatgtgaacacagaggcagatactggagggatgtggtcgcaagccgaggaatgctgacagccaatcagaggctggaagggaaaggacaaagtcttcactagtccccctagagaatgcacagtcctgctgacactgtgattacagacttctggcctccagcaccctgagaaacaggaagctaatacaatgagaaaatcagggtcctggctggggaaggagttttggggaaacagagccctcgaatttataccacatagacagtttttcccccaaccacctgttgggtgaacccaggcaggaatattcacttcctgccctggtcacgtataaaccaaactgctttctttataaagcatcagagtagggggcacaacagagcctaaggtccccaagctcatgccagatcagcccggcaggtgtgtcgccaagttctttcaattcaccctttctgtgcagtagtgtcacctcacagccaggagaagaaggaagctaccagaagtctggaatcacagctgggcactgtgactcacgcctgtaatcccagcactttgggaggccgaggcaggtggatcgtgaggtcaggaattggagacaagcctggccaacatggtgaaaccccgtctctactaaaaatacaacaattagccaggcatggtggcgggtgcctgtagtcccagctactcgggaggctgagccaggagaactgcttgaacccgggaagtggaggttgcagtgagcagagaccgcaccactgcactccagcctgggtgacagagtgagagtctgtctcaaaacaaaacaaaaaaaatgaaacaaaacaaaaaaagagtctgtaatcatttcttgggtggttcatttatttatctgacacatacttatcgagtagccctttggtgccaggcattgggctacgtactggagaaacacatgtaaatcattacaatgctgcatggtaagtgtgaggatggccgaaatggcccagagaagcgggcttgacccagactaaagaaagagaatcacagaaggcttcagagctgtggggaagtgaggtctaccaaacttctgatatggtagccacaaaccatctgtggcttttacattttatttatttatttattttattttattaaaaaaagttttttgagacaaggtctttctgtgtcacccaggttggagtgtagtggcgcaattacggctcactgcagcctcggcctctcaggctcaagtgatcctcccagctcagccttccaagtagctgggactacaggtgtgtgccaccacacccagctaaattttcctagttgttatagagatggggtctcactttgttgcccaagctggtgcattttaagttaaccaaaattaaattatagtgtgtgtgtgtgtgtgtgtgtgtgtgtgtgtattttttgtttgtttttttgtttgttttgagatggagtttcactcttgttgcccaggctggagtgcaatggcgctatctcggctcactgcaacctctgcctcctggcttcaagtgattctcctgcctccgcctcccgagtagctgggattacaggtgcctgccaccacacccggctaatttttatatttttagtagagatggggtttcactatgtcggccaggctggtgtcgaactcccgacctcaggtgatctgcctgttttggcctcccaaagtgctaggattacagagatgagccactgcgtcaggctggaactgagtttttaatattacttaattttaggccaggcctggtggctcacgcctgtaatcccagcactttgggaggccaaggctgacggatcacctgaggtcgggaatttgagaccagcctgcccaacatggagaaaccctgtctctaccaaacatacagaattagccgggtgatgaaatactggtttctttgtatcngaatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatgtgggaaaaaacccctatgcatctgagtgacagaagcgttctgtgttgagtgtgtagtggtagaaaacagtttgtttttcccctatgcaaacccaaatgttattcaatggatgaatggataaactaaatgcagtctatccacacaatggaacattactctcccataaaaaggaacgaagttctgatccctgctacaatatggatgaacctcgaaaatgttaagtgaaacaaccctgacacaaaggccatatattgtacggttccatttataggaaatgcctagaataggcaaatccaaagacacagaaagcagaaaaggggttgcttagggagaattggggtgggggattgggggacaacagctgaagggtttcttttagaggtgatgaaactgtcctaaaattgtgataatggttatatgtatctgtgaatatactaaaaactattgaattgctaactttatttattcacttagagacagtctcattctataacccaggctggagtacagtggcaagatcatgactcactgcagccttgacctcccgggtttaagcaatcctctggcctcagcctcacaagtagctgagactgtaagtgcatcccacaggccgagggcagtggcccacccctgtaatcccagcactttgggaggccgaggcgggcagatcatgaggtcaggagatcgagaccatcctggctaacacggtgaaaccccgtctctactaaaaatacaaaaaaattagccgggcatggtagcgggcgcctgtagtcccagctacttgggaggctgaggcaggagaatggcgtgaacctgggaggcagagcttgcagtgagccgagatcacaccactgcactccagcctgggcgagagcgagactctgcctcagggaaaaaaaaaaaaaaaaaaaaagtgctgggattacaggcataaaccaccttgcctggcttgaattgcagactttaagtgagtgaattgtatgatatgttatctgtatctcaggaaagctgtttttttttgttgttgttgtttctgttcttgtttttaagacttagaaagaaaaagcagttcaggccgggtgcggaggctctcacctgtaatcccagcattttgggaggtcgaggcaggaggatcacctgaggtcaggagttcaagaccattctggccaacacagcaaaaccctgtccctactaaaaatacaaaaattagccgggcgtggtggcaggtgcctgtagtcccagctactcgggaggctgaggctggagaattgcttgaacccaggaggcggaggttgcagtgagctgaaatcatgccattgcactccagtctgggtgacagagtgagactcttgtctcaaaaaaaaaaaaaaacaaaaaaaacttagctgggcatggtggtgggagcctgtagtcccagctaatcgggaggctaaggtgggaaagtcacttgaatccaggaggcggaggttgcagcgagctgagatcacaccattgcactctgcctgagcaacagagcaatactccgcctcaaaaaaaaaaaaaaaaaaaaaaaaaaaaaaaaaaaaaagaactccatgccatcaggagggaccttatcatggggttcatcttgcatcccccaaccccaaaacagttcctggcacatagcagactcttaagtagtcatgaaattaatgaatttcagctacgcgttttcagggtaaaatctcttccttggatgcttcatgagcacatgaacaaatggcagtgcctcattatacataagaaaaatggggaaagttagcaaccgctaaatacatgaagacgctctatttaatcctcaagactcaagggcctccttccaccatctcttgcttggaatgaagcagccaaattctttttctctattcggagtagagaatgaattagtggggtgttctcattccactttgtggtgatggaaaacctggctcagtgagacagaagatattcaagcttctttctgctgtttctccttgggcccagagatttggaatacattatctgtgcttaaataaacacattggatccctcccttgggtagtttttaagttatttttgagtaagagaataagactgaataattttgttgattgtttctatccagatgggggtagccacataagtataaagacgtgcttagggtaatagtttctttttcatgcaatgctggtgtcccaggaagaagagaccagtgaccccaaggtttttttgcatgctcctcagtggaaacttttgagcacatactcccaatatctttcaacatatattattttagtagaaatatatatatttttttgagacagagttttgctctttcgcccaggctggagtgaagtggcatgatctcagctcactgcaacctgtgacccccgggttcaaacaattctcctgcctcagcctccctagtagctgggattataggcgtgcgccagcacacccggctagttttggtatttttagtagagacagtgtttcaccatgttggccaggctggtctcgaactcccgacctgaggtgatccacccgcctcggcctcccaaagtgctgggattacaggtgtgagccaccgcgcccggccaatattccagtgagctagtcaataaacaagtaaataaagataaccctggatggcagcaggaagacagtgaatagagtgacgtcacagcaagggactggggatgtgggatggtgactagctgggctggtcgggtaaggctagagagaaggctggtctgagatatggcaggagtggcaggggttgaggctggaaaggcagactgggcctagatcttaccgaccttataagccacggtatggacaggcaggcagcaccgagccataaacgaaatccagcttttaaatccagcgcttttaaaaaactttgaccttacccaagggggtgtctttttatgttagatctgcccaaaggaggggctttttataatccattttcctggagatgacccctgcttctaattcgaacagaagggaagtgttttctgcaacttgggttttatgcttagtgaaatgagaagccagtgaaaagtttgaggccagccacggacaagatccggcttatgttttaagaatatacttaggcaacagtatggaaaataactgtatggagacaagggtagaataataaaaataatgatggcaatcacagctaatagaaatataataaatagaacaatgacaagaaggaaccttgctgttttttctgttcttttttcttttttagagacagggtctcgctctgccgcccaggctggagtgcagtggtgcgatcatagctcactatagcctcaacctcctaggctcaagcaaccctcccacctcagcctcccgaagctctgggattatagacatgagccaccactcccggcccccatcctggctccaatcctggctaactgtatatttaatcttactttaaaacaaattcaggctgggcacaggtggctcacacctgtaatcccagcactttgggagggcaaggcaggtggattacttgaggtcaggagttcaagaccagcctggccaacatggtgaaaccttgtctctactaaaaaaaattacaaaattagctgggcatggtggccggctcctgtaatcccagctactcgggaggctgaggcaggagaatcatttgaacctaggagggagaggttgcagtgagctgatatcgcgccactgtactccatcctgggcgacagagtgagactccgtctctaaataaataaatataacaaattcaaataacagttatgatccaaaaaaagtgacttctccaacatgttgaaagctaaccctttatgtatcagaactttattctgaacaagaaaccaatgtgggcattggaaacactccttcttagcttagctccagagtcaaagaagcgtgacagtccatcacatctgttaagttctagtgccaccacctgacctcttctgggccttgcacgcttacgcccaagaggacaattccagactccatctgcgactgcagccttctaactggttctcttaaggttcaatcacacaaataaagaaacaccaatgtgaacagtgagatgccgttttaacctatcagatgagcaacatggtttgaggacatagtaaagtggacgtgcatccgctgctggtgggaatggggatttgtgaggaagaccttttgaaatgcatgcagtgtggcaatttgcaactggaggctttaaaatgttcccttcattcccttggatctggcaaatctgttcctgggaatgtatcttaagggaataattccaaatatggaaaaagcttagtgaaaatatattagcacagtctaagtgtgcagaatagctccagggggtgacctaagagttttgaggatttgctgtgggctgaggattgcctacatctatcatctcatctgatcctcacagaaaccactgaagcgggtatattatccccattttatggataagaaaagggactcagggagattacaaaattcagtccgactcataaacctatacacagaagcagaattagaacctgagcttgcatggcttttcattaaaaataaaaaatcattaaaaataaaaacactattactaaaaataatattttaaaaagtttatagtggcagagaaaagaatacaaagtaaaaaattgtacctgcagtaggctcatgattttataaaaccatgtgatgcagagaaataagaaacaaaatgcaacctgccagaggaactgatcacaccctaagtgtttgtgttttccatacatatctttttttctttggcacagggtctctgttgccccggatggagtgtggtggcatgatcacagctcattaaagccttgacctcctgggcttaagcgatcctcccacctcagcctcccaagtagctgggactacaggtgcacaacaccatgctcggctaatttttttttttttttttttgagacggagtcttgctctgtcgcttctgtcgcccaggctggagtgagtggcggattcggctcatgcaactctgctctctcagctccgagtactgggattacagcgccacacatggctgttaccaggatgttcaatctctgacttggaacctctccttggttccaaggctgggttaaggggtaccccgggtttcaaacccccctttttaaactcgggggggattttttaaccgggggaaaatttttggggaccaaaaggccctttttttttttggtggggccaaaggggttttttttcaaaaaaaaaaaaaaaattttttttaaaaggggggccctttttttgaaaggggggttcttttttgggggaaaaattttttttttttcccccaaaggggggggtttttttcggccccccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagataagttcatcactctaggctcccaaacgtgctagggattacaggcgtgacacacgtgccttcgccacgcccagctaatttaaagctgaggcaggagaattgcttgaacccgggaggcagaggttgcggtgagccgagaacgcgccactgcacttcacgctgagcgacagagcaagacttcatctcaaaaaaaacaaaacaaaacaatttgtagagacagggtctcgccatgtttgccaggctggtctccaattcctagggctcaagcagtcctcctgcctcagcctcccaaagcgctggaattacagacgtgagccaccacatctggcccattttaaaacttctgtttaaaagtacgtcatgaacataagttttgttcctaccacataaagtatttttacaaatagttttttgtttgtttgtttgtttgttttgagacggagtcttggtctgtcgcccaggctggatggagtgcagtggcgtgatcttggctcactgcaagctctgcctctcgggttcatgccattctcctgcctcagcctcccgagtagctgagactataggcgcctgccaccacacccggctaatttctttttttttcgtagggacggggtttcaccgtgttagccaggatggactcaatctcctgacttagcgatccacccaccttggcctcccaaagtgctgggattacaggcgtgaggcactgcgcccagtcagctattttcttttagttggtctcaaagttgttatcacaaagctgctttctcattttctcttaatttgataaaggtgcaattcataacacaaggttattatcccctaaaggaaatggaacaactagcatcatggacaaatctctgctgattaatgagtagattaatgagtaaccaacatccagagctgctcaaaacagccctttacacttaaatctcaaaaagaaggaatgatgggcgataagcaccaaaaaaaagtagaaataaatgcatgtaatttttcctgggcaatttaaatagttcttcatctgggagtgcctccaatccttctagccaattcatcctacccgcagctgtcaagttcatcttcctaaaaacatcaagttcactctgttatttccctgcctaaaaataccacctgtttatggtgtcaaggtgccaacgtgcttttctccctcctctcaccctgccccacagttccagctttgcgccttttcttgctcttctcccttttagagtgttccaaccacatcctccagggaaaatccctcgaccaagagtccaatctgattttgcacttccctgacttcttgctaagccgtctacaccaggagggtaagccagtttcttctgacacacaattccaatcgattggtagagatttgtggttgcctgggggcactgcgtgtttaaagaacactggaattaacaacgacccaggaagggtagcaatgggctcaagaagggaaagtggatgtacaactatgggtcatcctggtctctactgcactggccaatacggtggccactagccacatatggccattagatacttgaaatgtcgctagcccaaattgagttatgctgtttatttattgagacagggtctcactctatcactcgggctggagtgcagtggcatgatcacagctcactgcagcctcgacctcctagggtcaagtgatcctcctgcctcagcctcccaagttgcagggaccataggcatgcaggaccacacccagctaatttttgtattttttgttgagacggggtctcaccacattgcccaggctgattttgaactcctggattcaggcgatccttccaccttggcctcccaaagtgctgggattacaggcatgaaccaccacacctggcctgatatgttgtaaatttaaatcactcaccagagtttgaagactaagtgtgaaaaaaaggtgtaaaatatctaataatattttcatattgattacacgtcaacatattttggatatgctactggggcaagtaaaatatattattaaaattatcctggataaaggaccagaggcagacaatatatatatttttttcatctttttttgttttttacaatatgtgcattaacagtggcagtttcaacagggttcagtgcctaaaggagtgtcacaagacccaaaatgacaatgcttacaaacctcgtttattacaagaaaaggattcaatacagcaatggcattaaattaagaatatgtgtcccggccaaccggtatttcagagcaaaggctctggagaactaggcgcagtctcccacaatcctcccttttgtaagggctgtggctggacacactatccccacccagagcaagaaccagtgatgtgtgtatacagcatcttggaatcagggtccaacatagcatctcaggtgtttctcatactttgcttgtcacataggcatattcctgccacaactagcctcaatagcaggacgttcttagtggagttggtctcaccaagaccaggagcaaataatcaatttaattgttataaataatggtgacaggctgatacaaaccacccccaagctcttcaaacccctggctacaaggcagcactataatccctatgtttccttaatcactgtgtttcatgccttgaccaggacagtgccttgcaaaaactttagcaaaacagatcagattaattccagcaggcctggaattaacccttaaagcataatgtgtctactagaaaatttaaagcatcaaatgtacttgcatgatatttctactggacagtgcttctgtagaccaaggggaagcaacttttctttatctgtcaagagccagataaagaaatactttagctttgccagccgtatggtctctgcatagtccattctcacactgctataaagacccacctgagactggaaaatttatgaagaaaaaaggtttaatggactcacagttccgcaggcttaacaggaagcatgactgggagacttcaggaaacttacaatcatggcagaaggcaaaggggaagcaaacaccttcctcacatggtggagcaggagagggagagcagcaagagtatacacttttaagcaaaaagatctggtgaaaactcactattgtgagatcagcaagggataaactgcccccatgatccaatcatctcccaccaggtccctctcccagcactggggattacaattcaacatgagatttgggtggggacatatagccaaaccatatcagtccctactgaaactactcaaccctgtcactgatgggtgaagcagccccagataatatgtaaacaaacaagcctggcttcatcctaacaaaattttattcatgaacactgacatctgaattttaactaatgccacaattcttttactattgtttggattttttttaaaaccctttaagaaggtaaaaattatgatttggtcaccatgggccattatttgctgacccctagtctagacccttgttactttaagtgtgatcagtgaacaagcagggttggtatcacctgatgcttgttagaaatgcagaatctggctgggcacaggcctctaggcccagctacctgggaggcctgtgaatggccactgcactccagcctgggcaacatagccagatcctgttaaaaaaataaaagaattgcagaatttggaccccaacccagatctgtgaatccaaatctgaaatttaaggaagttccccaggtgatttgtataaaacacctgggaagtttgaaaaaattactaaaacctaactccaagaccccagagtcttatataactggtatgggtgtgacctgggcactgggattttaaaaatatccccaggtgggccgggcatggtggcttacacctgtactcccagcactttgggaggccgaggtgggtggatcacctgaggtcaagaatccgagaccagcctgaccaacatggtgatgaaactccgtctttactaaaaatacaaaaattacctgggcatggtggtgagtgcctgtaatcaccactacctaggaagctgaggcaggagaatcactttaacccaggaggcagaggttgcagttagccaagatcacgccattgcactctagcctgggcaaaaagagtgaaactctgtcttaaaaaaaaaaaatccccacatcatctgaatatgcagcatagattccaatagacagcaaagtttgtcgattagacaaagaccagggacttggcatttactcctatgtaaatttttattcttcttattgcaattgcaaagactgcgtgttctactagtattctccaaagaacctagaatagtgctatgtgcctagtcgggacccagggtccttcggaatggcctgacaatcaactgtttttttttttttttttttttttttgagatagtcttgctgttgcccaggccacctgggttcaagcaattctcctgcctcagcctcctgagtagctgggattacaggcggctgccaccacgcccggctaatttttgtatttttagcacagacagggtttcattatgttggccaggctggtcttgaactcctgacctcaagtgatccacccgccttggcctcccaaagtgctgggattacaggcgtgagccaccgtgcccggccttcagttgatttctaatagattcactacttaacaaaactaggcacttaaactgtattcttgtagactggtaattttacaggggacttgtagccattgtttcaaaacaaactccgaaatatgcaaaaatacagaggaatgtgactncagtagcttaaaaaacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccacgggttttagccaccgcacctggcctatttggtgtctttaatactctcataaaaagcccaggagcggtagctcacgcctgtaatcccaacactatgggaggccgaggcaggcagatcacctgaggtcgggagctcaagaccaaccagcctgaccaacatggagaaaccccatctctactaaaaatacaaaaaaaaaattagccaagcgtggtagtgcatgcctgtaatcccagctactcaggaggctgaggcaggaaaatcacttgaacccagaaggcggaggttgtggtgagccgagatcgcgccattgcactccagcctgggcggcaagagcgaaactccatgtcaaaaagaataaatactctcataaataactgaacaccttattaacatcatatctaacaaaagaaatgtagtggaaaaacctagctctattagcctcctagaatataaattcctcattaagctttccatattgccccagaaatgaaagagaaaaaagactcttcgaagagtgtacttaccattatttccttgtttaagagatttacctctcttattccatagcctcgtaaaagttttttcatctccattagtttgtaactttcctgtaataacttgactctgaaagcaaatttacccatattaacatggattgtcttttttatgaagtactatgggacacagcaaacaatatagaaacataaatgaacgtcaactcaaaacacaatgtttctccagagcataacaacattgtttcgtagacagtcatcttacttgggatggtccatttccaggtgctgtttcaccagttgctccacagctgcactccaaggaaccactgccgcatacatgatcttgagcacggcatcaaatatgagctacaaaagatgcacgcatggacaaggaacagccctcaggtttacgatgcatgcaagtgaacagcacagtctaatcagcaggtcttacatcaaccacatggtagtttgagaatatttcatccactcactggaaaaccatttatttcttcagttttcacatatagagaacaatttgactattcagaaaaattcagaagagtattttttctgctgtaagctaagacatacagcgttattgctttctacggtctctacaatccctgggttttttttgtttttttgaggcagggtcatgttcccattgcccaggctggagtgcaatggcgcgatctcagctcactgcaacctccacctcctgggttcaagcgattctcccacctcaggctcccaagtagcttggactacaggcaagcaccaccacacctggctaatttttgtattttctgtagagatgcggttccaccatgttgcccaggcaggtctcaaattcctgagctcaggtgatctgtctgccttggcttccaaaagtgctgggattacaggcatgagccactgtgtccagcctcagtctctggtttaaaaacagttttcattattttatttctattttatagtggcaataacagcgtgaagttaacataaaggcatattacaatatattaacagatgtctcacattgcagcgaataactgagaaagaaaagtctacatgttacgcataaccacagaaaagcctgcacagatatgcatacaactgtccatggacgatcccctgggggtggaaatgagtaaccactccctctctatttcctgtattaaagaaaacagacactttatgagtacgaagccggcagatcacttgagcccaggtgttcaagaccagcctgggaaacccctgtctctacaaaaaatacaaaaattagctgggcgtagtggcacacgcctatggtcctaactactcaggaggctgaggtggggattgcttgagccagggagattgaggctgcagtgaaccatgatcatgtcactgcattccagcctgggcgacacagccagacccatctcaaacaaaaacaaatatatgtcgcttttatgaacagaaaaaagctttcagaaaagatttaatgctcaaaagggaaacgcaaatggtcactatttacttacgtccgtgtcagataaacacgctattactgccatggcctttgcttcccatgctgtttcaaagagtgatgtggactttgagctgcatctattcagtaaatcctaaaaagggataaacatgtatgttttttaaaaattaaaaattctcattaaaaaaatgccacatacagctagatacagatattatatggccttgatagatgtgttaaaagaaaaaaaacctaaaaattctaattagtcataaatgttgaacaatggtctaaaaatacaaaactgccaaaacattagcctttagttttatatggtatagaaaatttaagaatgaaacattcttgaagaatctacaaataagattactgtagcacattaataacatccacaagaaataactgctaatatttattgagttcatgctcctgtggtctcacaatagccctttgaagaaagtactgtgaaagggaaatatcttgggcccccaagatcactaaggaaaactcaggctggaaattgcttagggcaaacttgcctcccattctatcaaagttacccctctgctcactgagacagctgcattatctgattgcctcctttggaaaggctaatcagaaactcaaaagaattttaatgttttgtatcacctatctgtgacctggaagctccctctcgcttggagtcttcctgcctttgcttcaagttgtcccacctttccagatcgaaccaatgtacttcttacatatgctgactgatgcctcgtgtctctccctaaaatatataaaaccaagctgtgcccggaccaccttgggtacatgtcgtcaggacttcctgaggctgtgtcatgggtgtatcctcaactttggcaaaataaactccctaaattaactgagaactgtctcagattttccgggttcacagtcctcatgtatcccccctttgctcaagatggttagtagcagaattaacccacatttttaaccaattcaatatgctgcatgagtcctactgagaaagcatatgacattccttaaagagttaaatatttactacagtgctacactgcatagatccaagaaataagactagatgtaaaggaaaagttacctctatgtacagcaagagaagttcctcctcttgcaagtcatgttctctcatgtaaactcttataaacttctctaagatggagggaataagctctggggccagcactttatcaaacattcggaacactatggtggttgtattttcctggatgccaaaagaaagatggaataaatacagactctacccataacttgatatacaaaataattcttatgaccctggactttaccttctcaaaatcagagagggctaatttgcagttgtacttcctatgcaacgtgatcaactctcgcaagttatttaccaaagtccttagctgacatacttcctctgtgttctgataatctttctaaaacaaaagtgttaaagttgttaacgatataaaataaaagtatgagagaaaaatagaatcagaattatttcagataaaataagaattaaccctggttatgcacgtaagaggaaacctgcaactttaaaccaacttatgctctaaattttgtagtattttaaccaaattagtatagatcagaatctgaaagatattttctcttaaaaaaatagaaaaattaagaatattagtataatactttttcagaacccaagtatacttagtacacagcatcatttaggtagtgctcagtgtcccatctatctatagagattatatatcataaccagatataaaggcataacatttcctaaaattatataaaaagaacagaaccttcaatattgataaaagttaacagggaaaagataaaaataatgttttacagcaagaggaaaaagctcttatatagaaaaggtgacttgacagacacaacctttgaaaactaatattaatgtactgtcaagacttaatttttccttttttctttttttttgggggggacagagtcatgctctgtcacccaggcaggagtgcagtggcacaatctcggctcactgcaacctctgcctccccgtttcaagcgattctcctgccgcaggctctcaaatagctaggactacaggcacccaccaccatgcctggctaattttttttgtatttttactagggatggggtttcaccatgttaatcaggctgatttcaatctcttgacctcaaatgatctgcccatctcggcctcccaaagtgctgggattacaggcgtaagccatcgtgcccagccaagatttaatttttcaaaggattgtgaaatgctaataatgcagaaatgataactaatcagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatattgtgcccgggccccccaaagaatggccctgtcttttctaatgaaaactagtatagctatctcatgcggtctggacctctcaggcatcacccgtcaccccgcaagccttccaagcctgtggtaaccatcttcctactctctatgtccgtgagataaagtgttttgattttctgatcccacaaattagtgagcacttggcctggtagtctttccagggctggcgtttttcacttacgatgatgatgagccgggccatctgtgtggtcgcggattacagagtttccattgagctgagatttgtgccatgacattacagtcctgggcgatacagcaattagtttgtctcaaataagagaaaaactggaagttaattgtgccaggtgtggtggatacatgctactcaggaggctgaggcggggagtacgaggctgcaggaagccatgattgcgccactgcactccagcctgggctacgaagaccctctctcccctccaaccaaaaaaagatgaaaaagctcatttctttcgcttttgctgtagcaacatgttgtgtcatcatttctgtccagcgagggatacacagggatgtgaaagggccactgtcagtctagggattcttcttcccattggataaaactaacaccttgggtttgctttttcagaacctcgaagtctgtatcagttagggtgtttttggctacaagtaatggaaaacccagctagaaatggctttaagcaaagacatcatttatcgtcttgcttaatcagaggtccagagttccctgaacaggccaatgacatggccgagctccgtctaccatctcatcccccatcctctacatgctgatttgctctttgcttgtctcctcacaatgcaaaaaggctgagccactccaaaccttctggccttgcaagaattttcaaatatcctttttttttcaaatgaggtgaaattcacataacataaaactaaactttttattttttaaaaaaaattcatctccagccacgtccttttgaaaaactaatcattttaaagtgaacaattctgaccgggcgtggtggctcacatctgtaatcccagcactttgggaggccaaggcgggcaagtcatttgaggtcaggagtttgagtctagcctggccaacatggtaaaactctgtttctactaaaaaaaaaaatacaaaaaaattagccgggcatggtgtcgggtgcctgtaatcccagctactcgggaggttgaggcaggagaatcacttgaaccggggaggtggaggttgcagtgagccaagatcacgccatttcactccagcctgggcaaaagagcaatagtctgtcccaaaaaaaataataaaaataaaataaagtgaaaaattctgtggcatttagtaccttcaccatgttgtgcagccaccacctgtatctagttccaaaacattttcttcacacccaaaggaaaccccatacccatcaaaaacaatcctccccattccccgactctcagctcatctgatttctaagtatttgcttattccggacatttcatataaatggagtcacaccatgcggggccttttgcacctggcttttttcacttgacatcatgttttcaaagttcctccatgggacagcttgtgtcagtgctttattccatttcatgaccaaataataatacattctgtcgtacacagacaccatattttgttcattcatcagttgatgggctgttgggttgcttccacctttttgctctggtgaatattgctgctatgtacaggcctgtgcaagtatttgagtaacctgttttcaactcttttgggcatgtgactaaaagtgggattgctgggtcatatgataattctatgtttaattttttgaggaactgccaaaccaaaaggtccttttcaaaagtgaagaaaatcttctgaaaagcatccccggaagacttcctcgacaccttactggccagaatgatgtcacttctccatgcctacagcgtggtcttggcaaggagagtgatattaccaagactggcttaaactgatcaagactcagtttctgtactggattggcacccagtcacctctgaatgacactgtcgcttggaggagggtcatttctagaaggtggtgacacagctaggtgagttctctgtcgaccaccccctcccccaacattattagagcaatttgtgtttcattcaagggcgtaatctagtctgttccagcagccaggcagccttccctttaggggttgtgtagctgtctttgttcattggtgtgtttattctgcaaacatctgtcttaataaagaagtgtgggaacaagagtcatgaccaacagcaagaggataaaggctgtgtgaagtggaagctcaagaaatatcggaggaggtgtctggcacaatggtgcatgcctataataccagcactttgggaggctgaggcaggaggatcacttggatcaggaggtcaggagttggagaccagcctgggcaacatggtgagacctcatctctataaaaaataaaaaattagatgagtttggtggtacgcaccagtagtcccagcttcttggaaggctgagttggagagattgtctgagcctgggaggtcaaggctgcagtgagccatgatcacaccactgcctcccagcctgggtgacagagtgagaccttgtctctaaaaaataaataaatataaaaaaagagaaatatcagaagaaggatcctgaatggtatggggtgtgctttaccttgtaacgcccttgcagagatgctgggagtgtatttcaagacccccatttgtggctgggtatggtggctcgtgcctgtaatcccagcactttgggaggccaaggcatgcagatcacctgaggtcaggagtttgagaccagcctggctaacatggtgaaacggcaaaccccgtctctactataaaaataataataatacaaaattagctgggcctggtggtgcactcctgctacttgggtggctgaggcaggagaatcgcttgaacttgggaggcagaggttgcagtgagctgagatcaggccactgcactccaccctgggaagcagagtgagactctgtcacaaaaaaataaaaataaaataaataaaataaagctgggcacggtggctcacgcctgtaatcccagcactttgggaggccgaggtgggtggatcacctgaggtcaggagtttgagaccagcctggctaacatggtgaaaccccgtctctactaaaatacaaaaaagtagccaggcatggtggcaggcacctgtaatcccagctactcgggaggctgaggcaggagaaccacttgaacccagaaggcagaggtttcagtgagctgagatcgtgcctcacactccagcctggtcaacaagagcgaaactccgtctcaaaaaaaaaaagaaagtctcaaataagagttttcttttctccttgctacttgccagttctgtgaacttgcatctgtaagatggaaataatattatctgctctaatatgtaataaacaggtgagaacaatttatatcctttgcaatccataaactactattcatattaaaattttaaggtaaattcttacctatttaaaaaaaattggccagatgtggtggctcacacctgcaatcccagcactttgggtggctgaggtaggcagatcacttaaggccaggagttcgagaccagcctggccaacatggcaaaaccccatctctactaaaaatacaaaaattagccgggtctggtggtgcacacctgtaatcccagctacttgggaagctgaggcaggagaatcacttgaacccgggaggcagaggtttcagtgagccgagatagcgccactctactccagcttgggtgacagagtgagattctatctcaaaaaaaaaaaaattgcagcagtttaatgacacagcagccacctatctttaggacatagcttatgggaataagtacacaaggacatagaacagcctcacactactgagtccatcaactgcagagttcgtgcatttatattctataaaaagctcaagcctttaaacagtgtctattttcttttgttatgagacatttcatttattcttttttttttttttttttgagatggagtttcactcttgttgcccaggctggagtgcaatggtgcaatctcggctcaccgcaacctctgcctcccgggttcaagcgattctcctgcctcagactcctgagtagctgggattacaggcacacgccaccatgcctggctaattttgttgttgtttttttttttttttttgagacggagtgttgctctgtcgcccaggctggagtgcagtggtgcgatctcggctcactgcaagctccgcctcccaggttcacgccattctcctgcctcagcctcccgagtagctgggactacaggtgcccaccaccacgcctggctaattttttgtatttttagtagagacggggttcaccatgtttgcccggatggaaattttgtatttttagtggagatggggtttctccatgttggtcaggctggtcttgaactcctgacctcaggtgatttgcccacctggccctcccaagtgctgggattataggcctgagccaccgcgcccagcccatttattattttgataaatatgtactgagttcaaaaaaataaaaggaaaactgacagctatttgtgacaagaaagtatttaagggaaatacttattatcttcacatcgccttctctgggtgtcagactgggaagcgtcactgaggtccttcaaggagcaagcgaggccaggcacagattccagggacaccgctaaagcacagtgagaactcatttgtttttatcttaatgtttataggaaaaataatgtttgagggtaaatgattgttatcggcccacaaagggcaaagaaagggcaggctgtacaaatctaaccgcagttcctcctgtcagtctttctcagcattgccagaagagaaatctgtggcgcaaatacggtgtcatgtgaccatttggcttcagttgactggaccagctactgtcatccatgcctggaaagtcatccacaggctggccagaagcccatgaagtgacctggtacaaaagctttgctcaaaaggacatgctctagctgaatgtagtttcctatagctactgaaacagatcaccacacacttagtggcttaaaaccgcagagctggccaggctcgggggctcacacctgtaatcccagtactctcggaggccgaggtgggcagatcacctgaggacaggagtttgagaccagcctggccaacgtggtgaagccccgtctctactaaaaatatgaaaaattagccgcgtgtggtggtgagctgcctgtaatcccagatattcgggaggctgaggcaggagaatcacttgaacccgagtaggcagaaattcgcagtgagctgagattgagccctgccgtgccagctgaaaacagagcgaaactcctgtcaattaacnncccaaagaaacacagcatcagcaggacgaagagcgatcacgtacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcttagtagttaaccacaaagtactctgattcatgtgtgagccaccgaacctggcctgtggaattaaaatttgggtgcggtggctcgtggctacaatctcagaactttgggaggccgaggtgggcagatcactcgaggtcaggcattccagaccagctggccaacattacaaaaccccgtctctattacaaatacaaaaattagcccggcgtggtggcacatgcctataatcccagctactttgggaggctgaggcatgagaatcccttgaacctgggaggttgcagtaagccaagatcatgccactgcactccagcctaggcgacagagtgagactctgtcacaaaaaaaaaaaaaaaaaaaaaaaaaaaaaaaaaaattccatggggccaagtatagtggggaggctaaggtgggaggactgcttgaacctaggagtttgaaaccaacctgggcaacatagcaagaccccatctctacaaaaataaaaataaaaaataacttggagggctgaggtgggaggattgcttgagcttgggaatttgaggctgcagtgagttttgatcataccactacactccagcctgagcaacagagtgagaccctgtctcaaataaataaataaataaaaattaaaaatcagctgggtgtggtcatacatacctgttttcccatactcaggaggccgacataggaggatggcttgagccaggagtttgaggctacagtgagccatgattacaccattgcactccaaactgggcaacagagagagaccctgtctcgaaataaaaccaaataaataaaataaaataaaataaaatcaagctgcatgggaggaagggtgttggcgaggatatcgggaaactggaacctcgtgcattgctggcaggaatatacaatgatgcagccactgtggaaaatagtttggcagcttctcagtaagctaaacacagaatcgccatgttacccggcaattctactcctaggaaaatattcaaaagattgaaaacaagtgttcaaacaaaaatttgaatacatatattcacagaagtactattctcaatagccagaaagtaacccaaccccaaatgtccatcaaccgatgaatggataaacaaaaggcagtctatccacacaaaggaatactattcagacatgaaaaggaatgcagtactgaagacaaggaatgctgcatcatggatgaatcttgaaacattatgctgactgaaagacacgagccaggtgcagtggctcatgcctgcaatcccaacactttgggaggctgaggcaggtggatcgcttgagcccagtagtttgagaccagtctgggctacatagcgagaccccatctctataaaaaaaaaaaacgaaacttagccgggcgtggcgacgcatgcctgtagtcccagcttctcaggaggctaaggtgggaggatcacttgagcctggggaggtcgaggcttcgctgagctatgctgacgccactgcactgaaaaaaagagagagagacagagagagagagacaaagaaagaaaagaaaagaaaagaaaagagaaaagaaaaagagaaaagagaagaaaagaggaaagaaggaagggagtgagggaatgagggaaggaaggaaggaaggaacgaaaggccacattttatatgactctatttacatgaaatgtccagaataggcaaaatctgtagacagtaaccttagtggttactagggactggcggggaggggagaatgggaagtgacagcttaatggtttctgtttagagtgaagacaacgctctagaacgggaaagtggagtgagaattgcaccaaattataaatgtacttaacaccactttaaaatggtgacttttatgttatatatatatatatgtcttttcacaataaaaaaattcatggtgggaaatctaaggaaaaaaatctaaaaaggcaaagtggggaggggcaataatgagaaagaaaggtcgagaaacactgagctaaagaccagtctgtaatctctctcttttttttttttgagacaaggtctcgttctgtcaccccagctgcagtgtggtggcgtgatcacagctcactgcagcctcgatggcctgagctcaagtgatcctcccacctcagcctcctgagaagctgggaccacaggcatgtaccaccatgcccagctaatttttaattatttatagtgttgaagtctcatgttgcccacccaggctggtcttgaactcctgggctcaagcaatcctcccactttgacctcccaaagtgctgggattacaggtatgagccactgcacccggccttagtctgtatctcaacactgtaaagattgttacctttaaagcaaatacctcaataattcaagtctttaaaacagtgaggggtccagccacagtggctcacatctgtaatcccagcactctgggagaccgaggtgggcggatcacttgaggccaggggttcgagaccaatctgagtttaggagtttgagaccaacttggccaacatagtgaaaccccgttgctactaaaaatacaaaaaattagctgggcacagtggcgtgtgcctgtaatcctagctacttgcgggcctgaggcacaagaattgcttgaacccgggaggtggaggttgcagtgagtcgagattacgcccctccactctagcctgagtgacagagcaagactctatctcaaaaaaaatgaaaataaaaaaaaaagagttcgagaccagcctggccaacacgttgaaaccctgtctctactaaaaatacaaaaattaaggccgggcccagtggctcacgcctgtaatgccagcactttgggaagccaaggtgggcggatcgcctgaggtcaggagttcgagaccagcctggccaacatggtgaaaccccatctgtactaaaaatcaaaaacttagctgggtatagtggcacatgcctgtagtcccagctacttgggaggctgaggcaggagaatcgcttgaacccaggaggcagaggttgcagtgagccaagatcacgccactgcactccagcctgggcgacagagcgagacgccgtctcaaaaataaataaatgaataaataaatataaataaataaataaaaacggtaaggaagggatcttggcccttgaggtaaattgcccccttgtctctctctaatccagggtttgggggaatggtgttcactcacggcctgcaaagctttgggtttaattactgtttcttgtccaacatttgtctgattttgtgggttacttggggccctcagggatgcaagaagccaagtgcacactcaggtgaccaaggtgatggaagttatagaagcaatcgtgggcaagcaagaatgctctggaaactgtggagcctcatgaagaactggaaccggtctttaatcaagtctcagataccatctcttagaagctgtgtatcattatttcataaactatgaagaaagaaaaacaggccgggcgcggtggctcacgcctgtaatcccagcactttgggaggctgaggggggtgggtcacctgtggtcagaagtttgagaccagcctggctaacatggtgaaaccccatctctactaaaaatacaaaaattaggcgggcatggtggcacgcgcctgtaatcccagctactcaggaagctgagacaggagaattgcttgaacccgggaggcagaagttgcagtgagtcaggactgtgccattgcactccagcctgggtgacagagggagacaaaggaaggaaggaaggaaggaaggaaggaaggagggagggagggagggagggagggaaggaaggaggcatttaacgtattgttatcggtggcgcgcgtccgcgcggtgaagcgcgcgaaccaccagcaccataaatgctttcatggaaacagaacccagaccaccccactatgccaagcaacaccaaagagcagccaccaacgctcgtacgcgcacgcagacccaaaccccaccgcctggaccaaaacgcataagacacgcgaacgaagacgacaggaacgagaaagacgcgcgcaaccctataatgcggtgcgccacgacggcagacgtattaacgaaaaacacgagctggagagagaaattcagcaaaatagcgtatcacgacgcccgcggacgcggtacgatggacccgagacggggtgccgagcacgcacggcacccgcccgctagaggcacggagtcgacgatggtcgtgttacgctatattgtcacatcgaactctctccactctgcatactgttgatcaacattcatcacgaaacacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttggcgtttcaaaagagacaggtggtagatactgtgggtaaggaaaagccaggaggtgagcaggaaaccaagtcagaagtcagaggcacagtcaacgaagcagtgccacgaggatggtgccaatgcctgtggttgcccagcaaccacatttcatcaatctgaagatgcacctttccccgccccccgccccgcattttggcatttttgaatgtgtctaacaacagacgatgtcttatttgctgcttttggtcgggcggcagccctgaggttgctgggactgcccgcaggtaggtgaactcctagagcgttgtgatccccacgggcagagcaggcgctggtggctttgggaacaccgcgggacccttttcactcctaagaatccgagggtcagatgcgtttggcaacattctcacaggaggagtcagaggaggctctcctgcatgatgggtgagccggcataggaattgtgccaagggccattagattttgtagagactctgaaccccctgtccagaggacaggagctgaggacaacagcaggcgaaaaacacaaacctcaaagtgcgtgcactggaaagagaccagaaagccagattgaaaatgtggaggtgttgcaggagtaaatcaccggtttcccttacatcatcctctttactttatttacttatttacagacagggtctcgaactcctgggttcagcgatcttcctgcctcggtttcctgagtagctgagattgcaggtgcctttttacttacaaaaatttttttaattgagagatagaaattgtatatatttatggtgtacagcatggtgttttgaaatatgtatacattatggaatggctaaaatgagctaattaacatatgcattatctctcatgactttttttgtagcgagaacacctaaaatctactcttaacaattttcaaggacacaatccattgttgttgacactatttattcatttattatagaaatggggtcttactatgttgcccagtctgatcttgaactcctggcctcaaacgattctcctgccttggctttccaaagcctctgtgcccagccattgttgactatagtcaccatgttgtacaatggatctcttgaatttatttctcctgtctaacagaacatttgtaccctttgatcaacctctccccaacccagccacccacctccagctcccggtaaccaccattccaccctctgcttctatgagttcaacttttttagattcatatataagggagatcatgcagtatttgtctttctgcgtctggcttacttcacttaacataaagtcacccaggttcattcaagttgtggcaaatgacaggatttccttctttttaaacgctgaatagtacttcattgtgtatacaccacattttcttcatttatccactgattgacacctaggctgattccatatctttttttttttttttttttttttggagacagcatctctctctgtcacccaggctggagtgcagtgtcacaattttggctcactgcaacctccacctcccgggttcaagtaattctcctgcctcagcctcccaagtagctgggattacaggtacccgccaccatgcctgactaatttttgtatttttagtaaagatgaggtttttgctatgttgaccaggctggtcttgaactcctgacctcaagcaatcctctcacctcggcctcccaaacgtgagccacggcgcccggccagctcctatatcttgactggggataatgtcatgaagaatgctgcaatagacatgggtgtgcaggtatctcttcaacatactgatttcatttccttcagatatgcattcagtagtgagctttctagatcatatggtagtactatttataattttttgaggaacccccatgctatttcccataatatctttcttttcatatatacacaagactgatataggaaataaagaaacactggagactaaaagagtcaaatgaaattttgaagcaataagaaagaagtatattatagttaaattgtgtgcattttctttctttcttctttttcttcctttctcattctttctctttctttctttctgatggactccctcccttccttccttccttctttccttccttccttccctccttccttccctccctccctccctccctccttccttccctccttccttcctcccttccttcgctttgcttcttgccttccatgctggcactgcatcgcgtacatgcatgatagacatgcctggctggctcctccctgacgtgcatgcaagctattcagtctaaattacatgaatagcaagccatcgaaacccagagggagacagctagggaaaaagaaagaagcattgcaaatagtgaacgacaaagagaaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctttggatacaggtgatgagccaacgcacccagcttgttactatatgatttaaatgttacatatgaaatgatgttctaccccatattccaactctgttgaatgaaaatccatacatatacctgaagtccattctacagtttgtatttaaggtgaaatgtaattcctcagtgccagaactacgtaagagtcactctaataaacactttcctgggccgggcgcagtggctcacacctgtaatcccagcactacgggaggccgagaggcaggcaaatcaccaggtcaggagatagagaccggcctggccaaaatggtgaaaccccatctctactaaaagtacaaaaattagctgggtgtggcggcaggcacctgtaatcccagctacttgggaggctgaggcaggagaatcgtttgaacccagggaggtggagggtggaaggaacccagaaacggaccattggacttcaacctggggaaacaagagcgaaactctatctcaaaaaaaaaaaaaaaaattacatttcaggatcaactttttggtacatatactgaaaaaaagcacagtacacaagatagttatccaccctagctaaaacccttgcctttgtaagtctgacatttttgttgtaaaacatatcaagtaaaaacattgaaggagaaacaagaaacatacatcagtatcaagaacaaaaagtagattgtctatcagctggaacttctttgcacctacaaaagagaaaataagatgtctcaggattttatttcaatatttcatatatctaaataaaaaactaacatattcacagaaaggcagaactacataattactaggtcccattttcctttattcctgcctctatttctgttaggtgattactaaaatgtaaaacctcccaaaatgaagagtaacaactgtaacatgtcaagaactgttctgtatgtgaacaaccatcaagctattctggcttgtttcaaagagtggtagggtaaaatgacccatatgtcagtctaagtacactgacataaaaattaaaactcactaataattgtctaaagtagtttcattaacttattttacctttaataatctctgcatcaataaggttcttaactgtcattcctttcttggaagaatctggttcccattttgagaatgcacaattaccggttccctggaaaaatgaacacagtacttaaaatgcaaatttcattcttagacctgagccttcctcaaagtagaaacatgtaagttttataggttactaattttaaaatatatttacatattctaacttaactaggtttcatcttccagttcctctcttggtttctgaagagaatgaaaaaaacagtgtactattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtacagtagttcatcacgctcttgccgcccaggctggagtgcaatggcgcgatcttaactcactgcaacctctgcctctcaggttgaagcgattctcctgcctcagctgggagtagctgggattacaggcgtccgccaccacacctggctaatttatgtatttttactagagacgggtttcaccatgttggccaggctggtctcaaactcctgacgccaactgatctgcctgcctcggccttccaaagtgctaggattacaggtgtgagccaccacacttggccaatagttggaaatttaaacccctaaggatagatacctcccaacttctctcagtccatttcagtaatgttttttgctgttggaaaatgaagttattgttgtttttaacacctaatatttgctatgcaataggcattaggttaaatagctacttcttgttcataacaaaggtgtaaagtagttcctattgttgtctccttatgtattaagttcaaaaaccaaaatatgaaagtaaatgacttttttccaaggttgttagaaaggggcagaacctcagctcaaactgtctaataccatagtctgtattcttttttttttttttttttttttttttttttttttttttttttttttttttttttttgaaaagggatttttttttttccccccagtttgaaggggggggggggaatttgggttaattgaaacccccccccccggggttaaccctttttttttgcctaaccccccaaagaagggggaaataagggccccccccattaccccgggttattttttttttttttaaaaaaaaagggggtttccccgtttaaccggggggggtttaaatttccggacctggggacccccctgcctgggcccccaaaggggggggaattaggggggggacccccccccccgggcccgtattttttttttttaaaacccagttggaatggcccccgttaaaaaaaatttggaatttttttttggggggggcctttacaaaaattttaacaaccctggggttttttaataaaggcatctcttttttttcttttattaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttggggnnaagcctcncctctggctttnttaaaagcactctaaccggccacagggtaccttttttagggtgacagctctaccatctccgagtttggcatgtaaacacaagatccccacgtgcagatctattgatgggtggtcttttctcagaaaggtacattcttctggctcggtctagattaccggtgggatttttctatgtttcatttttttttctgtgctttcggaaggacaaagggaagctgacagcgagggtgaaatgaaaacgtaagtgataagggttgtaagaaacaatgaaaaagatgttttttgttggcttttttttttttttggagatggagtctcactctgtcccccaggctggagtacagtggggcgatcacagcttaccgcagccttgacctcccaggctcaagtgatcctcctgcttcagcttcccaagtggctgggactatagttgcataccaccatgcccaactaatttttaaattttttgtagagacaaggttttccatgttacccaagctggtcttgaactcctgggcttaaaagatctgtctaccttggccgtccaaagttttgagatacagtcctaagccacccttgtggccggagtgagatttgattttgcaggtgatagaaccctgctgacagttctaagcaggagaagttcttgattaggttgtgcttttacatagaccaagaatttgggcgaagggtaaataccttggaactaagtccttttttctctgagacctggaccacggcattggagtgccgctctacgtgcaaagagaaggcttgttttaaaggaaatatatggccgggggcggtgggtgcactccttttatttcacgctctttgtggagacananacaggccgctaaccctcgggcgatgagattcgtagccacgcctgggcctcttggggcagcctcaaaatctttcttacaatagcaaaaataacctggtgtgggggggctcgcccggcccgcctctcttcggtgggttggtgtgggaaaccttttcacctgagtgtgaggtcagagacacaaacccct

SEQ ID NO: 703 - DNA, 169752 bp, Homo sapiens
caggaactcctctggcatctctgagacccagcagggcagagggtgggcggggctgcatggcgcaggggctcccagacctgagctgtggaggtggggccctgtctgccccctcactttggaaacctagtagggtttgtttgcttgttttttgttgttgttgttgttgttgttgtgtgtgtgtgtgtttttttttaaagaaatttgctgttttccaggtagcttcatagaaagccagggtctctttcctctatagttaggttgtttacattgcaaaagcctaatcctcttgctaggttgatattgtgtctcgtgggctccttaatgaaaagcatttgtccaggattattccttcacagcaaatgagagcctccaagacagctccactctgagaaccggccttgtggctggggcacgagcaccaggggccccaaagagggggtcaggctcgagccacttgtgtacgtgtgctactcctggcctgagcaccccaggctggctctgaaatctagggtgagcagaaagggaggcagattctcactgtaagaagcacgggggagagaccccattcgagtgggctgtttcccttttggttttgagcctgtagtttcccccaaaggatgtccacatcctaatccctggaatctctggacatgtcacctgacatagaaaaagggactttgctgttgtgattaaggactctgggatgaggagatgatcctggataatgtaatcacaggagtccttgaggaggaaggcaggaaggtcagaggaggaagcaagaggccagagtgatcccaggaaggggtcgaaagctgcgttatgcaggcagctccagaaactgcaaaaggctggaaacagactctcctgggagcctttggaaggagtgcagccagccctgatttcagccctgaaagactcattgcagacttccggcctccagagctgtaggaaaatgaagttggttgcttttttgtttttgcttctagaggcagggtctcgctctgtggcccaggctgaagtgcaacaatggtggcaatagtgcaatgacggctcatggcaacctcaacctcctgggctcaagttatcctccctcctcagcctcccgagtagctgggaccacaggtgtgcacctccaagcctggctaatttttctttttttattttttgtagagacggggtcttgctgtgttgtccaggctggacttgaactcctgagctcaaatgatcctccttcctcagcctccccaagtgctgggattacaggcgtgagccactgtaccaggtcaagttgtgttgttttaagccatccagttggtggttatttgttacagcagccacaggagacccacgcggccagagtccctctcctgccctgcccccgatgccagtcagccactaggctgggagggtcctgccctgggagagtccggcatgaacacagggaccaggtgcagcaactggactccagacaggaagcactctgtcctgagagctgcccacacccagattagggtttggatcccccaagaaacccccatccaatctcttccccgcctcctttggcccccagcagacctgcttctcactcacgttccctttctgcccctgcttcagctttttcctagaccgcctgcctccagcagaacgaatcaagaagattacagggcaggcgggtgtgagagcagctcctggggcgaaactagacgaaaatcccctggccctgtttccccaaacttccctttgatttttaatttttttcaaaagtttcttcatcacaaaatttccggatgtgacatccctggcagctcacacagcaagttttggcaaaaaccaatgtcttacttctcgctgggctgcaagaaattagagtaatcgcccccaacacacaaaggcatgaactcccgatgcaattaaggagaggtgaggggatcaaaggaatcatggctgtggatgaactctccttctctcgttttcccttaaaagtcacgagaggcaacttgcagtctagttagcttgggggcacccggggttggggtgtagcaatgtgggcaggagatggtatccttggcctcagcagatggggcccctaaggttgtactttttggcgtggctctgccagagattatatgagctccaagttctggagctcccttccagccccgcttttcactttggcgcaagagggcagttagggcaagttcctagttgtccccaaggctcctctgcccctcaactgtgacgtgggatggtgataccacctagcttgcagggctgggtgcaggtttaaggaggcacgattgaaacctggtgcctggcacagagaaagctcaaaaatgcagggtgccacccttcatgtcatcctcacctccaccccatcggcaccgcctcccacgcagccctcctcagtgacgacggcgggtttggcttcatccccttccatgaagatgagcgcggctccctctcctttgtgttggatctggggccctggggagagctgggcacacggctggtgtgtagtagcggctcactgctgggacactgctgtctgctgagggttgctcacttggctgtggttgctgctctcaggcctctcatggagccaccgtgacacaccccccgtgacacacacaccccgtgacacacaccccccgtgacacatcccccgtgacacacaccccgtgacacacaccccgtgacacaccccccgtgacacacaccctgtgacacacaccccgtgacacaccccccgtgacacacccctccaagccagggtgcaagttacatcccatcgccaggcccagcaccatccacacagcagccccacacgtggggagcgtcgctgtggttatggccgacttgccgtgtaggctaagattgttccccttacacacacagacatcctctctctcacaccctcacgcaatcccacactcgtattcactcccacatttacacacgtacacgctcacaggcatgcatacagtggggcattcatttacacacacacccatgcacacacacacatcctcacacacacccacatgcatcttcacacactgtgaaacacacacccacacccacacactctacgggggtcacacaggcctctccagctgcgccctccctgcaccgtgcagacccccaggtctggcctcagaggggacacgcaagccccactggcagcagacctccggtgtcccgtcccctgtctgggctggcgaaagtgcaggtagctccttggtcgcctgacccagtgccttggatgctgcccgtgtgctgggccggaggacaccattccctcgcgcacaacaagccctgtgaggcatcacggaggggacgggagctcacacctcaacctagagaccccgtctactcacaaccacttttaaggaatgcagctaaacagggggctcagatccctgttcagggcccttctcacgatcccaccgtaacagcccagccctgcgggtgcctggctgcagtctccttctccccagcacttccagacctggcagcccggcccaataccagcggccgtggggcctgacctggactgaaccccggagcccggacaggctggtcactgcagggcggggcctgaattctgcagctgctcctgaggccaaaagctgttctgagggtggggtgggctgccaggctccaccgacgccctcccgcactgcaggcgcctctctggagcctcacatatgtccaccatcagattccatggtctgcggtctgtggagacggtggggaccgactctctcaacacctctgtgtgaactggatcccctgggggactggggggagtaacagaaaagctcacagagtgcccctgagcccagagctgtttctgatctctccttaaaagcgatctccgtggaaacagcccagatgaccatcagtggacgaatagatacacaactgtggtccatccacacaacagaatatcatccagtcacagaaagggaggaagcgctgatccatgctacaacatgggtgaaccccaaaaacatgataagagacgccggatacaaaaggccacgtagcatgtgattttacctccacggaatgcccagaagaggcaaaatctgcagagacagaaagcagaggagccagggggaggagctgagtgttcgggagaggggagtgagcagtgaccgatcacaggttcaggctttcctttggggcgatgacaatgttaggaagtcgagagaggtgtttacacaaccttgtgaagatattaagtgccactgaactgtgtgctttaaagtcgttcattttatgttacatgcatttcaactcaatttttttaagtgacctctgatttttaaaagacgagtcaatattcccagtgactcatttgaccatgggaaaatccactcttttatgggccaaatgtttgcaaggctagagttctgtctgaaatggaaacttcatcaacagctgggcattcggtggccaggcttttacttggaaaattggaccagatttcttggccatcatcttaattatgtgttcgacacagagggacagaaatttctaaatcacaacttcctctgagtggagaaaatcaagccccaaattcttaaagggatataggaaagcaagtctcccggccatgctttttgagagggatgttggtgaagggcgtttagtcctccccatcatagaagaggagaatctggccacccaaaatgtgggaactgggttctgtggactgggaaggttcaaaaagagtatcaaaaacgggggaggttcgcctttcccaactgcagccagatggcacacaaggctctcctgcatgtgcttccagaatgtctccaggcagacagaatgtgtccaaatgctaggaggaaaacagagtacaacagcgtcaatgaccacagcagtaatggaaaccatgctaataatcataataccctctaccaagcccaaccccatgtgtcatcctacacagtagctaggacgacattagtaccccatttcattctcccgtgtctcagtctctgtatctgaacaacaggacaaataacagtgtctacttcattatgctgtcatcattattgaatgaaggttcaactctccatattccattttttaacaaaagcttcaactcacatttattggcaaatgttgatgtcatccaggtccagttccatgctgccaacagaagatccattccttatcttccagcgatgcgctgtacttctgaacagcttcgcctgcatttggtaagcaagagtcgtcagtagcctggagtcaatgagaagtttacaaagttgttgagaggtcaggcttttgtgaatgaattataagaggataatacaaaacaaaaataataataaaatgccctagggaaaaataatttatcccatgccaactaggtcttgagaaggtcatttctaaattactgtctcaaactgaattataaacaactactgaaggcagagaaaggggggtggggaagcaagtgtggacggggcgcagaaggcttcaggaaagacaaaaccagggggagggagtcagactctggaagaggaggctgtaaatctgtgggtctcagcctgttcaggttgctgtaaccagctaccatagaccaggtggtttacaagcaagagaaacttatttcacacagttctgaggctggacatccaagataaaggcagattggtgtctgccaagggtccttcccacatagacgcaggcaccttgctgtgtgttacacggtgggagggacaaaggggctcccttgggcctcttttctaagggcactgaccccatccacgaggctccaccttcatgactgatcacctcccagaggctccacctcctagaaccattagcttggaggcgagaatttcaacataggaattttgtgagggacacaaacatttggaccatggcattctgccctctgcagagctggctgaggttataaactgcccactgtgcagaaaggacccgaagcagaaagcatgcccagtctcagccaggatggaatagttactgcagcatggacaaggaaggcatgtcagaaaaaaaaaaaaaagccattgccatcaccatcgttattatcaccatcatcgctagcgtttcctgagtgcttgctggttccagagatggtgcaaagtgccttgcacgcatcatgtcacttaatcctcccaacagcccggggacgtgtgttccacggttaccccatctgctggatgaggaaactgaggctcagggaggttaacaatttgcccaacgtccaacagcagctggagagccatggcaaggctgaacggtgaatgcctgtgcaagggaagccaggctgtctccagggctcccgacaggggctgcgtttctgctgggaataattgccggattccatttgcactaggatgtgcgaactcactgttgttcactaattctaagacaccttcttcgtatttaacaccctctaaagctggggtgctgtgtcatggtttagtcttagatggcaacaataatggaatcaatggtatcttagacttaatgaaaagttgggttgccaggcccaagttcctagaactgttaagtttttgttttatggcaggcatttattttcttcttgtggccactagagttttttttaaaaaaaaaaaaaaaaaaaaagaagaagaagaagaagaagaaacttctagagcaggaatgtccaaaattttggcttccctgggccacactgagtgtcttgggccacacataaaatacacaaacactaacgatagctgatgagctaaaaaaaaaaaaaaaaaaatcacaaaaatttctcataatgttttcagaaagtttacaaatttgtgttgggctgcattcaaagctgtcctgggccacatgcaggccatgggccacaggttggacaagcttgttctagataaagaaaaaaaatgtgtgtgtgtgtgtgtgtgtgtgtgtatacatatatatgggctattaataaaccacccagtttatggtgcattgttatataaataacctaatgttcagatttcagattttctattgctctttaacaaatacaaaatttagcagcttaaaaacatggttttcttgcaattccatgggtctggaattcagcagggctgggctgggtgactcttcttttctccttggcctggacagggcccatgtggaggtatctggttctgagaagaggctgttccggagggtccatgtgacttcactcacaccctggcagggagggctggaaggctgggctcagctaggactatgggctatccacatggcctcgccagcatgctggcctcaggtagaagtatttcttctgtggtggctgaaagctctggaagcacgtgttccaggagaccaggcagagccgcagggcctatatggtatagccttggaggacatgcatcctcacctcctgaccctgtgtgggagaggacagcctggatggtgtagccttggaggacattcatcctcacctcctgactctgtgtgggagagaaggatctggatggtgtagccttggagggcgtgcatcctcacctcttgactccatgtgggagaggatggcctggatagtgtaaacttggaaggtgtgcattcttacctcctgactccatgtgggagaggacggccaggggggtgtagtcatggaaggcatgcatccttacctcctggagacgtgccaatgcctagcctggaaagggtcccacctgcctcctgaccccgtttgggagaggatggcctagagtgtgtagtcttggaaagcatgcatcctcacctcctgattccgtgtgggagagaacgacctggatggtgtaaacttggaaggtgtgcattcttatctcctgactccgtgtgggagaggacttcaccagggcgcaggtgccagaggctcccacaccaaggatgaagatggtcaccttcacaacccgttccgactcacccagtggctactgttggacacctactctctgtcaagcattttccttggcaacaagtaaaaaagacactcaaatgatgtcctcaaggccgttacgctgcagtgacataagaggcaagtgacctaagaaaaacaggatccttggaaatagtgataatcactctaaagaatgaaacaggggctggggcctgtgactcatgcctctaatcccagcgccttggaaggcaggtggatcgcttcagctcaagagttggaaaccaggccaggcgcagtggctcacatctttaataccagcactttgggaggccgaggcaggtggatcaggaggtcaggagttcaagaccagcctggccaacatggtgaaatcctgtctctactaaaaatacaaaaaatagccaggtgttgtggtgtgcgcctgtaggcccagctactcaggaggctgaggcaggagaattgcttgaacccgggaggcagaggtttcagtgagccaagattgtgccactgcactccagcttggacgacagagcgagactgtctcaaaaaaaaaaaaaaaaaaaaaaaaggagttggaaaccagcctgacagacatggcgaaacccgtctctttaaaaagtacaaaaaaattggacgtgctggcgcgtgcctgtggttccagctacttggggggctgaggcaggaaaatcgcttgaacctgggaggtcaaggctgcagtgagccaagatggcaccattgcactccagcctgggggacaaagtgagaccctgtctcaaaaagaaaaagaatgaaataaataggaaaacatagtggagcctggaatgttagaaagaatgatcacggaggcgtcctgaggaggtgacctgtgacaagcaatctgaatgatggcggggaatggctgtgggactccctgggaaagtgcatttggggatggggaagagcacgtgccaaggctgcagggtggaggagagtgggctggagtcctccaggaacagaggatgggtctgtgagggcccggagtcacgggggctgggaaagggaccaggaggagatcctcaggaggtgagaagccagaccaggggttctcaggggccatggcacagggtgtggattttatgccagatgcattgggacccatcctagcgcctgcctggaggtggagtcactgagcagctgggtcatgtgtggctggtgaccagcagggcctatctggaggaagggcggtgtggcgagcccagcctgcccttagcacacacacacgcacacaggggtgaggctgggctgcacccacccgcctccgggccatcccctgcacctcggatgactcctcctgggcgtgtcattcctgcccacgcttggctcacggacctcacagccacttggggcctgtgcttcccagcaacaggaagcctcacgcagtttagaaggggacctgggcctctgccgcagtcagggcagggaagggcaggggtgggggtggccaagcgaagctggctgggagaaagcatcacctggagacgctccaacgcccagcttggaaagggtcccacccgcctctgcattcgtttggatgtgtctttcgtaaaaatcaaagaaagaaagagatgcttgtttcagctgacgacagggagctccagggttgcccataagttcaggagacgccgttctgtcacccttgatattcccaaaatatcaaaccttcactggtgcagcctgctgcactgggtgtttcatcaagctttcttgatttttaaaaacttttttacaacccctttagccctcaacaaatatgaagtccacatcaagtgcataataaatgtctgctaattgagtgacagtggtaggcagaataatggcacccccaaccaaaatgtccacatccaagcccctgggcccgtgaatatgtcaccttacatggtaaaaggggctttgtggatgtgagtaggggttagggaccctgaaatggaaaggttttcctgaattacccaggtgggaccagtctaaccacagaggcactaaacgttggaggactgttcccagctgtggtcacagagaaacaggatggcagaagaagggtcagagagatgagaacttggtggctctgaagctggaggaaggggccacacaccaaggaacgtgggtgctcctagtggctgaaaaaagaggggactggatcttccctgagagcctccccaaggaacacagagctggcgactccttgattgcagaacttctgacctccagagctgtaagaaaataaacatgcttattttagtggcttgttttaagccactaaatttgcggtagttcattagggaaaccatagagtctcgtccagtgacgaactcatgcctcttccccctattctgtggcgagatgcacattctcctggaagacccattctatcatttttgagataggatttttttttctcccacccaggcctttttcagttgcaagttcctaagaccaaactcaaatgtctaaaggaagaaaagaaaaggaatgcattgactctgatggcaggagaaggatctgggcacggctaaattcaaatgcaatcgtcaaaatcatctctcagccctgttctcctccaggtgtcctcattctcaggcagtttgctccccatgatgtcccttatgcaggcttcccagctgatatcctctgtgcttcaagcccagtggaaatgaaccttgtttttctcgcctgtgtgaactgaagttctcagcctggtggctattggccagaactgggtcacatgcctatccctgacccaatcacagtggccaaagagatgcagtgctctgactggccaggtctgcacatgaccatccctgcagagccacagggctgagataaggggagatgagttccccggaaaaaatgtaaaaccccgtttctgggagatgggagagatggatgctcagtgtcaaaacaaatgtctcctgtgggaatattgacaattcactggttttgcaaaaggccatctggaagccctttgatgaggcagtgtttgaaaatctgcaatgccatttgcagaaatgatgctcccactgagtgtttgggttcacccgtcccggtcactccagcacgaggcatggacgtcaccaccgacccttgcttccgatgggaaagtccgcctcctgggcctgggcatgggcacctcaccctggggtctctcccaggcctggttccgccctctgggaatccctcctgattgttttctgtcctgctgggactgggaacattcactcttgtgtttgttttcacagagtttgcaaacttgagccttggccttgaaccagggaaataatcggctttttccatccgcccactgccatccccagctggcccctggaagagccctgggaacgctgtgggtaggacctctgctcagctggagagaagggtatgccagtcaaagctcccagctgagcgtggcttggtcaccacccctcagcaccgcccgtcacggctgagctctgtgactgtcacccaagccaagtccttccctcccatgagcgatgatttacactcttccagctaccccaagaccttgttcagatggtctgaaatggctccaaaggtgcggatcccgatgagactcagaggccagggcccaagcccctccccaccccatttttcccatcagtgtctgtaatatcaccccactttcaagggtcagacgctacagtactgaaggccaaacacacacacccaggggacgtcagtccttcagcgcagcaacagaaggtgactcacagctaattctgcttaggctacactaaattggcacagccagactaaaatacttttgactaattcatttggcaggagcatcaaagcccaaaaaggattgagtccaagtttccccctcttaaaaataaaataaaacagaaacaaaaacaaatcctggcaagaagagaggcaaaaccctgactatctttcatcttctgtgttcacaagaatggagatgccacagggcatgacctgtgtctgggccgttcactgtgacatcctgctcctagcatcctgcctggcccagagcaggtgctcaagaagtgtttgcaggatggtgttgttagacaagaaaacaccctacacttaatggcataaaacaaccgtgattttactcatggcttctgagcagccagagcttggacagggcatgcttgggctgttttcgctccgctccatggtctggggcctcggctttgagcattcgtgtgtgtccagggctgactcagtagctagagtgcagacctggaggtgtctccactcacacatgtggtggttgtggctgactgtctgcgggttgggacctcagctggtttgttgaccacagcacctactcacgtggcctctccatgtggtctctccgcatgggctagcttgggcttcctggcaatatggcggctggattccaggagtagtatcttcaaaagaaccaggaggacgctttgttactgtctatggcttatcctcagaagcatcttatcctcatagcatcacttctgtcatcacaagcccactcaaattcaaggggaagaaatacaggctcctcctctcgatgggagggttggggtcagagtcaccatttgagatgagcctgtgggatggcaggtggtgtttcagctggtttgaggagcatggtgtgcgacagatggtggatggatgagacccagatgggacactaagccaaagcgtctttgaggtgacttactcaacgcccctgaaagttttcatatgtggccttaagtataatggagcatcactacaagtggtcagatggacctaaggtttggagttgaatcaccatcaaccttttaacctgcgtggcaaggcagtgttgtggttaaaagtgaagccaggctgggcatggtggctcacaccttaattccagcactttgggaggccaaggtgggcaaattgtttgagcccaggagttcaagaccagcctgggcaacatggcgaaaccctgtctctacaaaaaaaaaaaaaaaaattagccgctagccaggcacggtggcatgtgcctgtagtcccagctacttgggaggctaaggcaggagaagcactttagcccaggaggcggaggtttcagtgagcccggatcatggcattgcactccagcctgggtgacaggagtgaaaccctatctcaaaaacaaacaaataaacaaacccaaaacaaacaaacaaaagtgacgctagatcaaggtcagtcttctagccacgaggctgtgttatcattttgcaagacgttatcattaggaaaactggctaaaaggtacatgggatctctatattacttatgaatctacaattatctctgtaaaaatttcaattagaaaaatgtggagccaggctgccaggatgtgaggctcgagtctgtcactcaccagctgggcaaacccaggtccacaacttactctctttgtgcccagtttccttatctgcaaaaggaggctaataataataataatagtaataaaaatataagcttcgtagaggtgtggggatacacaaagctaatccgtggaaaaggatcaggaagaacagctcatgctgaaacatcctcatggaatttcaccagcttcctcgtgataggagatgactttccatggaacccacaggccctgaagatgacccacataaaaattaggaagaagcaggaagagggagccggtgatgactgtcttggaaaagtcacatcctggagacatctgtccaagagatccactggaaagttgtgtgttagccaaagcagtccgctggctgtaggcatcgcccatgacatgagcagaaagagccaaggtggacaaagatagcaagtgtttaaaagagatggcctgtggcgtcaggaggcacaggtccctaggacggagagcctgcatgccgggccctctcccagacactgaaaggtctgagcgtggaaaggaagacattcaagttcatgatttggaggggcgtgctaggtgccaagctctctagcttttttcctcatatttaatacttacagcaacttctaagacagcttttatgacattccccacttgatggattagtttgcagaggtgcagagaggacaagaaatgtgcctaaggccacccagctaggaagtgaagcaaaacaagagttgaagccagctggctggctccttcgtctgctcctggctgcctgcatcagagacgacccctcaggccgggggtgcgcacctggctctcacctgcccccgataccttggtgctaactcctgcctttgcgtttttgcctatcctgtgtttgcagatgagctacttgccctgctgtgtgcacggatggctcacagtgggtgcaggcggcctgcgggcacagtccacgctgtgattagcagcagcagagcccctggatacctctgcccagagctccgcggggtcagccatgcaatggcaccatcggatgagctggcaagggcctcccagacaggcggaaagagggcttggcaactgcaccatgtgtatgtaagtcccagctgggtgtccctggtgtcagtttctcagtctgtaaaatgggcatcatttggctgttccatggattaaatgaggggatacgtgcaaagaactttaggttcctcagagagaaatccagataaagttagcaaaagaacaggagtggccccaaatcctgaaagcccttggcaccttcttcctgtactctagacagatgccatctccctggcaccatctgtgcccacacccacaaccccacccatctgtgagggggtgggggtggagggcattctaaaggttttttgggatcctccccagcaaaattggagcggtttgttcattctcgagtccactccacactctctgggccctgctgggcatgaaaggaaaccacccttcttgcctccctcactgtctggctgctaggtggggtcaaacaaaggaggccctggcagcagaaatctggaggccaggagcagggagaagccggtgtctctccttctctctctgctctgcggaggcagcttttcctcatgggacaggcgtcttccagggttcctgctcctgtccaggtggccgtgcttggctctagctcggatgggcccaagtcaggtgacatagctcctcccgatgtccctccagcccatgggaggtggagctccctgcttctgcctgtctccaggcgctgaaccaagcctgcctgttttctcactgtccatcaccgtgtctccaagcccctggactggataccctgtgtttcagcttccttagagtgacttttgatgtcttccctggactccagacttccacttagaagcagcaggagtgcttagaatccacagacctcccctagtcctgtgtgagttacgtttcctctgccaggaagaggaaacatagagccaggtgacttcttccattgtcctttatttttattcattcatatattcagcccgactggctgagcacccataatgcgtctatgtgatgccatctgggagcttttaaagagtttattaatagtttacacaaaaagtgcttacggggtgcatgggtgtaacccacagactagtgggattggagcacagatggtgctgtgtgtgggtactgaggccagccagcggggaggggtccagctgctgaccagggacccctgaagccactgggcaaggcagagcgagcaccctgggcagagccagggctgtctcagcaggaccggccaaatgagcgagtgagtgctccttcctccttcccagaacatgggtggctttgaacaggaggcaggcacgatctgcggctgccgtctgtgcaggcagagagcagctcttggtgggcctattcattctgtttgacacagcagagggacagtgctctttgaagactctgttggggatcgtgagaggtggattaagggtctccccaaagatgtccacaccctcatccctgaaacctgcgactgtgtcaccttacagggttacagggactcgcaaatgagctggagagattttcctgggtattctgtgtgggaccaatgtcatccccagggcccttagaagagggaggcaggagggctggaggcagaggaggagaggcgaccagggaagcggaggtcggagggatggagggcgggagtcaggaacgtgggcacctctggaagctggaagaggaaaggaaatggatttccccccgcaccctggagcctccctggggacaaagccctggtgacacctgagtttagctccgtgagacctgtttcagactcctgacctccgggactgtaaggtgagtcatctgtgttgttttaagcccttggcttggtgatttgttacagcagaaataggaactcattatatacgggtaataatggctgacctttactgagcgcctcgactgggagccagccacttagaaatgatccctttgatcttacagtgcccctgtgaaagggtattgttaggctcattttaccgcagagaagctgaggcttactgcagacaagcaacttgcccagagtcagaggaaaaggaagtgggcacctgagtgagactctgccaggctctgctgggagcccttcatgtgtacaggctgatcccaggctcacagcaagcccgtgaggtccaggcggtcgccattctcctcatgcttacagatggggaaaccgaggcacagctcatctccgaggtccccgtgttaggaaacgtcagagccaggatttgaactcaggcaacttctcgccggagtctgtgctctggaccccacggggaggggtgagatggaagccaggcatttacagaagccaagaccagggaagagcatggaccttagaccacagcacccctgaaccatcgagcccctgccacacttcctggaatgctctttgtggagcattgaatagtgttcacccaaaagtcatgccctcctccgaatgtaacctcatctggaaatggggacactgcagatgtcatgaaggtaaggacggaaaagagcgcgcactggagtaggctgggcatgaaatccagggagagagtccttctgggaaggaggagagcagacacagagacacacaggagggcgacacggaggcacaggcggagactgcagtggaatcatgcttccacaagccgaggaacaccgacggctgccggcacaccacagctaggagcgccaagggctgccggtacaccacacaccacagctgcacagaggcctgggacagatgctcccatggagcctgcacaagaagcctctctgcccacaccttgactttggacttgaagccttcagagcggtgagaggagaggctcctgttgcgtgaggccggcagccccaggacacacactcttcccgtggggccagctcctccctccccagcaccacgaggcgccccggagaattgggctcttgacccgggccaggcaggaaatgcaggcttgctctttaaaacacattaaaagggatcctgcaaaggttaaaaaaaataagcagatgaacaagataagcgttcccctgggacctgaaagacgcagaagaacaagtaggaggaacattcggaggagaagacctagctgcagctgggtcctggcaaagttatcgggttctgctccctctgcctgggtgaggtactggcaaagttctccggttctgcgccctctgcccaggtgagagccaccaggtcctcctgtttctgcaagcaacggtccccagcccactcctcatgcagagaactccctcttggtgccaaggccgatggggtgcccccgccactacccagctatccctgctgcagaagcacagggcggtcagggcaggcggagttctgcagcatgcaccccccaagcctgggaccaggcacaccgacagcactccccagcatatccctgctgatgcaggcctggggcccggggggtgtggtgtgtgtgtgtgatgtgtgcatgtgtgcgtgtgtgtgtgtgctgtgtattatatgtttgttattcagtgtgtgtgcatgtgtgtacagatgtccgtgtttatgtgtgtacacgtgtggtgcacacatgtatggttatgcatgcatgggtatgcatttgcatgtgtgtgatgtgtgcatgcacatatgtgtgtatctgtgtgtgtatgcgcatgcctgtgtatgtgtgtatatttgtgatatatgtatgggcagtgcaagtgtgtgtgctgtgtattatatgtaggtaaattgtgtgtgcctgtgtgcacaggtgtgtatgtgtgcacgtgtatatgtgtgtacatgtgtggagcttaaccctgtgattgtgcacatgcatgtgtatgtatgtgtatgatatgtgtaggtgcatatgtgcatgtgtatctgtgtacatatatgtgcgtgtgtgtttatgtgtagtgtgtgtatatttgtgatatgtgtatgtgcagtgtatatgtgtatgatgtattatacatgtgtgaatctgtgtgcatgtgtgcagatgggtatgcagattgtcatatgtgtgtggtgtatacatgtgtggttgtatatgcatgaacatgtatgtgcattgtgtgatgtgtatccatgtgcatgcctgtatgtgtgtgtacatgcttgtatgtctgtatttgggtgatgtgtgtatgtgcatgcatgtgtgtatgtgcctatgtgtgtgtgcatatgtgtgtgcgtgtttacatgtctgtatttgggtgatgtgtgtgtacatgtgtgcatgtgtgtgtgcacatgtgtatatctgtatttgggtgatatgtgtgtatgtgtgggcatgtgtatgtgcgcttctgtatctgtttatgttcatgtgtatctgtgtgcctgacatgtacatagaggtacgtgaagctgtgtgaatcacatcagcaaagtctcttttgctgtagaaggtgacatggtcacaggtttcagagattagggcctggatgtcttggagtccacggctaagcctgccacagaaggcattccacaatccccccgccaggtcatcctcagtttcccctttctacgagtcagaaaaaacaaaatgacactcagaggttcagctctgcctacagatgcctctgtctaccctaagttcttaacaaatcctgttttgttaccaagacgtacaaatcaggtcatttcactcccacgcccagttgtccagcttcccttgaggagtcaaggcctcaaggctctgctggccaccctcttccatgggagtaactggctgggattccctggggctgccccttagaggaggcctggacagtccagtttgccacagacctcaccgctccctcatactccgttcctgagagccgaagtctgccaacttttcccacacacttgcactttctctgaaatgtctcctcatagtggagttagggaagactggggcgtttcttgcacgtacaactctatcccaggcacaacccaagctggatgtgctgggtgggtgtttttaacccaggactcaaccctccttcatgctcccagctgggccccgacgggcattggtgcctgtgacccccccactctcagtgtctgactttccatattctttgtctgcttttctagtttgaccaaggagcttatgtttttaagtcatggaataaaacatggattactattgtgggttgaactgcatcccccaaaaagatcagtggaggtcctagaaacacaggacttcagaatgtgactgtgtctgaagacaaggtcattgcagatgtaattgttaagatgaaatcatactggagcaggctgggcccactccagtacgaccgatgtcatcataagagaagagacacagagactccacgtggagacagaggcggagatgggagcaatgtggccacaaacccagggttgccacaaccagcagaaactaggaggaggcgaggcaggagcctcccctgcgcctccagagagagcctggccctgccaataccgtgatttcggacttcttttaacctccagaattgtgcaagaataaatgttgcttgttttgagccacccagcttgtggtcctcagttacaacagtcccaggaaactaatacatctagtaaataaaatgagagcggtttctctgcatgaactgaaatgatggcgggctctgcagggacagttcgcagacatctgcaaacaaatactgtccaaaccgtggtaaacagccgtcttttatttcggcgaaagcctttgggccagttttcgtatgttgttggaagcactaaatctctcgctggcagagatctgcaagcagctacaagccagcggctcacctgcagcaaaacgcctggaggcaggtccatgcaatgcccacgtcttgcatgtcattgtgcagttaaacagctcctgaaccagagagcagctgcgcccagacagcttcccgggtggtaagaactgtatttgacctcctggcagcacaaacgactgaataacaattaaacaaaacaggacagtctccgtgtttcaaaatgcgcatttaaacctaaaagaaacacggtgtgtttactttctgagcctggccttccctgggtgcacagtgagccacttctgaaagcgtatgggcacacccgctacagaaaccagcttacactggctcggttgccagtcctggggcatttcagaagaattgagtcagaaaggtgttttctgtgggtgattcaaaggctccaggtctccagaaatttgttgcatgaaatggagaataagtaggctcgggctcggacttggccgcgtgcagcttcaggggtgaagctgcttggaggccaggggccagccccagtgcttggatgctggggtgcagatccgggaatgggatgatagccaggtggaaagggggaggtggctcctgggtcttggagaagagggtgagaatataaccaaagatttgtctgaaagccagacagtggagagtcagcttggctgtgaatcatacctagtttgagcataaagatgagaagtgaaaacagagatggggaggtaaaaaaggagggggaggtgaacagagaggcttaggtccccatcgataacagtagctaatgacacgtgaacacgggatctctttgcttgcttttctttttttttttttttttaagacagggtcttgctctgtcaccaaagctggagtgcagtggcacaatcatggctcactgcagcctcaacctcccgggttccagtgatccacccatctcagcctccagagtagctgggactacaggggtgcaccaccatacctggctatttttagtattttttgtagagacgggtttttttgccatgttgcccaggctggtctcgaactcctgggtttaagtgatctgcctgcctcagcctcccaaagtgctgggggattacaggtgtgagccactgcatctggccaagggatatcttttgagatcttcttgccccagagcttaatttcagaatccagcgtgattgttaaagaagaaaataaacgggctttttctattttacctggagcatgtcaccaggacaattttcatccaaagacctagttcaatggggctccttccccaagctccccacacacgctccgggaatcgattttttttacagttgtctgaagtgcaagtcaagcttttgcacacacactctctctctttctctttttctctgtcttaaattgccagaaatgtacaattttcctaatggagagtttatttcaggctcatcaagataaaataaattccgctggtgtgcagccggccaggcgcagggcagagcggcggcaagcggcccgcgggcagagggggcagcgagggtccatgctcagcgtctgaacgttacattggcatctggggagggggggggctccatgtgtggtcacgtgaactccgagaacgaacctggctgagcacagtcgaccttgtcactgtcatgacccaaggtgtcctctgtgactggacatggggcggggtgcgttacgtagatgactcgttaagctctagtggctaactcagtgcgtccatgaaggctgtgcggagatgcggccggcagaaggcaaacatagatgacgctggggatatcggtgtaaatacgggtatggccagttggtcgatacagaagggtttgtttgaaggccttcgctcacacgattgtggctgctggcaaatccaaaatctataaggcaggctggcggctggagcctcaggcaggatttctacgaggcagaatttctcctccttcgggaaacctgcttcccctcggaaggccttctgtgggctgcgtgatgtgctcccacatgctcaggggcaagctcctttattggctgtaggcatcggccacatccccaaaacacctgcccagcaaccctgagatgactgcttgggttcgtctccaggtacgctaagcctgcccacataaaactgactgccacacactgacgttctccggtgagagatgggagactcagagaggccacttcctttgccagggttgtagagcaatggaagggcttgagtggtcaggtctttgggtctcattgcctgtggttctaaactagcagagtgtggaatgcctcggcttccactgaccctgtggccccggcagggcctccaccatcaggaccgccgagcacgccctcctgccaggagcgacgtcctccttcctgagaagtttctcgtgggtgggagggatgggaaccggactcttgacacctccctggtgccccagccccaccctcgcaaggcggaccacccagaaggttcttccggccccttttccaaagccctcctgcctcacttaacccagcccaggttaactgatgactgtgggaagagatgtttccagcagcacactgtcttgtaatccaaggggccctggaaaaaggggtttcgcagcggcactgtggtctcagagtccatgcgagaggaaacacatctgtccctgtattttccgcagacaccccccctcgcctcccccacgtccccacaggctgtcatattgtttccagttgtgtttatggtaaactcaggccataacacgcctctgtcgttgtaaaagatggaaagagtcttaggagagaaattttcatcccaggcctttcaagcggcattttcccggtggtagaggtgaatgggaaacatgaagcagctgcctgcaggaacgtttttccctctgtggcaaggataaacagtgaaaggcgtttgctgaagatggaaagagacactgtgcaaaccaatatgcacagctcctgaggcctgtgctgggggccgtggcttgctgacgtctctccaaatacgcaagtcagagaagggctgactcacaggtcatggattgcaaaaaatatggcacaagcctgacttcgaactttcaaagggacaaggacgtgcacgccacagccacagccccagaccagggtgtaggccgtggggctccagctcccttctgggcatcactgctgtgtgtccttgggagagtgtctccgcctctctggcacctcccttcactctggaaacctgtccatcaggccaggggactggggtggcgtgcggcctacctcctcccaccttccgagcccaaccccaaaactggataagcagtcagcttgcactctgaacccagaactgaaacgaggattaagcttcgctttgtgcgtgccacaaaccagacaccacatccaacctccggctctagggccaggaactccaatcaccaagcatttttggaaaaccaaatcaaagctagatggcttttctaacatgttatattgtattaaagattgaaaatgacattgagaagtaaaaataaattggaaataactggaaaaatctaaatgtccagtaacattgggggattcattaaaaattctgacccaatggaacgtcgacgagccaccacaatgacctttttaaagaatgttccctgctgggcaaagatgctcatgaaatcttacttgaaaaataaagtaggccatggaaaggtatgtacagtaagatcacacttaggaaattatatataatcggggtgctcaggctttcagaaaaaaaaccagaagaggcacacagagtcacagggcacagagtctgggtggcgggcccctatgagattttcactctctctatgtatgcgtattttgtgtgttatacattttatataatgagtgtattaattctgtgatcagaaggaagtcagtgtttttgtgttttgtgtgtgtgtgtctcaaggcagcattataaaagggactaggtcatcagcttcctcagctaccccacggcaaaccgcccttgttctttttttaacttacaacagctcagaagccaaacttcaaactgctctcgtcaagggttttttccttcacactaagagccagagacatagcaaggaacccggccctgaagcagtgggcacaggctgctgaccggctccgccctgcctctgggaccctgggcaggctgcttgacctctctggcctcagttttccgaactgtgaaatgggagcattaatgacaggatcaacccctgggaagcgcgggtagggttatataatgagaacaccggtaagtgctgggtcataattggtgtcaccataactaacataaatgacaagagaggcagccagtgcctgcacgcccaggccatctgtctttcatccctgggctgcatctctacccaaccctgctctagactccacagagagatgcagaccactccctctccccaccaaaaaaagaagagagatattttgtgtctttaaagaggcaatgtcttccgatgtccaagtcaaacggaacagaaaagtcaggccacactccaccgcctgaccctgggatgcagatcacagaagttcaagggaagatgggggtcagggcagatgcagccaaggctggttccagagagagggcagggctgggagctcagtggggagcttcaccgggctggaagcagaatctcctctatcctggtgtcctaggacaggcttttcatgacatatagtggcggcactaactcacgccaccctccacccatggttacagccatcatccactgctttgccacaggtggctttggaaggacctgagcagggacctgttgtataagctgttctaggtgagctcacctgagccctagagtcctgccttcttgttcccagctttaatattggcccaggggtcagcagagccatttcctgtgtgtcctcgggggcacggcagtgaggaaggaggacctccacggcttacccagacacctccctccctctatccgtgcaaatcccgcgactactgtaatgtcctccacggtaagaaagggcccctcggtcccctgtcaaggcgctgtctgctgcaggtggtgccagccttgcagtgctgtggtaagaggggcatgctttgtgttagaatgccagtctctgcagagttggaaagcaccctcacccgtggtacacggtcctgtcttctccagacagaaacaaagaacacccacaggacagcccaggcttcacccaagcagcgccctggagaagggagtgatcttgtctccttcctgcgtcatctttcaaatggaacaggatctgggggcaagaccagcaaatcggagctgcctgcctgggcctgggaacatcagcgtgggatctcccgccctttcccctgcagcttcaatccagctagggctccgttccctctggaaggtgctaagtggttctgggtgtgataagccttgtctggtcatctggccatgctgggagacctcgctgcttagtgggatttcaaaggagagggatgttggaagtgggaagtttattatcattactactactgttttggtgaagtgcccatggctgagtgagttttaaacatccaagggtggagatttgggcccggcatcatcattgcttctaaggaaagtcagaaaacaccacatgtatatggagcatttgcgttagacatcagaagctagaggcggcgcccttctctgcagcaccctcagctaccctgggccggggcacctgcagggaaaacgctttcatggtttagagacatagacgagccacacagccctgtgtcaatccagtggggccaaccctgctcggagcctgctgcaaacaggcctgtttgtgttggccgatccgtgcctccatcagccagggtgactcacctgcatttagcttggagcgagaaccaaaggccaagtcccggtgagaaccctttccagaggtcctaatcgagtcatctcacggggcttcgcaagcagtcattaggctgaacaactcctgactgtacatataattatgctccttgcacacagggaaactgaggccaagagacttcactttctcagttctgtaattgggctagcatccagactctcttgtctcgttgtctaacccagaagcaggggttattctggatgaaccgggaagtttcctcccaagtctggtgtctggatcagacatcacctgctctctaccaggcagccgtgccagccacagaaggacggtcgggacagtagaacggggctcatgaagaactggatcccagcagatgtcctgtctacagcacacggtggctactcgcctgagccagacctatgcccagaaggatattttttgagaagctgaaagctctggttttcatgtgaaatatgacgatgttttaaagttcactgacagattcaaatgtctttaaaacactgcacagtccaaatgcagcaggtgtggagtagattcagtcctaaagaaatgaatatggggccgggcacagtggctcatgtctgtaatcccagcactttgggaggctgatggcctgagctcaggagttcgagtccactctgggtaacacggtgaaaccccgtctctactaaaatacaaaaaattgggtgcgcatggtggtgtgcgcctgtaataccagctactcgggaggatgaggcatgagaatcacttgagcccgggaggcagaggttgcagtgagccgagattgcgccactgcactctagcttgggctacagagtgagactccatctcaaagaaaaagaaaaaaagaatatggaccatttatctagatcagcacagtctactagaaatataatgtgaaccacaaatgtgattttaaattttctggtagctacttttaaaaagtaaagagaagcggccggaagcggtggctcacgcctataatcccagcactttgggaggctgaggcgggcggatcatgaggtcaggagatcgagaccatcctggctaacacagtgaaaccccgtctctactaaaaatacaaaaaaattagccgggcatggtggcgggcgcctgtagtcccaggtactcgggagtctgaggcaggaggatggcatgaacccgggaggcggagcttgcagtgagccgagatggtgccactgcactccagcctgggcgacagagtgagactctgtttcaaaaaaaaaaaaaaaaaaaaagtaaagagaagcatgtaaaatgaattgtgataacattttatttaactcgatgatccaaacgatgctcatttcaatgcaggatccatatgaagattactgtttctccccgcctcgcatctccatttgggccggccacatttcaggtgctgagcgactgccggggccatcacacaggccagccagagataccatcagatccagcaggcggggcacccggctcacaccagaactccattcaccaaacctgaatctcacctaccaggtggagaacattttcaaatgtcccttgaatgcctgggacttctggccatgctgggagaactcgctgattagtgggggtcttaaaggagagggatgttggaagtgcgaagttgattaacattacagttttggtgaagggcccatggctgagagttcgaaacatccaagggtacagatttgggcccagcatcattctagcttctaaggaaagtcagaaaatgctacatctatatggggcatttgcattagaggtcagaaaaaaggacttggccttaggttcttgcttcaagctaaatgcaggtgagttaccctgaccaatagaggcacagaccagccaacacaaacagggctgtttgcagcaggctctgagcagggctggcccgactggattgatgcatctttttttcttcatcattcttttctttcttcatttccaaagtcgttgccatcacccttgttggccagaactgtttcagtgatacccacgtggcttctcggccttctctccaccttcacctcctctcctcccaaagctaccagtgtaatctttgggacccgcatctgatcttgccacacaccaatggcacccctgcagatcctcttccctccctaggggtgccacgaagcttcaagacaccgcgcctttgtgcataccgttccctcacctggcacccccaccacctttgctcaggctgaggaattcctaaccacctatctacagactgttaaatgttgcctcttctgggagttcttcccaaataaccttttcctgccccacacagcaaaacgaatccccccttgcgttctagaccttccactggaacacctgctgtgcagtcctgggcttggctcacatgcactccctctacgcctctgagtcagggttatctgagcgcgtgctctgcactgtcactgtacctctgaggtctacgtgaactgccccctgtgggctgtggtgcaaaacctgtgtatgtggtggggtattatagcctttacgtgctgttgttcacagagtcctcataacaaccttataacgcagctacaattattatcccccttttgctgttaaggaaaccaagactcagagaggctcatcaacttgtctacagtcacacagctcctgagcagtgaagccaggattcaaacccaagaaatctaagcattctgttaggccaactctgaattcctgcatggtgacagggaccatgatttgttaatattctagcgccatgacggggtacaagtgcttcctgggtgagtgcatcgacaaagaacaacagcacgaaggcacagtcagagcctcacggccagacctttgcctggctgccttgctctcctccttcagctctcagggatgcgtcacctcctcagagccagccctgaccgcctcagctaagcaggcagcctccccacgccccactgtctgtcccactttccttttattatctccacagcacacggcagtgcctgaacttatcccccttgccaatttgtccatccaacgtctcccccgctatgatatctatcctagtgagaacaggtgccagctgagcgcgatgattcatgcctgtaatcccagcctttgggaggttggggtgggagaactgcttgaacctgggaggcggaggttgcagtgagcctagattgtgccactgcactccagcctgggagacagagtgaggctctgtctcaaaaacaaaaacaaaaacaaacaaaaggagaacaggtgccctttctactggccgtggctgtatctgcagttcctaacacagtgcctgcacagagctgatgcgtgctgcaccctcgctgaatgactgaatgaaagggtgaatgaatgcatccctggctcctctcagatgctgccttcttcaccaggtactggcctctgtcaatccgtctggacagagctctcaggccagacagctgagaggtggcgtagaggccaccaatatgtcacagagttatagcaataaggtgcagcaaggctgagaaatctccataggtaaaagaaaatggagtcgcttatcctagtgatgaaactcctcgctctaaagccagcaaacatttcctataaagatccagataataaatgttttagacatctgggccagacggtttctgtggccaccactccattggagtgagaaagtgaccatctgcgaattgtaaatgaatgggtgtggctgtgtgccaataaaactttatttacaaaaacaggcattgggtcagatcacagggcatagttgctgactcctaatgaaatagcttcacatcaatgaaagaactaagtggacatctagcacagagtttaaacattatactggaatagaggttggaggtattgtatgcaaagtatttgtttaggaagattttgcctatttcaaacctgcataattcaaggctgatttttgcaaagaagcacacatcactgaggaattgttctgtatttctgtcgacaagctcgaatggcactgacttttcacgttagggaaaatgtggtttattatcaacgtaggcagcctgctttaaagtcacatgtttttactaattttaaaaattggggtgtgtgtagcatttattccaattttggtctagtgaaagtccatgaatatttgtcatattgccctagtccgaaatcccagaatttgaattcatataaaaggcagctctgtggcatgtgttggtctcgctgtctctcccctttgcccactagccactcagtgctcccttccttctgattttctctgcatatggaagagcgttttgatgtagcaggcacccaacacatgaccacacagaagtaaagcacctgctttacctctcagcttgagaaggagttagcagagcagcagggacctcagtaagacagcagaaagcacttttctctttttttgagatggagtctcactgttgttgcccaggttagaatgcagtgatgtgatcttggctcacggcaacctccgcctcctgagttcaagcgattctcctgcctcagcctcctgagtagctgggattaccggcgcctgctaccacactgggctttttttttttttttttgtatttttagtagagacggggttttgccatgttggccagagggtctcgaactcctaaactctggtgatccacctggcttggcctcccaaagttctgggattacaggcatgagccaccgtgcctggccagaaagcactttctgattataaagaacgtatagctgcgatgataaagaatgtagagctgttattctgattataaagaatgtatagctgtgattccaattataaagaatgtataggttctgcagtcttttcccctggaagtttgtttgtttgataatagttagtgtggactcagtccttcaggaagcaggaggaaagagcagagaatattcctggcatcctttcacacctggcatctaggaagggaaatgtcctttaccaagtatgacttgtgcttttctttttccatgcgctttaccaagcacttaaaattcactgtggcctcaccgcttaaccacatcaaaagcattttgcaatgatgctttttcctctacgaaacctgaagctgtaagtggacctgctattacactggtaattaagccactccctgggccagtggatacacattcaagacgtcaaaatatggtgcaacaggtgccttcctcagtggggccctggtggcctgactcccctgttccccttgataccttgttccatttcccacggatttgcctggaagttggtgggggggctacctgttgcagtcacccaggggcagacagtggctttgggacctcacccttccagtttcaaccacacccattcagcagcagctcaccccagcaagcagctcaccaaatagccgtgtggcgaccagaagagatggtttcctggggcactcactggagacaaagcaaccacagccatccaagtgctgccatcctgagtttatgatgccaaccagccctgggtggattgaaggaagtcctctgagtgaccaaaaggatgcctgccagtccctgtcatcccctgcccgctgaggcccagctctgctcagatgtctgccgtcctccacgggctctaagggtgcatcctagctagtctatgccaatcccagtagtctcctgtgatactgttctggccaatgagatgaaacagaaagtctgttgtggggtttctgggaacggttttcatgatttaaaaaaaaaaaaacattgtagagacacaggacaatgtgattcctctttttgatttccttttgttccactgaacaggcactgcttgtgtatgtgatggcaggagcagaggcagcaatcatgagcgtgagaggacagctggcccaggccaagtcaacaggctggaaatggcacagcagaaagaagaaatgaatccagagcctcgatgaagttctgagtttccaaagaaaccaaccctggaaccgtcccagctgcagaatttctccttctagaaaatgatacatcccttctctgttgaaggcatttccagtcaagtcttctgttacctgcagcctgaagcattctaatctacagagagcccactcctagattcttcctggatctggtttgtaagaattactcagatttaatgactttgagccatgaaatgatggagaaacaactttcctgggcaaaaaagggaagaggtaccagctctccccttctcttgtcccaaacccaacggctttagcccaaagggcagaggaaaaagtgtggagcagacgaagcccaggagcttgagcactggatgcactgcatttaatttccgagtgccacttgtccattcacaggcgcaaaccccaacccacaggagatgctggctactttatggttgcttagcaaccagtgatcacccttctcctgaactgcagtgcccaactttacttttgggggacctcctctacccaattctcagtaaagttagctcagagacgtctgacttcttcctggctaatcaggataccccatccctctggaaacagtggatggttcagaactaggcacacgacctgagccagtccaatgagactccacctcggtccttgcagggcagtctgtgaagggtgaagccaagacagcgagaggcagggccaggagctggagaatggctcaggcttaaaagtacagctggatctcagcttttcaattctgcgagccagtgaatttctccctttcttttcataatcccgcgcagcttggtgttctaccttacctatccaaaggaatcttaagtgaggcagctcccccatgagggacactgacccagacgctgggaattggattcagcttgcaccccctcaagaccgtgcattaagaccaaggtgcatttcttatgtatagcatggtagattgtggtagtgataatgtggttccccataaaattccttgtttccttctggtaatggagcccctctttcttccagggagctgtaccatgtagtagagatgaggttcaatgaatcttccctcccacaccctcccacactcacccaaagagtccaagaccatggcctgtccaattggaactaatccatccagagcggctggtttaggggtgagcccatgacccaaaccgggccactcatactgcttcatgggacttttgccaaaacacatggaaggaagggtctttcttaaaaggtgctctcagcttgacattgctggggccgtgtttgccaaactgggggaagccttgaagagaaggacgccgcacagaggaaagtgggggcacaaatgtgcgtcctcgttttccagagccagcctctgccaaagcgtcaccctttatactcccagatgcaggaaacttgtttagtgtaagccaatttgagttggatttttgtcacttactaacaagactcctaacgaatgcattcaataacaaatgcagcaacaccagcaaagatcagcacttgtgagtctccccgtggtagataccgtgataggatttcccatgaataatctctaattacccattgaggacacaactcccatcttacagataaggaactgatgttcagaaaagtgtcctaacacatccaaggctatctacaaggtagccactagcctttgtgagaattaggaaaaggtgccccctctcagaggaggcttctgagggcacagggttaggtggatgggatctcaaggtctctgtgcacattggagggaggagggaacccttccttgagccagacatagacccatgccagggtgcacggcctaggagtggggtgtgggctagatggcagccccctcgccccaggtagccaggcaccttggtgcaggtcacactcatgcagctgaaggaccccccccccagctccccagacccaaatgacctcacttatatgctatacaaccaagcctggaatttcagtcctcctcatcagttacagtccagccagagaaacacaatctgcaataggacataaatatatgaaaagattcagggagcttggaggcaagtccgaagtctgaaaaggaagctggaaattcccaggcaagaggtgacgctgcggtccggaggcaacacttcatcctcctccaaaatcctagttctgctctcaaggcctttcagctcactggatgaggcccgcccacattcttgaggataatctcctctactgaaaaccaactgattgtagatgttaatggcatccaaagaccttcccaacagcacctaggttcatgtttgatgggctcactggggactgtcacctggcagagttgacacataatgaatgcaggtggtctcgccactcagattcctctccaggagtctccagccctcatcttctggtgtggggccatggcctagactcgcctggcagggtcctggtttgccccgcctgccccagcgtaattagcagccccctttacactttcaataacgtcttgcttgcattgtggaagacagcgtggcaattccttaaagacctagaggcagaaatgccatttgacccagcaatcccatgactgggtatgcacccaaaggaatagaaataattccaccataaaggcatgcacgcgaatgctcattgcagcacgagtcacagtagcaaagacatggaatcaactgaagcgcccatcaatgatagactcgataaagaaaacgcggtacatatacaccatggaatactatgcagacacagaaaggaatgagatcatgtcctttgcagggacatgggtggagctggaggccattatccttagcaaactaatgctaaggataattgggtggaggacacaatcccacaaggcgctgtcccttgcacggccacggcagagggaatgaagaggctcctctttgcattggagccctgggactcctcctgttttccacatccctcctcagtgtgtaaataggtcaggagccagctccacacctcccagctccggagacggcagggccgagtgtgtgcagtgtccgtgcagaataagtcatccactgaattattgaagaaacacacaagggacactgcccttgaactgggaacacgtggaggctcctgtttggttcctgcctttatacagctcacactcttagggggaagcaggtgagcagaagaacggatgcaatgcctcacacccagtgccctgaacagggaagggagggaaagcccgggaaattcctagccaattgcaagacgcatggatcccagccccagtgaaacttaggacccaaggtggtcacagagggaagccactcactgctcccttcacaagcacagctgcaaggagctaaggctgccaggctggcaccgccatgctgccgtcttgggatccactgagcatgttaaggccgtgctcccaggctgagctcaggaagaagcgcaacacaccatttttgcttgactccactaatgggaaaccttgaaaccgaaagactggcttctcttgccttctaggccagaagaaccactcccgggcccaggagagatgaacaagcatccttagcataggccgcaggccccacggggaaagtgggttctctgaccccatgcaggctgggttgaaagtcaggccccgccactgactggctttgtgccccagagcctccgtttcctcctctctaaagtggaaagactatggcacaagcccgggagaaggattcgatgacgtgacacttggagaccacttggcaaaaggtctcgccctatttgggcttcccagggacacagattgcgtggcttaaaactgcagaaatgtattctctcacagccctggaggccagaagtccaaaatgaatatatctgccaggctgcgtacccaccacagggtccagaggaggctccttctgcctttgccagcttctggtggctccaggcattcctcggctcacggccacatcactccagtctcggcgtggccttctctcatatcttacatctccctccgtctttctcttacaacatcaccagtcattggatgtcaagcacagccggataattcagggtcacgtcctctcaagatccttaacatgattacttctgcaaagacgtaatgtagagctttttccaaataagatcacagccacaggttcccaggatcaggacgtgaacaggtcttttgggcgaacaccatttaactcgctagaagcactcagcgagcagctctcagaaacagtggctctgaggacagcagctgttaggattgtcagttctctgcctgtctctaccctccctaattctagggagaaacttcatttactccacaaaccctaggactccctaaacctagctggggtctctcctgcatagaatttcagaatgcttaaaaataaagctgtacaaacgtgtagatatgaaaagtcgtggagtgggtgccagctttttgccattggtcgtggtggcgttttattgtttctctcttagggaaaactgtaggatggagtagaagaatgagttttctggcagggtgcagtggctcacgcctgtaatcccagcactttgggaggctgagggaggggcggatcacaaggtcaggagatcgagaccatcctagccaacatggtgaaatcctgtctctactgaaatacaaaaaaaaaaaaaaaaaaattagctgggcttgatggcacacatctgtagtccaggctactcgggaggcagggaaatcacttgaacctgggaggcagaggttgcagtgagctgagaccgcaccactgcactccagcctggtgacagggcaagactctgtctcaaaaaaaaaaaaaaaaaaaaaaaaaaaagaagaagaagaagaatgagttttccatcaaaatggacagccttggtccatggtcaaaatggacagccggcccaggcttgcctggtggccctctaagcagaatccaatccctgctgaccgtggcctcttctgcctccggggtccaagccaccagcctatctcctctgaaccactgtggctgtctcctaactgtttctctgcttcactctttccctgccactatgtgtccttgatgcactagccagaagggtcctgggaagactgaagtcagagcatggctctcgtctctccagaaccctccgtggctccccatttcactcagagtcaaaatcaaaaggcccatagacgccatcatggcccgatttctttccctcccacttcctctccacacacctcttctgtcagctaccttctgacgctggcccctatgtcctgacttccagccattggccccattgttcttcctcaaaaaccccaggtatagtggcacttcagggccgtggcactggcagacaccccattatcccagcaggcacttctagaagtgccctcagctctctgcacccactcctggtgtctttgctcagtggtctccttctcatccaggccttccctgcccatcttgctaaaactgcagcccccctttcctagctctctggatggcatgagccgctcacctgccccgcacgccacgcaccgtggaacaggctgtagcacgcacatgtgcagaccccggcctatcgcctcctcctactggaaggtgaactccatgagggtgaagacatctgtccttctatcccctgctctgttttaaccatctggcaaagcaagcacactcagcgcagcacttattagaagggagggagcagaacaactattctgggactgacttcctgctggaggaggaacagaaaataaatacataagcagatgagtaagatcatcgacgggcagaaaaagtaccacaaacaaaataagagtaagactgctccgagacaaggggctggggagggggaacctgagtaggaggcagcctagtggacgcgtcacccaggagcagacatcgttcagccatgaggaggcgggggatgcagcctcctgatgtgtcagctctgaaagctaatgactgtgcctgcgtgtgtgcgcatgacatgcgtgagctgtaagggcagctccataattagattatatatgtgtgtgcgtgtatatatatgtctgtgtgtatatatatgtgtgtatgtatatgtctgtataataatatgcatacacacgtgtacatatatataacctatatatctctctatatagattatatatgtgtatagtatatacacacatatatattatatatgtgaatgtgtgtgtatatatgtatatatgtgtattatatatacacacacacatatatatgtatacatatataatctatatctcagagagagagactgacctgccagcagatgggcagacatttgtcagacatggagagagtgtctttattcctaaagttggtttctcagctgcaagggcaatggccaagcccttcccaatcttaccttacgaaacaagggtgacaggcattcagggatagcaaaacgatctttcctatcctattttgggccttagagaaaagcgtaattgtgcatttaaactgttgtttgggatgagggcagcagagcacacagctgttggaaccagtttctcttcatgctatcacatgaggctggagcctgaactatctctgggaggctgcagaaagtgggaagggagtttcagatccatgctggaagaacagggaaaggctcccgcagggctccgggtggtgtctgccgctgattcagcaaaggacttgtcctggacacggggcatgtgggagctgagcacgggatttcaggtcctgcttcacctccttctcatagggaagaagctgtccactgctcactcctggttaaattcaaggaagaagggatacacaagtgtggcagccctatagaaaagagaaagactcgtaagtgatgctattagtaagccatcttggcttccggccagtgaagacaaatgaatttaacaaagaaaagtcaactaaccagaaagtttacagaccagtgaatcccacagggctagcattatgtgccaactcggttctcagagcttactgagttatctcacttcattcctaccccgaacctgatcaagtaagtgtcattgttcccattttacagcagaggaaacagaaagaatctcagagaggttaagtaacttgcctggggtcacacagctgaggacatgggtaaaccaacacacattaatacctcccacattgcttcttccgccatttcctccctgtttgtggctccaaagaatcccttcagacaccatcacggggaatatcaacatgacaggaaagtggcagcctcgccccaggccaggagcccctgaacaaagccataaaccaagacttgatctttgcctggctccagacaggacagcagaacggggtcccattctgaaagtcaggctccatcacaagtacccactgtgcttgcatctccgtggagaggcaggaggccaggcgtaggcagctgagcccctgggggagtggaatggtgtcggctctacccccagtagccccgtggcctgggtctagtgactcggactccccagccccagttgctcctctctgaaatggaaatcttctctggaccagcttcctggggtacctatgaggaggcagtgagctgcttcctatcaaggcttaaggcagcacctgtcaaatgcttagtcagcctcggctcttgttagccttttgattatttgcttgccttgattatcagcttgtattactgtgtgcctgacactgacatgtccccaaactcctccccacaaatgtcacattccagtgcctctccttattgtgctctctccctccatttatattgcatttcaacaataataaccgctactcatcactgagcacttatttggtgcttggtattgccatcaacgcttccaagtgtgttatgacatcatcctcatcgtgccttgggaagcgggaactctgctggtcccattttgcagatgagaaaaccgaggcagagcaattagaagtggcatatctgaggtcatggggctagaaagtggaagagggggattcagacccaggcatccgggtcgtttcctccccagatcatcactgtggtgcggggctgctcaggcgtttggtgagtggctgcagattcagagctcacctaaggtgaaaagcaggaacggggttccttctcatttctttgtaaggcagagccaagctcgtgggtgtccccactctgtccctgaagggatagtttctctgtgtcatctttgcctcctctgtcacccatgcaggggccgcaggcctgtgatgagctgacccactcagctcccagaacaggcaaaagggtcccagggtgcaggagggaagccgaaagaaaacagatgggaaggggagtaattaaatcagcacatcccaaacagctaagggaggggacaaggagcaaagcaatgaagaccaggtatgaagtctgaactcacagaatgggcacgcgcttccgataagctgtccgctcaagctgtttggaatacaaacaccaaccaaaacaacacacgcacacactcttttgtgtcgtgtttctggaattctgtgatgtttcttttctcatatattcctccaaaaacagtccagtacagaattgcaggttgaagcactgtgaataggctctaggtttgccccaggttaagggttaatttgttgagtttcagaacaggtaggcgacgccctcctggattttaaacagataacgtccttgccatgtaagagcacttagaaggctggctttatctctttaaaaaaaaaatatatatatatatatacacacacacacacacacatatatacacacacacatatatatacacacacatatatacacacacacatacacacacacatatatacacacacatatacacacacatatatacacacacatatatacacacatatatacacacatatatacacacacatatatatacacacacatatacacacacatacacacacatatatacacacacatatatacacacacatatatacacacacatatatatacacacacacacacatatatacacacactatatatatatatatgattgtgtttgttgttgttgcagttgcagagatgaaaaagaaatctgtgtctttaaatgaggaggggctgcgtaaggaggcttgggcagcaaaaaggctaatacgctgtggaagagaaggagtttaatctaatttagttggagggtgtctgtctgcggtgttgttttttggagtgtgggaatagaggcgggaagctgcccccttgaatggtccctcctgagccaggagcagtggggagccagtcgacgccagcgatccaaagcccggccttgaaagaggattaaatcaatgctctgatttgcaattcacactagtgcaccccgtggaacctttggtaatatttcaaaccacatttcaagggaagtggccttaaaatagctgcctaaattgtgctggagccacactggacaccccactcatccactttaggatgggggtgcttcggggttcatttctcaccttcccccaaacctccacatctcacagccagtgtttttaggcagaattaaaacttttgcgcctgttgaattcgctgcgacttgcatggcctttctggtggtacaaactgtgttttctttgctaagtatcacttcagatcactaaaggtattttccctggagaaaaagatgggggcacgccacggggagcatgcctacttgatcagaaaacataattttttgtgcatgttttatatctgataagtttctgcagaaacttgatactagatgaggtcagagaaaacaaggtctattcacatcagacttccctgcatgtgaagcaattattggtaaatagatcagttttcattctcatacttgaaggtagaattggaaatgtcccggactaaatacaaacattgacgacacgagaagacaagagaagaaacacaagaatcacttacgtggatcctcacacttgaatgtaccaagagaggtgattcaagcagcagctactgaaaggcgttgcgacagcctgaaccactttttatctcaacattcaccagcacgattttacttctgtttatgagctttcttcctatgccaccagtttactcttgcaattagcttgtaacatgctaagcttatggtttaatttctttctgttgctgaaagactcagtacttttttatcttaaagagattatttgggttttctctaatcccatttcagaaaacctcgcacagtgcttataatttccattgactattacataataagaaaagatacaactttgatttttagcaatatccgtgtcaaagtacttttatacttttgactttgtgagtttaaatggaatgaaactgggcctctctttcaattcccctccacctccaaaaaatatttagttcttgttcaaaacactgcctgactcctgaaatattctctctcaaaaacctcatactttccctggtgaacgtttgcaagaacctgaaggcggataatgtttactgatagctttccgatagacagacatttttaggtggttgggggtaaaaacatattccttgtctctgcacgttatgtgaaatcatgtttaattataaagtttcattaaaaatctttgctcaaaattttagaagcctaataagatttccattaatttaaacatatcactattcccacgacggctccaaagctttcttttccgtctttcatccatggttaaatatgtaaataaaatgtctaaagtcattcttcaaagaagacaaaagaaaaaagagctgagggaaagacagccataaaattcctcccaattctccataacatttgccagaggggggtcggttgccagccagggctgagcagcgggggaccccggctgctccttagactcacacatctcaaatcccacacacaggaaaaaaaataaaataaaatatcttttcagctggggccatcaaaagagccttttcatttattagttacagacttatcttccagttgctgatttctcagaaccctcatttctctataataaagtctatttgttggtttccatctcagctggacagggcgaagcacttctgcagacatttttataaaaaacgagagaaaaaggcaatctgaagtggttatagctaaaataatgggcctgaacgtggctgaattaaaacagcacagaaaagatcaattaggaggcactttctcaaatagctcacacccagctcccggcgtttggctctcactcttgcactaaatatttctaatagttgctgagggagagacacaaaaaggaaaagaaggaaaatagggcccaggaaggacctttgccaggaaaattctagaaaagccaagtgatttccgctgaattaattttaatttaaaggtcctgaaaaattactcactagacaaaaaacaacaacaacaaaaaaaaaaacactataataaaaatggcagtctttcaaaaataaaatcatgcaacttttcacttgggaaataacacagttgaaggtggtgttctaactgcccggagtttctaccttctttttcactttctccctcaccccgacttcctccagcacctcctagtgagacccaggacacccagggacagcgacccaggggtgggtgcctgaacctgcctattaattctgggattctgggcgctcaaatgtctgttgaacggatgaatgaatgagtggaaaggtgagatttccccaagtttcttaccgatgtaaaaattgtagggcttgttttaattaaaagccaatactctccgaggaagtggccccctcctgcacggcgtgcagaaagctggtcagtgaggggggttcctggcgggccccatctccttcccgggcgcttcctagggagaccttgccccgtgcgcagcgtccccaccgcgggggcccgtgcagccgccccccacgccgggtggagcgccgccaacgcgggaagccccagcactgcctccaaagatgtccgcacactccaccctgctccctggaactatcctcaaacgggcagggggcaagcgaggccggtggacgcgggactcgctcctctgacctctccccggccccccgggaggtagcgggagattgcacacgcgatcctgcgagtttccgaactttggaagatcgtgacccggagagaccctgggaggagagggccggccacctcctaggggtgctgtttttttaagggtcaacccaggacgctacgggaagcacctggcgcatccttgggaacagtggggcttggcggtgggcgcccaccgcgaacgccctgggcgggggaagggaatggcggggggacgtcgtgtcctaagtgaccccgtcacagacccgccccaatccgaggggggatgagctcagaggacctgcccaggacgctccttctccactttccaggaaaaccgagcggcgtgcgcgcctccgtgtcctcgcgggagctgggggtccccgggcaggcgctgacgcgctcctcccacgacccactccatcccaccctactccgggtcctcctgcggggctgcagccaaggagggcgctggccgggcacatcactcgccaaatcacataaataccccacgagcgaatgacttcctataataaataaactcagccgccaagaaggcatctccagccctgctggcgcgaggccccggctctgcggcttcggagggggcgggggtcaccgcggtacaaaccaagcccgcacttcccgcggggtgggaggcggtgttcaaagtcccgggacgcttcccgcccctcccccttcccgccttcttagaggagacctcggatgagcggccctaaaatccggattctcgagcccctccccctccccttagctcgtctctttgaaatttcaaagaaaatccctcctcggagcccggagcccggggctggtagcacctccccagcctcaggaagatgcgggcaggtttacaagcaagggcctactttatggcccaggctataaaacgcaaatcccacctccctttgaaagcgccctccgcccgggactcaccataaaaggaagagaagatgcaccccgcgcccctcgccgcggaccacccccaaaccccttctcccgccagtccccgaacttcccgtaacctcggcgtcctcggggtgccggggaccatcccggggaccgccgggaaagggggcgccggcggagaggatagcgagaggcaaagttggaggccaggcagagagagggcgaggagaggcgggcgggactgccggggagggtcgcagcgcgcagagccccgcgcgccaggcgggctgtcccggggctggcgggcgacgcgggcgggactaggcgctgcgccccccgcaggctgggctgcaggccgggggggatcggcccccgcggggcccgggagcccgcggcggggcggcggggaggaggctgccccgggccgctgcgctttctcatgcaaagcagcggcggggcggggcgcgcggcccgggggcggggcctgtcagcgctcggcttttctgcccccctttgcctttttgcgagtcttctcatcccgggacgcaaacctcgaaacagctgccggctggtcccggccgaggccggcgcagggagggaggagccgcccgggctgtgggggcgccgcgagctgggccggcctcggtgtgcccgcgccgccagcccgctccagacgcgccacctgggcgctccaagaagaggccgaagtttgccgcggccgtgagttggagctcgcgccgggccgctgcgccgggagctccgggggcttccctcgcttcccggtattgtttgcaaactttgctgctctccgccgcggcccccaactcggcggacgccgggcgcggagagccgagccgggggcgctgtgcgcagcgctcgggccaggccgggcgggcatgggcgggggcccgagcaggggtggagagccggggccagcagcagcccgtgcccgggagcggcggcgctgaggggcgcggagctccccgcgaggacacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttctttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccctaaatatacatctgtgtatttgagttggctttgctacccatttacaaataagaggacagataactgctttgcaaattcaagagcctcccctgggttaacaaatgagccatccccagggcccacccccaggaaggccacagtgctgggcggcatccctgcagaggaaagacaggacccggggcccgcctcacaccccagtggatttggagttgcttaaaatagactccggccttcaccaatagtctctctgcaagacagaaacctccatcaaacctcacatttgtgaactcaaacgatgtgcaatacatttttttctctttccttgaaaataaaaagagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttccacaaacagatcaggaagcactaggttggcagagacactttgtctagtgtattctcttcacagtgccaggaaagagtggtttctgcgtgtgtatatttgtaatatatgatatttttcatgctccactattttattaaaaataaaatatgttctttagtttgctgctagtccctggttcatggtgaggtttcccttctctgtgtgtggagagactacaggacactttctccctttgctttttaagcaaattctggggttgtgcttctagccagagagtactggttatctgtataaaattgcagatcagaggattccaagattggaagaatcattcacttgtgagtttctgaggaactgcagtcaggcaatgtgtgaagttggaagtcgtttctgtgactgttggtagctggacatgagggcttagttgtagacacacatcaccaaggagagcctcaccactaagcgtggacccactcatgagcctggattagccagttttaatatattcagagagtagagccaaccgattaggagaattaaatcatctgtattcaattgacctgctaggctcaaatggtacctagacagagctgtatacatcagcccaaagtgtgctggctttgcagtgactctgaactatgaagacatttacaaaacagattatagacctggacgggataaaatacctgctaagggtggcgaatccttaagaggaagttaagcagctttggaacttcatggtacttggttcttctccagggtttcctgttagaactgggtagctgtaaagaactgccccaggtctgctggtcaaaggcacagctacactcaagttccagccagaaggaagcaagggcacagtgcagtcctactgtggtgaggactctattaatataaagcaagccaagctgcccctggggccatgcttttgtccagctccaagttaaacaaggagctctggaaaacttggagcatggatgacacgcttaccaacgaggaggagagcctggagctagtgcagtctgttttctgaagagggtgttcagaacttcagcctggtaaacataagatcacccatcaacactagggctggaaacaggcttacattggctttgaggggctactgcacttggccgtgaatatttgcagggcacaggagcaggcagatcggtggtttgggatcaagtttgacaaacggaggaaacaccagctaggtaggcaaagtaaaagaatgcaagatcccaaagagctttcagtgcattaaaaaagaaggcagaaaagcttcagaaatgcccccaaataaaatttctttgttgattgttttcgcctagtcccccaaaagactacatagaaatattgatgtctctgtgcatgtatgggtatagcgtttcctttttgtcactcttagggaaaatgaaaataacatatttggaatagaactttcaaaaagtccagaagggtaacattgtccggatgctgctgtgagccacaaggctagatataacacaaagacatttggttctaaaattcctggactacagcagcttcagacctgcccatgctcaggtgtgtaggctcgaaaatgtggtcccaaggaaagtcatattcaacaacatacctaagagcctttgttgttagttatccctgaatgtgtctcactgtggatccatcccagaaatgactgatcttgtttacgaatgtgaagggattgtgacatgtggctgggttgggcgcagctgggtgagtttaacagtgagcagtgcaaggagcagctgtagagcttccaagcaaaatgctccaaggtcttcctctccctctctctctctcttcctctctctctctctctctctctctctactaagctgaaatctgaccctccctcacatacagacagtgagttttaggagaagcatcaaggccttaagtcagaaagctggggaaaaaaagaaaggaaagaagggagggagagagggagggagggaggaaagaagcaaggagaaagaaagacaggcaaacatcactagtgaaggaaggaaggaaagaaggaaagaaagaaagacaggcaaacacatcactagtgaaggaaggaaagaaggaaggaagggaggaaagaaagaaggaaggaaggaaggaaagaaagaaggagaaagaaagaaagacagccaaacacatcactagtgaaggaaggaaggaaggagaaaggcaaacacatcactagtgaaggaaggaacgaaggaaggaaggaaagaaagaaaaagaaagaaaaaaagaaagaaagaaaggcaaacacatatcactagtccttagattctctttagctcagtacagggtttccaaaggaattgttgacagcattaatttggagatttctcagcatctgtaccccacggccttagttttagaaaaatggcaacctgttttgcatggcagtggtggagtcatagaagaagcccaaagaagtagattgtccaagatctacatccattcatccctcccttccttcctccagcctccagccaatcaccacccaccacatgctaaggccgagaaacagaactggtacctggtctgtgtgtggttttgcagtggacaggagagacctgcatggcacatcttatatgcgcctctgtgaggcatcagggcaggaggcccaaaagtagatgtatttccacagggcccctaaatgcatacaaggcagaagattcagcctatgtgaggtcatagcaaggggaagctgcagggtcatatagaaggcaagagaagttatcaacagagcatcaaaacattccatcgggacccagactgggtctggctcatgatcccctatgtaagcccacaccttgcagagggctttggacgtagtaagaataactacaataatagcaatggctgtgataatagtaatcgtagcagcacagccttgagaccacttgctgtgtgctgaacaggctgctgggactatctcagtgaatcctcaacgcattcagggaggtactgtcatcagccccactttacatgtgaagaccctgacacagagaggttaagtaaattcccagggtcacatgacaactaaaagacccagaacaggaactgggtggtctgataacagatctggaacccccaattcagtaagcaattgttgaataaatgaatgaatgaatgaacaatagctgaccactttacatgcattaattcaatcctctgacaaactttggtggtactgctctcatgctcataatattacagacgaggaatttggagcacagagaagttgtgtcacttacccaaggtcacacaggcagcaagcagagagtctggcatgcaaacctgggctgtgggactccagacctgcacctctgaccacgaggctttcccacgtctctggtttctcaggacttgactaaatcatttcatcttcacagcagcactgctgcacctttattccaagcaaaaggggaacaaggttgcatggcaaagagcaaaagccacttggccagtgtgggggagcccaagggaggaggccgtggcaacctgcatttttgcagcagtcgcgagggtgctagcagtggggctagggggaagcaggtggatggagaggtccttagaaggtagaaccaggattaggttttatgtagagagggagcaagaaggaatggtcagggaggaccacaccatttctgactttggtggcaaagtgacattcatcaagacaggagaaaaccaacagaggacaggcagtgtgatgggaagcaaagatgagtgcagtgtggattatttgccatcgaggtgtctgtagagaatttgggatgaggtcatggtcacaggcgggtgtttgaaatggtgagagttggagctgtggttaacctcaggaagcaagtgggtctctccagggacagaggagggaggagggcagacctcagggccaggtgaacaaagaggaggttgcaaggggagctgtgactgggagcagccccttaaccacttgggcgctgggtgcccatttttactataagaggattggcagaggagattatgcaaatggccttatccaacgtcaaaatacgtgatccggatagcactaagggggaatgcagcaagggtcttacaggagtgacttaggaggatccactcctgcccgtgataactcagcctctgtatctttaacttaacccttgggctacccgagcaaaattaaaatcagctccaagagctcatagttttaaattctccactagcatctttggggatgctgtttcaagacagagaaacagaagagaaaaatcaagaagtattcctgaggccatagatattatcctacattctagattattttctcagaaggaggagaaagaaatacagaaaacgataacagattggagtgcaaactggcatcttacacttaaaggatgtgcagatataaacatcgtttaggactgaactatatcttgccttctctatgagctggtttttagtttgactcaaccacttacacattgcttcaccttgagcaagataccagaactttcctgcctctgtttcttcatctgtaaaatgggcatgataatggtacctatctcactggactgtcactcacaaatagctcatgcttattgaacaagtattacatgctcgattgctttaagttctctgtgtttattaattcgtctactcctcacaacagccctaggagagatggtacgagattaaataaaaccatttgtgtgaagtacttggaaggctgcttggcgcagagcaaatgctcaataaagtgatctatttttatgttttttgtccctccccccaaagaaagttaaatcctgtaagctaatgagtagggctctttaaagaaaatgagtttttttcttacagaaacactttttccaatactgtgttcaggttccacagaaaacccactgatctttcaagtttaaaaggcaggcacagagcctctacagcagtgaaaaatattctctgtctttccctttgaacacaataacatcacagctgacttcccaggaaatcagacctcatgcacggacacctctatacgcaaatggataaagatggctgtaatatggaaatgcagagaaacggtcagacttcagggaagctcgcgaaacacgtgcaggcagcatagtgtggggtgttttttaatgttttattaagagtgtgaaggccaagctggagggaggagggaaggagacgtttgaaatctgaaagaataagtttcagctgccgaggtgagctgtcgtaattggggacactcctaggaaaatgacactgttggatcccacacaatgtccgcagcccatccggacttccccaaagtcagtgcctgtcgctttgttattctaagactttctgaatgtttctgtttttatatacattgtttggtaccaggctgccctccaggggcctttggtttataggaagggattcataacagcaacccttgccacacgcccatctccttcccagatgctgggggcttcaggggttctgtagatgggatgggatgttcccaggtggtctcttgcaacagatgtcctcaaaggatgcaatttgtggcattttagggaatacttgcacttaaaaaaacatctaaaacctatcctaacaatgttttaagtattttaggcagaactacaaagtgatcgaccttgacatgatgaatcaacacccattttccaagggggcgatggtgatcgggagctgcaggtgctgactttgatcagaactgacaagctcatggggtggtgcagctctctccccaccccagccctccccattccacccctgcccccagggcagcagcacctgtttacctcccatgctctccctgcactattttcgcctctcataaaacacttggatgttgttggctctgaataagatcattcatctgcgaactgcctctcttcctgcagctcatctgaaacagtcttattgaacttgggtcaatatcacctcggtttctttggattccaggatcacagcagaaggctcaaatttgaactaaactcagaagcattttaggtcagcaaaactttttttttccccaagagactttaagtattaggaatctaagtgccaccttacttttccacacatggcacagggtaaagagaacatgagatagccatgaagaagttgtgattctgatttgctatcatgatgacccaggtctaagaagacagaacaaaagcaatgagaacaagagaacacggccgattataacatttgacattcttccatggcagtcatgattgtaaccattttcaattaaaagaaaaaacacaatactacagcaatgttctgagctgaatcttatctcttgagtaaacagagggcctctgagcaaaaaaccatgcaatagaaaggaggcatcaaaagaagttggaaatgtagtatttttatttttaactcacctctaccttctaaaagctttattctttccaagacaaaaagcttcacgcatgtcccaggggatgagccaagaaaaaaaaaaatcaggtaaaataatccctctgggtcaggggcgtgcatgtcactcggtctggtcagtgagatgtgaggggagctttcctagtgagacaaaaaaaaaatgagggtgtgcgtgtgggagtgaaggaaggttctaataaaagattttgcttcatgataaaaaaaaaaaatgatgaggaaacctgtccttttcttctgcacacaatgtggtgtgtgagaatcacatatggagctattgcaaccattttgtgaccacgaggcaatacgcccaacaccaaagccaaaattctgagatggcaggtaagcaagacagagccagcctcgtgagcactcattaagcgactgcacccccaggattcttgttatgccaagtagccaacactgcctggatcccctgagagttgcaggttgggtgttctgtgcctcttaggaaaatacacctgatgtggcaaatgagtcccaggtgtctcaaaccctactgtgcacacaaatcactggggctcttgctaaaaggcagctcctgattccttaggtctgggtgggaccccaaattctgcatttgtaataagttcccagttgatgtcgatgcttctggtgctcctgacccctttgagtgaagaatctatttggccacccaccagaagttcagaacgaccccacttactcctggctgtaattatatgaacacatcttgggcatcacttcctgggtgtcctgtagtggactagctgtcaattaaaacaatttcttatgttgagttaaaatttgcttccttgtaactattttctattattatctctacttttgccacatagagcttcacagagcaagtctacttgtttttccatgggaaagccacttatatatgggagcttatcacaaatgcagaatttggggtaccacccaaacctactgactcaggagctgccttttagcaagagccccagtgatttgtgtgcagagtagggttcaagatgcccaggactaatttgctatatcaggtatattttcctaagaggcacagaacacccaacctgccaactctcaggggatccagagagtaatatgtgctccctggatctttctttttattcttaaaactgttgcccagataacttggtttcatcttgctggctgtcccctgaatgtgtttaccatggtctcaattcttgtcaaggaagaatgtgcccaagtaaagacaaatctccaggaagcatctaacaaggagtgggatcattagacacccagcaaatgttatacaagataatgggacactaaaagcatttttactaaaaccagagacaaaacaaggctatctatgattactggtcactacccggaacatgattaaccctgaagtcagagaagaggaaagaaaaaggaaggtaaaaccattggaaactgtcattatttgcagctgttgtcattgaaaagtgacttagctggaaatagaattgatgagattttcataaggagaccaggacaaaacatagctacaaaaaccaatagcatcctcatgcaccagcaggaaccagttgaaaatatgaagaaaatttaagatcacttatgcaatgcctacaacaagcacaaactatctagaaattaacatagggggtgtgcaagccttttggaagacaatgtgaagatgttactgaagagcataaataattggctcaaataattggaagctcatgtcatgtgcctgtaaatatgtcaattatccccaagttaattcctaaacataatgcaattgcaactttaaaatatgtatttctgtggaactccacaagatgatattaaatccataaaatttgagcagtagtcaaggaaaaaaccctggaacagggataagaaaggacataatctatcagtgaagtacactgtgagtctgcagaaacagacagcatgggccaagtgttaaaacagacaaaataatggaacaaaataggaaatccagaaagagtctcaagtgcatttcaaataaataagaaagaatggattacgcagtcaatactgttgaggcttagtttagatgtggggaaagtaatattccatccccacctcatgcctttcaccaaaatacatgttggattgataaaacatttaaacataaaaataatacagtaattaggggaaaatgttatctaaagttttcattcaatagaaagaaattacaggtaaacattttttataaacttatcaggaaaatgtcttcttagcatgacatcaaagctaaagccattttttaaaaatcataatttcactacataaaaatgtaaaattctgtaatgtaagaaatcagttaatttaaaaaaaattgcaaaatctccataaacaaaattaaaagacaaaaacttaagtttcttgtctgggtctatgagtaggcaattcaaattagaagaaatgctagtgacccataaacctgtggaaagttatttaagctcacttctaataatccaagggtgcatgcataaaaaaatgattatttgtgcctaacaggtttccccgttttttttttctttgagacagagtctctctctgttgcccaggctggagtgcagtggcatgatctcggctcactgcaacctctgcctccccagtttaagcaattcccccgcctcagcctcccaagtagctgggattacaggcgtccaccatcatgcccgtctaatttgtttgtattttcagtagagacagggtttcaccatgttggccaggctgcttttgaactcctgagctcaagtgatccgcccgcttcagcctcccaaagtgcgaggattacaggtgtgagccaccgcgcctggccagcttggtacttttttttttttttttaaagcggataatacctggattttgctcaggcatggagaaatggactccctgtatcacagagtggaaccataaagtagctcaccctttctggagaacaagtgtgatgtgtacctagtgccgtttgcagtatacatgtcctttgacccagcaattccacttccaaataaatgttgtattgaaaattgggaacagtctaaatatataccggtaagctgactattcaagccaattatggaaaatccttaaaatagagtaacatgtagtcattaaagtaattacgtagaaccgtgtcattaacatgggaaaatggccacacggcactgctaagcaggctgatcttcagacaggacggaccagggcagcccttccagtttgttttgtctggtgtgtttttgaatttgtccacacccctatgccaaatcagttgttgaacatttcaaatattgccctgttgttactacacaaagcaagttatataattcctgaataagacaagcctgggcaacacagggagaccctgtctcaaaaaataaaaagaaagaaaaggaagagaggagggaaaggaaggggaggggtggggaggggagggaagggaaggggatggggaagcaaaggaaggccgggtgcagtggctttcgcctgtaatcccagcactctgggaggctgagtgggcagataacttggggtcaggagtttgagaccagcctgaccaacatggtgaaaccccgtatccactaaaaatacaaaaattagctgggcatggtggtgggcacctgtaatcccagttattcaggaggctgaggcaagagaattgcttgaacccagaaggcagaggttgcagtgagctgagatcacaccattgtactccagcctgggcgacagagtgagacttcatctcaaaaaaaaaaaaaaagaaaggaaggctggcagactttgcagtatctgcttattccggagcaagtgttaaaatggtgtctgtttcatgagtgggcatgtgcaggttgccatcctaatattcatttcaccccttttctctttgggtatccatgcagctgaggcaatgttgtccccaccccgtctccactggctcacttccttgagatatccacaaaggtgggcattgacggaaaccaacccaatcagtgtgaggctcaggcatgggtgggcacagacaccctctcttcctctgggtcacgcagcacaggacgtcgggttcaaagggcctctgccatgtttactatttcaagggcccccgatcccaggagaaggtcaacacttggagtggggctattttcagaaactccgacactaagccatggtgacatgacacacctcgaatcaaacagtgcctggataaaatctctcctgtgcttttcagtccataaattactttttagagacagttccgtggggttttctcttacttgcaaccaactgagacacgaatataattgtcacaaaagcagctgcctcactaggcaggagaccagccaggggaggggagtcgattcactcagggtgttcgggttctttgttattccacagtgaaacacctcaaaactcagcttcctcaaatgactcttttattcatattcagctcacaatttggcaagtcaggaatgttgtcaggcattggctgggtcatttgtctctggccaccttggcaatggctggggtggctggggctggaggatacacttctgcttttcatttcactcatgaacttggcctcttgctgccaccttggtctctcttttcccccaaaccccacatggtgtcgcctcctcttgggccccctcacctggctgtagcttgggcttcctcacagcatggctggctcagagtagttaaacttattttttattttattttattattattatactttaagttttagggtacatgtgcaccacgtgaaggtttgttacatatgtatacatgtgccatgttggtgtgctgcacccattaactcatcaagagcagttaaacttcttacacggcaattggctctgcccagagagagcattctttaagagaaagaaaatggggctggccagggcactccctctgccatgctggtttttttttttttctttctttctttatgagacagggtcttgctcagttgtccagggtacagtgctgtggtgtgatcagagctcactgactcctgggttcaagtgatcctgccaactcatcctcctgagtagctgggaccataggtgtgtgccaccatgcctggctaatgtttaattttttttgtagagaagggacctccctatgttgcccaggctggtctcaaactcctggactcaagcgatcccttgcctcagtctccctaagtggtgcaattacaggcatgagccactgcaccaggcagccccaacctcccaggctcagggatcctcccagcttagcctcccaagtagctgtgactacaagcatgtgccactgtacccaactgatttttaaaattttttgtagagatggggtcttgaactcctgggctcaagccatcctccctcctcggcctcccaaagtgctgggattaccaccatgctcttttgacaaagcagtcacgtagcccacctaacttcaaggagagggaagtgagtccctgcctctcaatcagagaaggggataggaccctgtggcctttcttaccacccgggacagggtgcccctaaatccacaaagagaaagagcggaaacggcctcctttcatctcctgccccggacgccccatcttttgttttctcataaaatggcaacagaagttgattctagatagaataattaactccttcctgccacagtgatcccgtccctgccttttgcggcacgctgatttttaaccagaggaacttctccttgaaagatgctgctgtactgcaattttgtcaaatgtgctgacagtttgggagccgctggaggactccggatctggtctccaggcggacgagggacactttttgtgggctgagtttgtttactcctggaaaaacctggcttcctgtttctaagggggaacaggtttaaaagtcctcataaaaaaggctctaaggccccttcacatcaaatggctcttccacagtaacatttgatgagttaagtgtaaaggaatcagaaacataaggattaaatttccttgcagatacacataggttataaattagggggggaagaatcatgtcaaaacatgttttggcatttcgccaagactgaaaagatttgaaaaacggttttgagatggtagatgtaattgtgttctctctcagcccatccttcccggtttgtaagatttatttatttttcagtaaacgtcggaagaattgtagacgcgcgtggagggaagtggttctaattcaagttactgagattttaaaggtttattcctgagagatggtcctggatggggacattcagcattcttgttttgtgttggttttaattgagatttcaaagaaaggcccgtagcttttatagctttcggtatgtttcttatttagattaagggcccaggaagcacagggctcgttaagttcagtggtctatccgaggatggctgcctggcctttctctcacctgttttcaagagatttatgcatctgcaggctttacatttcatcatggatggagcagattctctgcttcagcagatggacaaagaagttgaagctccgatacttaggaggtatacagaagtaaaaccagagacgtggggatttcagcttgagaggatatttctggagaaatatttcacgatctaggactgcaaagatataaacacactttttttttttttaagattttcatttaggaaaccttcacgaatctaagacttgttaaaaatgggtccagcagccgggcacggtggctcatgcctgtaatcccagcactttgggaggccgaggtgggcggatcacgaggtcaggagttcaagaccagcctgtccaacatggtgaaaccccgtctctactaaaaatacaaaaattagccgggcgtggtggcgggtgcttgtaatcccagctactcgggaggctgaggcactgaggcaggagaatcacttgaacccgggagacgaaggttgccgtgagccgagattgcaccactgcactccagcctgggcgaaagagcgaaactccacctcaaaaaaaaaaaatggtccagcgatgctgtcaagactggagtttttgtgtacgcctgtgcagctgacccacataatttcttgagttacttaaaaaagacgacgagttctgagccaactgaagagcacaagggacaccacaggggccacccagagacctggatttcccagctttaaaaaataaaattgaccacaggaatgttttccgaggcaactccacctactaattatgttgtagctccacctgtgatcagcagagacaagaaagactggtcaccaggacatgaaaaacagcaaaaacctgtccctctgggccaccgttgaccgaggagcaggcctgcaagatgtgtggggtgagtgcaccgttcctagaaatacctttcagttcctgctgaccagggcacaggtcagctctgagcacagccgagtgcactcaagtggcagcaacgatttagcatcacctggatgcctctgtccatgttcggtgttgtgggtgtagaaggaggtggaggaagcacagaggaagaggaggttcgtgcatccaccggcggcccatcctcagcactgagtaggtccgagaggggcttcagtgtaggtctttctcccgttgtctcttccaatcccctctcttcctctctgcccccagaaggctgaccccacacaccacatgtctcagggccccctgacctctggattgggtccagtttggccaacggagtggtaccagcaagggagactggaggacggggagagagtgagcttccagggcacgggttccgccctgtccctcctggccaggcctagggtgggggccgtcccttccctgcagcttcagctgctgcgggctgtggctcctccatcgaggctgcagctctccggagcaggcttctgctgcccagctcctcctggaccccatcagactggttccattgcagcgacacccacttggctgttctctctgggcctcgccattcacttatgtttctcttaactctacccacactgtatgagacagggttctctagagggccagaactaatggaatagatatatagataaaggggagtttattaagtatgatggcgaggtcccacaataggccgtctgcaggctgaggagcaaggagagccagtccaagtccaagtccagttcaagggatcatccaggaagcatccagcactggagaaaggtgtaggctgggaggctaggccggtctctcttttcacatttttctgcctgcttatatttgagctgagcaggcagcagattagatcgtgcccacccagattgagggtgggtctgcctttcccggcccactgactcaaatgtgaatctcctttggcaacagcctcacagacacacccaggatcaatactttgtatccttcaatccaatcaagttgacactcagtattaaccatcacacacaccttgatcaagagtccctctcttaagtcctttccagggaaaccatctgtcttagggagctcatgctgctccagtaaaataccatgggctaggtgacttcaccaacagacctttcctgctcccagttctggaggcagcacaggatcaatcatacaagatcaaggtgccaattcagttcctcatcagggctccatccctggagtgtacacggcagcctccttactgtctatcttcggcgtgtgtgggtgaagtgtcaggcactttcctcttcccatcccaccatggggcccccactctcctggcctcatctcaccccagtcactcccccaaagccctcacctgctaataccatcacatggggggccaggccttcaacacatgaattctggggggacacagcccatctgccctctgagagccacccgtctcctgcaggaaacccaatagaccatcttctcacatcaacttaagctatttaactcattcccacagatatttattgaatactgctaggcatgggggaaaagcaaacaaacaactcttaccactataagtctatgaaagcttatcaggcatttaatacataagatctccttccatccccacaaaaatattgttattccagttttccaggaaggagaaatgagggttaaagagaaagtagggaaaagaaaggatgcttgcatagccaaggccaccaatcaggagcagaacagttatcaatcttcaggttgatttttctttaaataattcattgaggtgaaattcacacaacataaagttaaacattgaaagtgtatcactcggtgacacgtagaacattcacagtgcgtgcaactaccacttctctgcggttctaaaacatcgtcactccaaggtaaaccctccacccaataatgagtcacttgccattcttccctcccctggcccctggcaatcactctgctttctgtctctccgggtttgcctcttctggacagctcgtagaaatggaatcacacagcgtgcggccttttgtgttggcatctttcactcagcatgatgtttcttgaggttcatccatgttgcagagtcagtcagagcttcattccttttcatgaccgaataatattccttcatatggacagatcatactttgtgttttatgcatccgtggatggacatttgggctgtcttcaccttccagctgttgtgaactgttctactgtggcatgtgtacacgtattggtttgaacatctgttttcaattttcagggtatatacctatgaataaaattgctggtttacataataattctatttttaactttttgaagaaccaccaaactgttttccacagaaacaggaccatttttacattcctaccagccatgtacaaaggtttaggttgatgtttttaatagctttcctgagctataattcacataccatacattcatccatagaaggtgtgcaatttcatggcttttggtatgtttacagaattatgcaatcatcaccatcatcaatcttagatcattcatagcaccctagaaagaaaaccatggctttcacagtcggcccccacactcccctcctcagtcctaggcaaacacaaatctaatttctgtctatagatttttctattctggacatcatctcatgtaaatcatacagtgtggggtccttcatcactgacttctttcacttaagagaatgtgtcagcattcattcatgcagcagataaatccatactttccttttcatggctgcataatatttcatcgtggggattgaccgtgttttgtttacccattcatcctctctctgatggacacttggattatttcaatttttgggccattgtgaataatactgctatgagcatttgtgtacttcttctgtgtgggacatgtgttttcctctcttttaaggttgatgttttcattccattggatagtaggtttgtttgatgtagagaatagacagttctgtgtggagaatttccaaaatgtcatggaccagtgggaaagatttttttttcctttggaacagattggccatagtagaaaatcatgcttttctacctcagctgagcattttctgcttctgtgggtcattccagtcccatctgattgacaatcccatttcccagtgggtcctcctcccccaggccaagctccacccagcccccctcattcttccctgaagacctggagggtcacctgatggtccttctccactccatatggctccaagttaatgcttattctcaccatcctttcacttccgcctgtggccccatatctcctgcgcgaacccttggacctattctctcgatcccagtccctcctctgtttaccacagctcgttttctttccccaaaaaaacttaataaataaaccccctgtaagcagttgaatgaatcgtgccacccaataggtacatccaagtccttaatccttggttctgtgaatgtgaccttccttatttggaaatagggcctttgtggatgtaagtacgttaaggatcttgggatgtgatcattctgggtttagggtgggcactaaatccataactggagaaaggagaaggagatttgagacacggagatgcagggagaagactgtgtgaagatggaggcagggattggagtgatgcagccgtgagctggggccacctggagccaccagaacctgaaagaggcagcaaggaccctcccctagatcatttggagagggcatgaccctgtggacaccatggtttcagacttctggtctccagatctgctcaagaataaatttctgctgtttgaaaccacctagtttgtggtggtttgttatggcaggaaactcacacacgtctccaaaagtgtgcttagaggggctgttagaacacagattctcaagctggacagactgagtctaaatcctgcctcctgccacctgctagccgtgtgaccttgggcaaggatgtaacatttgagtggctcattggtaagagaaggacactatggcatcttggtcatggggcctagaggaccaagtaggtccataaaagtgactgtcagagcagcccctgctgcacacggctgcagccccacctgcagctgggattccacccctgcctcctccagccatgattttcttgtctgttcatcatctcaacgcagacccttggcgccatctgtaagcctacttctccttcgctcctgtctccagggaataggggtcccatgtggtctgcaatggcacgctcgccggctccctatcccacactgctcccgggctctggctgattttgagaccccccacaaccaccatctggatcccgagccatggcctctggtctccgacgggtctgcttgtctgcaggtcttctgcccggagccctgacacacgcagtggagttcacacattcacagggtctgtgctcccctggtgggtgggaccacatttctgctggtttaagaggtgttcaatctatgggcacaattatctagctggggagtagcatggggcagggaaagaataaagaacgctgcctcccccagcctcaggaattggtaggcgaggtcctggggcctcgttcaaaccaaggcccagagacacatcaggggcagccacaggcctcccaagcctccctgcagtgccccgtggcatctgggatggtcctgggtcacctttccctgttttttcctcagccccccgagacagcaagtcactctaggccaaggggcttctgctgtgtccaccgggtgtagcttccttcagagacacaataaaggctgcacagaggcaggacgtattagggtgtagaggacacactcccagaactgccacgctcagctcgccctgtgcctcccgcatggcaggtcctctggggggctgaggagggagtctcgtcccttgatatcaaaacaaaaccatgcacagaatccctttggctttgggatttaggctatgaaacgcagggcatgtcctgccatgtgatggcctatatttgtctcagatcagtcacacattggcatcttccagagatgggccccccctctccccgtccactctcccatcttagctgtctgcagtcgtcagaggcaggagagacacagactgctgaagggcggttgaggagctggctccagctgctcggccctgccctgttgtctcagcacaggtgacctgctgctcataggctaaagagcatgaggatagcaaggagaatgcgcaccagcatcctgaaggcagagccatttctccaatgcagccatctgggaagtgaacttcgtggtggaggaccaggaccaaacgcggccccttccgctccctccccaccctgcccatcccttgagctgactcagacatttaggggcaaacagacagagacaactgcacctgggtctgtaatgaaatactaacttcaaaaggctcagcagctgttttctggaacttggcagcctgactccaaagtcccctcagccctcagtccagcctctttattgccaatgcctgacacgctggccacagagcaaagtcgaggtgaacatttgaccatccaaagccaggggagcacaatcattgtcaagaggtttctaaaagtcctcttcatccataggtgtatgaattgctccatcttctcgattcctcacgtttccctctgagcacactgccttaccccgctgtatcagacaggtttcttggtagcaagccacagaaactccctcttcagccattttcagctaaggggtgggggtgtggggttggaggggaacggacatgaacagcaggtcagaagtccagaatttggaaccaggaaccgtagggcagatagtcttgccccgtgctccgtgtggctacagttaacataataattcccagctgtcctcagtttcctaccctgatccccaagaactctagttgagactgtcccactggctaggcctaaaccggctgccattcctcggttaagctgggtgggaaaggagagaagctttcggacttctgtagcgggaagtagggtctccttcccaaggtaatcgtgaggatggattcccaaaagtatgactcttcccaaaagtcggacttttttgggaagagaggtctagatgatgcgtagcctccttccctgcaaaatggctggcatcgacaatgcaatgataacactgaaggtcccgggaacgccctgcagggtgtgaagtcagtacacactggccacactaccggccggggtgctgtttccctcctctttgtgatcccaggtttccctgcagaagcctctgtatggtccatgcatcttgtaggcactctccccggctccatgcctccctgcagaaggctttgtatggcccatgcatcttgtaggcacctctccccgacatcacgcctccctgcctaggctgccttcatggctctctacagagggcagcccaagttcaagcagccggaaccggcagctggctggagcttgggtggggagcgagttctgctggccaaatctggtaggagattctccatgggacatgaacaccgtccggctttataccagacaacaggcaagccagtcccctcaggaaggcagcctctcgctgtgtggagggctgcggggcaaggaggggccactatctgtgccagcctagattgcaactgagcaagagattaagttgagggctttgaccttgaggcagccttcacaactccgggacgcgagacaccagaaacctgactctgacttcaggccaggcgaacacactttgcgcatttctctccggagctgtgtaagtcacagcggagatttcctctctgaccggggctgtgttacccaataggccacctagtaacacgcctgggatgcatgacggaaaagcagggatgccaggaatttatttttatgaagttggtatttcaaaaggagcattgaagagaagtcaacatggcaggtgctggcggtttgccggacttccttaggcttaccccacatgttagaattgctttggttttgaattatttgcggggatgggagctagtgtatgtttttctgtgtcaaatctctttgaaagtctctatccaacctgcctcgccaagataaaggccagtgagacgtgatactggcacacttgctgctgtagcaatgtttttctgttttgctctcctcattgaggcgaaagttttaaaattatccttactgtttttgttgttggcctgaaaggttaaaattcatttgggtgagcttccaacaatgactggtttctctgcagccaataccttccactgatttacacctgtgctctcaaagtgcgagagcttcagatccactcaaagtggatgggtgtgtgtgattggccagccacatcaccgccacctgggacctggttaggagcacggactcagccccacctcagacctgctgagtcagaagccctggaggcaggcccccaagatctgctttaacaaactctcgggagggttccaaggcacgttacagtttgagaaccaatggatttgattagaaaaaaagcaagagatgagacagacgtgtcccccaaggaggacgtgtctccttcgcaggtgcaccatccatggattcctgggagcttagtggacccctcagcaggcgaggcaggaaaagggtgagtcagccaagccctcgccttagtcattgatggatacgctctgtaaatctaaagccagacggctcttctcacccacttcctgctcctgcttttctaactggaggggaaaaaaaagagaaaagaaccaatgggaaataaaggtaacagaaaggaaaaccaactaaaccacgttaaaagatggaattatttgacagaagattttaaattacttacactacaggggttgtttttcggtagaaagcgactactttataaaattaaaaaaactgtttaaatataaataagacaaaaggagaaagtaaaaatcactcaaaattccttcacccagagataacattaacattgctgtgtttctgtttactttgcacataattttttaaaatgacaatgtattttttatccttttgagtgaaatctgtgctctcatcttggaggatttccttgggaccaattcctctaagtagaattcctaggttcaatgctgtggactgttttttctataaaggcgatgcttggtatagaaacagtctcatctgattgccctccagaatggatgagctacttttacgctttccactaatagcagaggagatttttgcagagaatatgaaagtcttggtgctcgtaaatattttgtttttgtttttgtttttgagacagagtctcactctgtcgcccagactggagtgcactggtgcgatctcagttcactgcagcctctacctcccgggttcaagtgattcttctgcctcagcctccagagtagctgggattacaggcacctgccaccacacctggctaatttttgtattttagtagcaatggggttttgccatgttggccaggctggtctcaaactcctgacctcaggtgatcctcctgcctcggcataccaaagtgctagattataggtgtgaaccaccacgcctggcctagcttgtaaatattttaatgaaaattctcattaggccacctcagtactgtcgtagttatctaagaatcttcccatggtccttagaatatgttcttccgaaggcacgttccttctgctgtccttgtaatctccagacacaggacaggccccagcagcctgaactgggcctgtgcaccctggaccatgtgtagccctttcctccccggcacctgtccttccccatcctctttgggttcccctgcatgcgggaagtgtgccccggcacctggtttcctcagatatacggcctggaaaccacgtgcccatcagaatttcagccacagtcccccgtagatataaccaccatcttccaaacttcatgtccaaaagacaaagaatgaaaagtaaaggtgtttattttggtgattttttttctcattcctaaggtaatatgtatttgcatggaaaattgcagcatagagaatacagctgtcatctgataacatttctagatttctattgtgcatgtctacatagatttatcatttttaccaacatgggttcatgtcaccattctcttttataatatttccacttgatattatatattataaaccttattccatgccaattaacagacaactatatgccattattttagatggctttaatgtattccataatacaatttctgtagtttatcaaatgaatctctcactagtaggtgttcaggttgctttctttcttttttcttctctaaatataaagggtattactgtacacgcagctgttatgagcttgtgggattattcccgagcagaattgctggggtcaaagagttagagcattactaaagcttcatgttcgaattgtcagatgccctcgagaaggatgaatcaatctgaaccctcactggccgtgtatatgaactccacctgcctcacagcctcttaacattggttcttaactgtattttttccatttttcccagtgcttatggcatcttttaatttgcaaggctttgctcagtaaagaggatgaacatcttttcatttgtttataaattattggcttttctacttttgaatcatttgcttgacttttgcccatttttctactgaagcgtttattttttcttactgatttaacaaagctactatgcatcataagtcattttcccagttttctttgtcactttattttgtttaaggtctttttgttacagaatatattttattttgcatggagttaagtcaatccattttttcccatattagttctgcctccagtgtcctgaatataaagtcttctagtaactatatctttttctaatgttttaacaattttattctttatgtttaaaatactaaaaaaaaatttggtgtaatgttgttgtagttacaggaaatataatttgaatttttcccaaattgttgttctattatttcaaaagtattatctcaatttcaaatggtgacacatgtaaatatatttccatacttagtttctgaattttcgactcaattccaatatttttttaccactacatcaataatacattgctttaattttataatagctacttattttggtaattcgagtacctcttttattcattcaacaacctttatttggcatctacaatgtgctaagctctatacgagaccctaggggaaaatgaggggaagtgacccctcctcattactcttctctttacatatttttattaccctcgtgcatgtatttttaaggtgaaacttaaaacttcttttgtcagataatctcatgggacttttgaatactaaagggtgttctctctattcatttggataatactgagaaccttattcagtcttcctaaagaacgtggaaacctacagcgggcttcacgtgtgctgcagagaagcgtttggttctcttcctgctttaatacattatttgaaagttgaacatcgtgtatttcttaaatatatttataaattcttttggtttctttactcattgatttgtttatttcaatgtctttctcctttttacttcaattatttttcttatttgcatgtatacctcattttatagtagtatattccttagagatatgtaggtgtgtatacgattttggtatatgatatgattttgatatattaagtcaattcttgacttaaatatgtctttcatttttctctgagctttctttttttaaatattaaactcatttagggtgatacaaatgtttatgagcaacagcatatcctataagttttagtattctgtaattgtttttcttacatctgcaattgaaatgtctatttcctgtttacttaggagatcttttagaaggtgagtttttaatgttagaaaactgagtttctcatttaaactttcatagtgtgcttctgccgtggtcagaaagcaaggacccggccggaagcctattgaaaggtattagggtttaagtagtttacaaccattgtggaagacagtgtggtgattcctcagggatctagaactagaaataccatttgacccagccatcccattactgggtatacacccaaaggattataaatcatgctgctataaagacacatgcacacgtatgtttattgtggcactattcacaatagcaaagacttggaatcaacccaaatgttcatcaatgatagacgggattaagaaaatgttgcacatatacaacatggaatactatgcagccataaaaaggatgagttcatgtccttcgtagggacatggatgaagctggaaaccagcattctcagcaaactatggcaaggacaaaaaaccaaacatcacatgttctcactcataggtgagaactgaacattgagaacacttggacacagggtgtggaacgtcacacaccagggactgtcgtggggcgggggcagaggggagggatagctttaggagatatacctaatgtaaatgatgagttaatgggtgcagcacaccaacatggcacatgtatacatgtgtaacaaacctgcacgttgtgcatatgtaccctagaacttaaagtataataataataaaaaaaagaaaggtattagggttgtctttgtgtctaatctatcgtttttgtagttggtccccaggtggcttaataaaggatctatttgctggagggtacaaagctatgacaatgggctgtggtcaggccgagttttaagcactgggtgttttctcctttcccctgtctcctagtgctccacagggaagtctggaaaagtccctgggggctgtgccagataccattctgaacaaaaggcttagcagaaggaagcagaaatggctttgcccctggcatgggtctgtgcatcccgtcagtgccttaatgagaaaacggggaggcaggagcaagggagtatgaatgaaagcactagaatagtcacctaccattctcatcagagcagctaccaccatttaaatacctgcacccatgccatgctgtccttccaggggatgaccatgtgatgaggctgacagtgcctgtccctggggcatctcatggggatcctctggaccaagatctgcacctgtgataaagaagagtcagaaatgactgattgtgtgtgtgtgtgtgtgtgtagacatgtattcatgagtatgtatgtgtatatgtgtatgcatgcatgggtgtatgtgtgtgtttatgtgggtggtgtgtatgtacatgtatgtgtgtgatgtatacacgcatgggtgtatgtgctgttctagtgctgtgtatatgtatgtgtatatatgtgtatgtatgtgcttacatgtatttatatgtgtgtttatgtatatgtatatggtgcatgtgtaatgcatgcatatgtgtatgtgcacgtgtataaggtgtgaatgtgtgtgtatgtgtgtgtttatatgtatttatgtgtttatggtacatatgtatatacatgcatgtgtgtctgtatgtataaggtgtaaatatgtgtgtgaatgtgtgtgtatgcgtgtatatttatgtgtgtatgtgttcatgtgtgtatatggtgcgtatgtatatgcgtgtgtgtttgtgtgcatgtatatggtgtgtgtgtgtgtgtgtatgcgtgtgtttatgtgcatatgtgtatatggaggttggtagtggtggtattataagcagagtacatcgaatcaaagggtttctggatccctaggtgtatgtagactggcacttctcaaactttgggtcctgggacccttttacagttgtagaaattattggagatcccaaagagctttagttcatggagaacatatcacctaccttgttagaatttaacgctgacagttttaaaaatatttgtttaaaaataacgataatgatacctttgcatgttatcacaaataacatctttctcatgaaaactaattatactttccaaagcaaaagtattagaagagtggcgttgtttctgatgtgtgcatgcctccttcatgtctggcatcatcaaagacaactggatttcatctctgtgtctgtggtgttatctcaggtcacgtgggctctagaaaactctgctgcactcctggaagaaggagagtgaaaaaaacgtctaacatcccacaaaatggtcttggggacctccaggggtccccagctcaccctttgagaacctcttttattttttatatttaaattcttttcagaattattttgacataatactggtgtcgttgtaggagcagccaacaatctgacagattttcataaacatgaggggctgaggcattgcggccatgcagctgggcctgggtgggggagtcacacgcatgctgatggctcagaaatgaagcgagacccggcggagaccccgagtcacatgcagccagccagcacagacaggcccacaactctttccactctcctgggagtgagcagcgggatccagggctgttcttgcattttcctgtatttcagtgaggatacaggcaaagctgctgaaggagacaccacaggacaaggacagaaacatctgactttattgttttccccgcctgtaacatacagaggtatgtcggccagggctggcaggtgcttctgctctacgaggctgtccagggaaccaggttcccgccgtgttgttgcccctccattccctagtgtgccgctctcgccctcctgtggtagctgttcaccagcacccatgggcattacaccagcaggaagggggaagggaaatagagggtgcagggcggaccagctcctccttaaaggaggattccagggagctgctcgcctccctgtgtgtccccgcaccaggctgcaagcgagattgtggctgcaggcactagccaggtgttcctcttacaacccaggaggctctgtttccataaagaagggaatgaccaattctgggaaagtctctggctcatcttgggactctctgcatcttagttattccatgagctttgtcttttttttttttttgagaccaagtctcactttgtcgcccaggctggagtgcagtggtgcaatttcggctcactgcagcctccgccgcctgggttcaagcgagtctcctgcctcagcctcgcgagtagctggggttacaggcacctgccaccacacctggctaatttttgtatttttagtagaggcggagtttcaccatgttggccaggctggtctcgagctcctgacctcaggcgatccacccacctcggcctcccaaagcactgggattacaggtgtgagccaccgcgcctggcccgtcttcatcctttctaccctgagtccatggcaactagccctggagcaggcaagggtgacaggatatgggcgctctgtctttggagagacaactaatttccttggcagtcttcctctttagatgactttatcaggagtagctagataaatctggctgttcaataagcatcttctagaagtttctcaatggacaaaggattcctatttggtctgctttgtttggattcgttttggtctccttatttggtctctgggacctttgacctgatgtaggtaaaatgtggattctggtgcagtcaaccaacaccgcatgccattttgaaagccaagccaagcaaaaccccgaacaatacaagacaaaaaataccccctccaaaccctagagagtcccatttgaaatccttgggggctgaggtgactcccattttgatgtattgtgtggactgaccagcatctcacatgtaggagctttctgggggctgtggctcccggggtcctgtgggaagaatagtgaggtgcacacaatgcaacgggatccttagggctatttttgtcacaatgaatccgcgggaggcagcagctttgtcctgacccacttccttctcgcaagtgtgctcacagcctgaagagagcgttgggaaggattttctgttagcatccagcttgcttccccacttccctgcgactgtctggggggagaggctgcctggatttttgcatttgcatttcgggacatgttgcagatattctccacacctgaatgccgtgtccatctgtcggcttctgcaggctcacactcctgtcacctccaaatcatgtttccccatctacgtcgttatcgtcagcttaactccttcaatgcaatattcatttcagttagcaagacacagaataactgtggacaaggagttcaggtgttaagaaagaggagagggccgggcatggtggctcacgcctgtaatcccagcactttgggaggccgagacaggtggatcacttgaggtcaggagttcgagaccagtctgacccacatggtgaaaccccatctctactaaaaatacaaatgagccaggcgtggtggcaggtacctgtaatcccagctacgtgggaggctgaggcaggagaatcacttgaacccaggaggtagaggttgccgtgagttgagatcactccactgcactccagcctgggagacaaagcgagactccatctcaagaaaaataaaaggagaggaagacaagaaagagtgggtaagaaatagtgtggtgctgtcttctctaaacagccaatcttagtggatatacagcatgaatcctatgcatgcaggaaaagctaacattctgatagaaatctgattgttcaggaatccatagaaagtataaaccccggaaaacaggaggagcccgaggatgttgtatagttcgtgctgctgtctctgaacaaaactgtatccaacatttaaatgctgccactttcaagaaatactcaaaagacagaactccatagctaatcttggtcaatgtgctccagggttttgagcccacgttattgataagttcttccaaatgtatattaccttgtttcaattttcataatcagtggtaacaagggacctttcctaatatgttatttgaccagctgtaagatggttattaggcatccagatccttcgtattagttatttctcaaactttttctctctgttttttgagacagggttttgctctgttgcccaggctggaatgcagtggcatgaccacggctcactgcagcttcaacttcccgggctcaaccaatcctcccacctcagcctcctgaggagctgggactacaggcatgcctggctaatttttatattttctgtagggatgggattttgccatattgccctgaccagtctaaaactcctggagtccagcgatcctcccgccttggcctcccaaagtgtcgggattacagatatgagccactgcacccggcctcaaactttttcaatcaatgagctactttagacatctaaggaatcctccccacctcgtgttatgattaaaaaatcatcatcaatgagaaggctgatgcttttgatgtgtgttttattaaatatcataaatgattaattccggccagcactggaggtatggaaactcttgaaaacgtgaccttggcagatgtgctgctgcggtgagaagacggccagggtggatttgcacatcatgggaaggaccgtcaccctgtgctctgtggcggacaccctccttgtcacaccgggagttcttcctcagagccacagtccacacagcaggggtccctgcatcctgtcctgcacacgcggttgcgtatctgcaccgagatgagaggataaacaggctgaggctgactgcattggtttttgtaatagcaaagaatcggaaataaaccagattttcacaagtggtttgcacactgttttgtattagggtaaagccattaaaaggaatagcgaggggctgtgtgcatgctggtggaaaggtctccaggacacacagtaaggggcaaagagcaaggagcagaatgtaaataaacacgactgtgtttctgcagaaaaaccatgtgctcattcacttgtacaaatactcagaatattctgagtattttccaaaatgaaaggccacacctagaagtctcgtgaatggttattttccaggacagacagtgaagatcaatcgacatgggactgacggacgtggctttgcatcttaatctctgtattttcttttatctatgacttttgtaatacagaaataaacagcttataaatgaggggaaagcaggaatcatattttaccaaaaaaaaaccttctgaggcagctgaggaaaactgaacgcagtctgggtcttataggacattgctgaattactgatgcttttctgaacatgacaacggtagtgtggtgtgtttcaaaaagtcttcttaggtgataaatacacactaatgtatgtataagtaaaatgataggattatgctttcaaaaactctatgcatatataaaaattaattttgcaatgatttaataggtaactttttaagatgaccaaataacaaagatctatagtttctttattgggggagtaggaagagcccgtggtcgtgtgggagggccagccaggtgtggctgcagcttccgagttctctaacttgacatccagacactgggtgagagtgggggagatggagggcccctgggatgcagaatgtggggaggaaccgggagtgagggtcgccccagtctgcagatcccactgcgcccttcctcacgcatggcgcctgggattcctgctcgcctctccctgcagggctctgcctcctagtgtttaaacgttgacaactaatgcagctgtgtgagtgtgtgtgtttgtatgtgatacgaatgtgtgcacctgcgtccgctgtgtgatatgaacatgtgtgcctgtttgtggatgtgtgtatgggcctctgtgtgtgtgagagtgagggtgtgtatgggtaagtatttgcatatatgaatgtgtgtgtatatgagtatgaatgtgtttgcctgtgtttgtgtgtatgagagtgtgtgtgtgttttgtataccagtatgaatgtgtgtgcatctgtgtatgtgagtgtgagagagtgggaagtgggtgtgtgtgtgtgtgtatatgagtgtgtatgcaggtgtgtgtgtatatgaatgtgtgcatgtttttatgtatgtgagtataaatatgtgtgcctgtgtctatgtatgtatgtgtgtgtgggtgcgtgagtgtgagagtgtgtgggcatgtgtttttgtgaacggtgcgtgggttcgtgtatgtgagtgcggatgtgtgtaaaagtgtgtgtgagcatgtttgtgtatgtgaatgtgagagtctgtgtgtgtatctgtggtgaagactaacatatctgaaggcaattgggcctgaggtgatctgtgtgatttctgatgtgaaagagcacctgcgaggggtcttccccagccgcccctggcaggagatcccagccgcagagggctcagggctgtccagagcttgaaacagaacccattgatctcattacaagaggcggagggagagtcacgcaagataaccttgaggttgggttgttcgtatctcaagtctcttagaaggcattctttgcttgtttaaatatcctctttcaacagaaaatgactcttccatggaggcccctaccatatttgagctactcatgtttgcaccacctaatcagatgcaagtctaaataaacatatatatatatatatttaatatacatcgacagagagcacagtcccaacattgaaacgcttctgtcaccccttatgtaatttcagacctgaggcacctaggcctgtgctgggtaaacctcagatgcagaaaggcctggaaggagaaaggcgtgttcgttttcaggagagacctggaactcgagcagatgccaggggaatcacagcacagcttgacgcaggtaagctgggccctgggcccagtgcagggaggaagatgctgggggttctcatacaccattcagattcttttgcttccaagtgtgttccctgctctctgcacccctcctccctgcagagcatgagatgcaggagctgctgggatgccgtgggagcgcctcgggcttgctttgagagagtggttcccaagcttgagcatccgaacatcccgggggtgctggctagaacacaggatgccagccccagcttggagtgccccagtcaggaggtctgggagggacccggaaatgtgcacctgtcacaagagcccaggcgatgttggggccgcaggtccgtgagccgcactctgggagctgctggcctcgcgagatgtgcctggatttcagatcaccccagggacaggcaggcagcttctggctttcaggaaaatcacagtttgggttttgtatctcttgcttgtatgcaacacatctacaaaattaaggtttttaaaaaattgtggcaaaatacccaaaatgcagtaacacaaactttaccaccttaccccctgtgagtctacgactcagtcatgttcagcgcacacacgtggctgtgcaaccatcacgccgtgctgcccccgcacgctttctgcttgcacggctaaagctctgtgcccagtatgcgccaacacctcgtccccacctcccatcccgtccctgaagccatcgttccactctctgtctatatgcatttaattaagtctgtagttcactatgttttgggcaaagtcgtggtcacagtgagacctgaggctgatcccacggaggagacgggcaggtgactgtgttaacttacgtgacagtgtagcaatcaaacagctgcctcgtgagagacgaaggggtggtaagaggctcagccaggtagtttctcttcctcctcctcctcttcctctttaacttcaggctaggaaaatgctgtgggtggagccactctgggaaggtgaaaagccttttacccccaggttgcctcagtaagaggttcccgctgcggcactttaaagccccgtagacgtgtctgaatttataacacactcttgaagtattcactcagaatcctgaagggattttcaaagccaccaagaggatggagaacttgtggccagctcaggtgtagggaaaaacttctaggagggctgcctgttcaatggtattaaacagacttttgggaagacggcgccagtagccacagacccggaaaactcgtgggcactgaattcagattagcaggtgtttgttgtgtgttaactctctacgaagcacagacacagtgggagagaaaccttctgaggtgcatggggctcggtcagtgatcggagtcagaggaacatcagataaccagcttttccctcgtgtcatagggatgtggaggaccctctgtgtgcagggccctctgctgagcacggctgcccagtggcttcccctgtgggaagcggagaggcgggcactcggtcacaatgataagaacctcctcctagcgagggctgctgtggccaggctgcactgggagtggtttccttatgttctgtagtggaaacagatcattacaaaagaacaaggtttgtgaccgctggaaatatgaatgaggtcttatgaagacatcaaagaggaattcctagcccaggccggggagggtgggatgggctgctgagtggagacggtgctggagtgaagaggcagaggacggaaaggagtatgcaggcctaagaggaaattcatcccaccgacatgcatccagaaagctattgagtgtccctccctgccaggcacaggcctagccccggggataaacgactgaacacaacctgctgtcatgagcttgtgttcttgggggaggaggtggtagcaataaacagggtgggatgtaacatgggtttgctttgagagagttgtccccaagcttgagcatcagaacatcctgggagtgctggctggaacacaggatgccagccccagccccaagcacccgagtcgggaggtctgggagggacccagaaatgtgcacctgtcacaagagcccagacgatgttggtgccgcaggtccgtgagccacactctgggagctgctgctctcaggtgatgtgcctgcatttcagattgccccagggacaagcaggcagcttctgacttacaggaaaagcacagtttgagcttttaacacataggatatgttcgtgataagtgtgaaaactataaagaaagagaatagcaaaactatggttgggctattgcaattttacataggattgcaagagaaggcatcatggagaaagtgggattggagtaaaactctaaaggatgtgatgacatgagtcatggcacatcagggaatggttttccagacaaagaccagacgtgcaaaggtcctggggcaggggctccctgggaagctcaacgtgagcaaccacagtgtggccacagcagaatgaatgtgagggagaggacggagatgcggtcctgatgaggacagggaacacgccacgctgaggcttcttggccactgaaggctctctgagtttcctttgagtgagatgggaactaccgaggttttatgagcagaagatgggtgtggcttgactaatgttttcatagtctctctctggctgcaatggggaatgaaactgaaggggagaagtggtggcaggagagacaccagccaggaggtggctgccccaaccaggtacggaaaatggtgggtgaaactgaggtgtaagcaatggtgtgagtgggaagtaattggatggggaccgtactttgaagacagagctgataagattgaacggccaataggaggtggaatttgaggcaagagcgatgtcaggaatgactccagggtttttggccaagccagcctgaggcaggagtggccatctcccctctcattgtgaagcgggtcagagcaggaggtgagaaaatgagaattcattctaggcagaccaaatgacagttgcaaaacaaagtaaccatggagtgtgtgtggggagctgccagcccctggagaccccaaggaagggtatggggtggatgagaccagacagggatgggtgcacacgaagaagctaggaagcctcctcccgcagcatccgcgcatccagagtttggcgttttgtgggcaggtttggctggcagaagctatgcaagggttcagggatgctgctgggagaataccatatttcacttcatccaagacatcacttgtaaattcggtcattattttgtatccttctaagaaagaaattatgttaagacttacattatggtgggttactgttgtgtcacttagagtttgccctttatgcatattacatgcatattaaaggtgcccttccacacttagacatagagattcataccctgcatctctccatgcatgcagaaaagaaaggcacaaaattaattggttcagattttgcaaacgtcttcacattcagagtttgactcctctgaaatactttgagactagaatcacccatgttcaggttttcaatctacctgggaactacatgtgctcatgagcgacagggaaggctgccttctctggaagagtcccccaccattgtctcgatggcccttctgcattgttgaagctgctgcatactttatctctgtcaacgtcttagggaaggccaatatgtcactattgctgctggatgtgatctgttgccaggcacatcctgatatcagaaatgttaagatgtatttaaaagctctgtttcggaaccaatgacataggagagaatttgggccatcattctaatctttcaccttgaggttggagataatttatacccagaataacattatgaaagccccaaaagacaggggaaggagttgggctgacaagtttcccaggtggaattattccaggtggtgccaagacccagcatgtgtcccaggtgtgggtgactggagtgaggtaagatgtcaaccagtggagtgaaagagggtcaagttctgagctgtggctgttggcagggagtctgtatggatgtttaaacctcctgggactatggcaggacatgggatggaggcttcagcagtgccctggggctgctataacaaaacaccacaaactgggtggcttagaacaacaggaatttgttctcacagcattctggaagctggaagtctgaaaccagtgtggcagggttggctcctcccagtgggcctggcttctggggtccctggcaatcctcgaggttctgtggctcgcacaggcatcactccaggctctgcctccgttgccacgtggacttctcctctgtgtgtctctgtgtgtccttgcctcgtataaagacgccagtcatttggatttaggacagaccctaatccagcatgagttcagcttgctttaacatgtttgcaaagattgtttccaaataagatcacattctgaggttacagggggacatagtttgggggcacactatttaacccagtacagagaagaagattgagccagctccctgagttacgcatggatagggaggggtggacaagaggctggtcaatggcaggggtgaggagaggagggacttctctctggggaacacattcaagaggacatcacagaaatgtccctgcccactttgtgttgctgctgatctcctggcccaagatgcaccctagcctggcctgacagcatacacttttacaaacagcttcctggctgtttgcagccaggaagatgagaggaggatggggctggagcaaaccctgtgggccgcagggcaggagggtggggcaacctcacaggacctccctgttgatggttttggccctcaatgtcccaccaacaccctcccagcacttttgtcctatcccctcggtaacctctaggcctccagagcctgggagctcttgggtgccctggcgtccgctccagtccttgcccactgcccactccaatggatgtggtatttctgaccttccctgattcctgggccatcatcacgcagaaacagctccagctcagcatccctttggcagagccccaggcacactttccgccccaagataaaatcaaacatcaaaggagtatgaaatttcacacgagggcggaagagtgctggtctggaattggcagtggaggccaagggaaaggctcactcctgttgtcactggactgggagtcgggacaaatggccccgtgtggaagccgggggaatgacctcatctcctgaggccacagttctccgtccatgaatccaagagcctggcttaggggaccgaccgtgagggcaccttcatgtcccaaactctccaagtttaaaaacgggcaggcaagggagcattccacagccatttctgattccttgtttctcttttacaaaaagtgttctttcgcattatggcttttattcctcaccttatcgttgaaatagttcccaaatctataattcttctgcaaaccataacagcttaatgaattctaccagaaagagaaagcaaccagtttattacagacacattaaccttcatctgtgatgcagcttctattctgttgcatgctggcaccacttgagagctttaagatacacacgtagtgcggggaataatgaaataatgaccccgcaggcatccaggtcctgatccacagaaccgaagactatgttagatcgcaggcaacggcggcaggtcggctgacctgaagtgggaagaggatctgggattatccaggtggacccgatgtcatcacggggtctttaagtggaaaagaaggcaaggtggagggtggttagggaagaaatgtcagaaggatgtgatatgagggcccacccgcctttgctggcttgagacagaggaaggtgccccaacccaaggaattatggaagtctctagaagctgaacaagctgcagaaatagattttcctccagaaaggaatgcagactgctgaaactttgagtttagcccagcaagacctgttttgggcttacaaccctcagaactgcgagataatgaatctgtggagttttgttgttgttttcgtttgtgtgtgtgtgtggttttttttttttttttttttgagatggagtttcaatcttgtcacccagcctggagtgcaatagcgcaatctcagctcactgcaacctccacctcccgggttcaagtgattcctctacctcagcctcttgagtagctgggatcacaggcatacgccaccacacccagcaagtttttatatttttggtagagatggggtttcaccatgttggccaggctggtctccagctcccgacctcaggtgatccacccgccttggcctccccaagggctgggattataggcctgagccaccgggcccagcccagtgttgttttaagtgactaaatttgtggtgacttgttacaggctgggtaggaaactgatgcaatagtaatgcttgagccccaccccagaccaattaaatcagggtctctgggcggtgaggcctccggtgacgctaatacccagccagaggccgctggtgaaatgctgcaacatttatttcgtaactattcctgacctccaataagctcggcaacccggtaggagcggatttccttgtctgtagaatgaaaggtggagaaagttcatcaactgacctcgtctgaacttctactgagggtgaggatgggacaggcgtgtgtgatagagaatgcacaagggttcctgccatggcaaggtgttcatctgtgaaggctgtggtgaccggggttactgacaaattcagatgcttacgaggaagaaatcaattccagacagatcaaagccgagtgtggaaacctccccattaccagaagcagccagctcagctcccatgaaatagcgaggaggggagtgcattccttagggcctcttccagtggccatggccattttatcacctaagtttatggagggcgggagggaagtgattcgtttgcatgagcacgcagggcagcatcagagctatcttgggggccagcactctgggaaggctgccgcaatgaggatctccccatttcccagctctgctcccagcgctgatgctctcttgggctccaggaagactcaagttacccaaagctccggccctgacagcctgaagcctcccgcccagcagaaaagacaggaccctttccccagacatcgcagaaaaagcctcatggcagctgactggttctaatctagtcccacaaccatccctagatcaattgctgtgaccaggagaacactcatggagccatgtctagtccaacggccacatcctgagaaggggacaggcccctgacaacaggggccgagcctcatctttgggttacagccataggagatgagcttgaaaccagaaggagctgctgatgaaaacattctgagatccctttgatcttgctgagcttgaagaggctgtggttctcccgatatcccacacccaggcccacacatggctggcgtgaaggacaaattggtctgtctgtcagtcaccttcatgcttcctcccaagctgacccacccacgcccagcctgccaacagctgtagagtcagggtgaggccgggaagctgtttgcaaaggtgtgtgctgtcaggccaggctagggtgcatcgtgggccaggagatcagcagcaacacaaagtgggcagggacatttctgtgatgtcctcttgaatgtgttccccagaggaagtcccatccgtaaagccagattcaagaagttcttgtttttaaagctcaaaggaccccatctggcctctgaaaagtcttaaaacatctgaaagcttaaagtgctgcctagtggtgtccctggaggcggacggtgaggtggtggtagagtgtggcctgacttctgtgaggatccctgtggtgaacctctgcagagaggacaggtgggccagggagcaggcagagggagaagtcagcctcacccacgggacccaggacagccacaacccaccccacagagcattctggagctagaactatccctagtagggttgagttgggtggttctctatattcccttatggatctgtccctggatcgtggaatgtttgtcactgttgtttaattgtaagagctctttatatattctggatattaatcctttctcagacatatgactttcaaatattttctcccattttgtgagttgtcttttcactgtattggcaagcacctttgatgatgcataaaaggttttaatttttacgaagtccttgttttgttttggatgatgctgttactcacgttattatcacacacggtactgcaagacaggaaatcagtgcatcctcccagcctgtagcaaagaaaaagacccaagtcccaggcccaagctgatcagcatattctgtcccctatgcactgtgagtggtatggagatgggcaaggacccagtttgtcccagtgaggttcagtccagaacttttcttagaatgactggggagaaagatttacctacctacctctgaggctaagagcaagttaggaacttctggaagccatctggtcaccatgagaggagggcgtaatagagagaggaaggcagggagagagaaggtgtgcatgtgagtgtgtgattgattgattatgtgcattggtaatcgataacctacccatgccgccttaccccaacttgagttgtgctttctttcttctttcacttgcaacaaaaagagctggatggatacagaagttactttggaagtcttttagtgcccgctctattgaacagaagagggaactgaggcccagggaggggagccccaatatctgatacatttcatcaggaactattaaaggtctcttgcaagaagcacatctgttcaaatatttgcatgggccttccttgtgagacaaaatctttgtcttgattttgctctcacctcctgtgctaggagaagggacaccttgggattccttgttctcaaaaaagaaaactaaggaagaaatcacagagggcccctgatatggtttggctgtgtccccacccaaatctcactttgaattgtaaaaatccccatgtgtcaagggcaggaccaggtggagataagtgaatcatgggggtggtttcccccatactgttctcgtggtagtgaataagtctcagatctgatggttctatgggagttcccctgcacaagctctcttgcctgctgccatgtaagatgtgactttgctcctcattcgtcttctgccatgattgtgaggcctccccagccatgtggaactgtgagcccattaaacgttttttctttataaattacccagtctcgagtatgtctttatgagcagtgtgagaccagcctaatacagcccccaagtcagtaagggaaccaggttctatataaaagaccaaacaaaattcatacctgaaacttaccttgaaacaattttcagagttcagagaaataaaacaaggtttacacatttttggacaaatttatatggggtagaaagtgaaagatttcttcccacactaacacatttctttatatccctgcagaatttttcctttgtttatttaaataaaagtcaacataatatgcatatttttctgcaacttgctttaaaagttaacaatatactgtgactgtttttccagggcagaatatgccaaatcaactacattctttttaatagatccatgtttcaatttcattcagtgaacaccaaggttgttttgatttttgttattacaaactactctgcccatacatccttaggcatagaaagctgtaaatctggggttaggtacagaatcacttccaaaagtaagaggtctagacagaagtttattgtcctgattgcagactctctcttgtgctgttgagtgacctgtgtgggcatctctcaatatatttattgtttgggtgtttttgatatctgctaaaatatgtcttcctcataatacttcctatttgaacatatttttagctattctcttgcatttttctcttcaagtaacctttaataaatatgacatgttaataaatgcttcattaaaatattgattggatataccctaaatttattaatttacgacttcacgctattgagttttcttttatccttttcagtatagtcttataatttcattcagagagagatcaaatacatgggtaagaattttatttcttcttttcactgtttttaactattactttcttccttacctcattgaattaactagcaagcccagaacaatgttgaaaaaccctggtaccagcagatagcactgcctttcatgtttcaccaatttatctaatgtttactagttattgttatatatcttttaccgttagaacttccttctgtcaatagccaagggaaagcagtaataattatcaagtttcctcagaatttttcccatttaatgattgaatcataatttttatccttcaacctattgtagtagttagccttcaataaaatgcccaataattctcaaatcctggcattcacacaccatgaagtcccctccctcatcgtatagggctgacctgtgtaatcaatagacgatgtggaataacagagtgtgaattccagagctaggccataaaatatctcgaattacttgctatgggagaatcagctgccatgttgtgaggatgctcaaagagtcctaaaaggtccacatggccaggaactgaggcctccagccaacagccatgggtgccttccaaggctgccatcttggaagccagtcttctgccccatttaagccttcagatgactgcagccccatcaacttcttgactgcaacttcttgaaaggcactctaagctacagccacctaagttgctctgggtacataacggaaactgtgattaaatacatatctattgtgttaagctgctaaggtttgaggtgatttgttatgcaatggtagataactaatgcacatactaattgatttttaaaagttttccgatgttatttcatccttttattattggaagaaaaatagtttagtcatggtatattattctttaatacaccgatggattcaatttgttgatagtaaattttgagttttattattcttatttgcaaaagtgattaaactcaatctgtatttcttaacctgtttgtcaagaaccgtaattctggaagtttaattggagctctgacaaaggcaattctattaaaccactctgggaagcatctgtgtaatgaatgcccctcttggagatttacaatgctcgttagtgcagtgtttttaccacctgaatccaaattacctaggtatctgttaaattcagatattcaggctttattcaataaaaatctgtgatttgggtttggaaacctgcattttaacaagctttaccagggattcttacgcacacaaaaattttaaagctgtatcttaatatattaaaggttctgggaagttcaacagttgaaaaaacaaacccttaatggtaaacaagttcatttatgagggaagggttttttctccatttgttagatacatttctaaaaatattagtttgggtttatagttgtatgttttaaatatacatataatactgttaattagattttggtgtcagaattttatcagtcttgtagaatatactagaaaattttctgtgtttttttctaggcttcaggatagtttaaatcatagacgatttatctgttcctagagggtcggatggtaaatttttgacatccttctcatttttaaataattattatccagattttctacttctttatttaactctggtaattattcctttcatccagataaggattcattcataccttcatacctcttggtatgagggtatacatggcattctctaagttttataaatctctgccatatcactaagtattttgtcttatttctatcatgaacaatttagtttttctctctctcttgttctcactcttgctctcgctcaagtttgccaagagatttatctatcttaatctattcaaagctatggttctttactttatcaattctgttttttattccttaatttttttctatacaactaatttgttttccatttcacctattttattcattaatttcttattttttcttagcttcttcagttaaatatttaattcatttgtttttagccactttattaataataagaggatgttcagtccaggaattttcccctgattacaggttgggccacattctggtttttgttgttattgctattgcttgttttttttttttttaaccttcatcttaaagtttaaatatgtgtgaaatacacacataattaagagtatccagtgcttataatttaagaagcatcccttttcctctctcatacggccccacgactccatgtttgctttcccaggagaaagcatgctggattgttgcagctctctctggtccatttccattttaaaaaggtgttttcagcattacatcatgatatagtattagttttagacattatctgttgactgcctgttagaagaaactatagtctcttttgtatgtggcccctgcctccttccctgccactctcccagtatgagtgagatcatttttctgagattatttctatagctcgatcacttctcagggcttgtatttggaacatcttatcttgcccagtttttcctgtgaatgtggaagaaacacttgccaatgaacctggctggacccaggctcttctctccttgaatagcggcaataaccacaagtcttcagcttgacctctcaagtccacagcggcggcccggggtagtccatcaggggctacctagggtggctacagatttggctagagccttacctaatacctgagaaagttggcttagagcttctcgtttggaagaactcatagtttttgtctcgcactttgttttttttttttttttttaattcttgagtttattttttcattttactttaagttctgggatacatgtgcagaatgcgcatgtttgttacataggtatacatgtgccatgatgatttgctgcacccatcaacctgtcatctaggtttcaagccctgcctgtatttagtatttgtcctaatgctctccctccccttgccccccacccgccgacaggccccagtgtgtgacgttccctctctgtgtccatgtgttctcattgttcaactcttacttatgagtgagaacatgcggtgtttggttttctgtccttgtgatagtttgctgagaatgatggcttccagcttcatccatatccctgcaaaggacattaactcattcttttttacggctgcatagtattccatggtgtatatgtaccatattttctttctccagtctatcattgatgggcatttgggttggttccaagtctttgctattgtaaatagtgctccaataaacatacgtgtgcataccacaatgagataccatctcgtgctggttagaatggagattattaaaaagtcaggaaacaacagatgctggtgaggctgtggagaaataggaacacttttacactactggtgggagtgtaaattagttcaaccattgtggaagacagtttggcgattcctcaaggatctagaaccagaaataccattttacctagcaatcccattactgggtatatgcccaaaggattataaatcattctactttgttatatttttatttattgtggaatattttattttatttattttattttatttgagatagggccttgctcagtcaccctgactagaatgcagtggcacaattaagactcactgtagcctccaccaccaaggatcaggtgatcctcccacctcaccctccagagtaggtgggactacaggtgcactaccaggcccagctaatttttaaattttttgtagagacaaggcctcattgtgttgcccagactggtctcaaacccctgacctcaagcaatccttccatgttggcttcccaaagtgctgagattacagacgtgagccgctgcacccagcctattatggaatattttaacttacacaagtgaatatagtagtataatgaactcccagcttcagagagagcgagagagaatagtgagtcacttagctttaagactgtcagttcacagccaatctgacttcatctatacctctatccactttcccactcctctattatcttgaagcaaatcctagaaatcatattttattcataaatatttcagtatgtttctctaacagataaggacactttctttaatataaccatgatgccattatcctaaaatagtaattccttaatatcaacaaaaatccactcagtattcaaatttccggttgtcttctaaaagtcatatggggtcaaaccaagtctctttgattttaggttctacttgtcggtttgaaccaggcgctgaacagctccacacctgctgactggctgtactatcttttgttttcatctctggagttcccagccatttttttttttcaacatttgtggaagaaaccagtttcttttgtcctgtttcctagtttcgattttgctaatcatgtccttgtggggcgttgtgtaatatttttctctgtcttctgtgtttttttgtggattggaagctggagcagtggggttcatgaaactcgatttttttaaacaggaaatctatctacgtgaggtgttgtcttacaaggaggcatacgatgcttgattgtctttcattttgttatgttaacagacctgtgttcaatgcctggatccattattttaagaaggcttgccaaatgttaatgctccgttctcttgtttcctcatccattcagtggaataactccacaaagagaagcttcctcccaaatactatttagtaattgtgtggcaatattttaagtctttttctttcattaacatacatcaacaacaaatataagatttgctatgtataactccatgtgtgtatatggaaactgaggactctgagttgtcaaagactcctagagctgcctaaggagtttcatcaatagatctctcactgttgttggtcagcagcttggagacagttccttgacagtgcctggctgtctagaagagaacagtccactccccattctcactggagcttggtgtatctgtgtgactatgttccggtcattgagataaaagtggaaaacatgaggctgctttcatgaagctgtcttagaaggcagctttgctggctcctgacctcctcttccttgcctcttcctcgtgcttggaatacatggaatgcagaagagagggctggaggtcctgcagccttcttggactaggaagtcaagctccacaccctagaaatagcaaacatgaaagccacaaagtccacggatccctgaaactctccacatgccatattaacctgagctgcccacctgcaggttgctttcacgtgagagggaaatagattgctatcttctgtaagatactgtattggggataaggaggttctattaatcttgatgagtggagttgtccagctcccacatcctcccaggtgaagcagctcttctcttcactctgcaaaccttgaagacctgcttggagaagggctggggggagcatgggtcatattctcctttggcactccctccactggctccagctcaataacctttaattcggatgacacatgaccccactcagctactccagtcctgaagtagagttaaatgggaagttatgtgctccagatacaactctggtcttatctcctacctctttaaagcatctgtggaggcacagacgccagcagcaatggcctccctcccgcaggattctgtcatctcctgtttccaggcacctggaatcttatggggctttttaacttccaatcataaaacagctttctctgtcatccaaggcatgcatgggccatctcagccctttgatcccctctctccctaacaatgctcacccccttggactgtgtttctccaacatgtctggttctgccagcacacatgctaaaaaaggacaaatgtggtttcttctctgttatgatcatcttgtctggagaatttgccagaattcatggagttgcataaaggtgctaagtggaaaaatggactgtatttaagctcaattgttttgagctatgaaaatgcaaagatgtgcctccaccttgcttcttgcagattttatctaagggtctagaaatctacaataagacataaatgccatctaccctctctgagacttttgagtccataaagcaaatcatcaccctctaattaagacctgcttgtgttttctgattaacagttaagggggttatttttgatatttcatgtgggagcttcacatgtgtgtgtcgaccaatatctcagatcaatgtgtgcgttcacagagctttgtgtagtgctgtgcatcgtgctcctaatcccacttttagtaaataaaaaagaagtgaggtggtagagatagcaagtgcacacataggggcagaaggaattggtgtgagactaagcatgatctaatctaatcagagactcaaatttatgagactcattacgagactatgacacacatgtgcttatttccactttacaaatgcggaaactgagctagcgagtgatgcaaacaaaattctaattccagccttgtctacttccaaaacccgtgttcttcccctgcactgctcccctgctgttgatttgagcctggtggtgaacctcggctgctaccaaatttatcagtgggaggtccttgtaggagagcatctggaaggaagagggcgtaggagacctatcttgaggttgtgtttgcacgggaagaaagctcattgctctcgtggagtggggaggctggagataataagggggctaaataaagctccttaatgtaggactccaatcccagcaaaggaatatgacagaaccaaaaagcaaaaccaggcaactcatgtaggaaggtggtccccgctggctccccttccaatttcaggagcactgtagaggctacggggttgcatttcgtattctcttcctttactgatgacaagttgatacatgaaaccacagggaagttgttgaatcatctgaatgacatttttctccctgacttaatatattcttcagttaaaagaacgctctgaagaggttttgtcccccggggttccatccttggctcccggatctcattccacagccccacccaagacttcccccgagctttgggctcatttatccaagtgtctgccgggctgccacctggatgtcctgcaggcactgccgctcagcaagtctgactctgagccccttttcctcccacaggggcatcttcaaggctggcccctctgtctgccccatgcacctgggctacgaccccagatcttcgaggctggcccctctgtctgccccacacacctgggctacaaccctggagccttgaccccctccctcttctttatcctccctcactcaaatcaccaaaccctccaccccaggctggggcagtcactcttcgtgcacacatatctatcaatctatcaatcaatcaatcaatagataggcatatgtatcaattgccgagtgaccacataatatcctatttatctgcatatgtgtctattttcccagctggatcatgagccacatggaggcagagtgaagacttgtttcatcttttaatctgtaatcctcagcagcacctgacatgagacctcaataaatatttgttgcatgattattgttgaatgacttgtagacacaaaatgctgtataagcatgagatgcagcacgggtgtgtggagagaggtggacagagaggaaatttatttacaacttacacttgttcatgaacacagccatgagctgcgtgctaggggtgcaataaaagaacaggaaaaaccccactagagctccccagtgatagacaacgagcatgtgaacactttcataaggaatccaggagaacattctggtatgcgtcacacaggcaatggcccgggtgctgtgacagggagtggcggggtgacctgctttttacagagtgatcatgaagggctgcctgaagaagtgagagtgaatgcgactgtgaggagagatgccaaaagaacattccagaaagagggaagagcaggcgtgatggccctgcccaggaagggcatgcatgtgtggaatactcaggccgcctggagcctagtggggtgcagggagcgtgacaggagatgaggttggccatgtggcagggccaggcctggaggagcccacaggcaggggaggggcggggagttcattctcagacccatgagaatccaataaggggtgtttttgttttttgttttgagatggagttttgttctgtcgcccaggctggagtgcagtggtgcgatctcagctcactgcaacatctgcctcccagattcaagcaattctcctgcctcagactcctgaggagctgggattataggtacccgccaccacacctagctaattttttgtatttttggtagagacggggtttcaccatgttggccaggctggtcttaaactcctgacttcaagtgatccacccgcctcagcttcccaaagtgctgggattacgtgtgtgagccactgcgctcagcccaataagggatgtttttaaactgctaatcaatgaattaaggtagttgatgtcaccatctgcaatggtgacttcaaccccaactcctggctcacactgatgagaataatccacttggcagtctcaggagggctgtgcaggtgtgtaggttgcgggtggattctcctctggaaggaagcccatgtcaagagccttcgccacaaggagtttttcctgtagtgcttctcaaaggctcgggaggcagctgggccagtcctttcacttggagatgaccttcctttgcggctctggtcaagtcagtacacaccttctccaaggattgcatgttgcggctcattagggagacttgaacttggtgaattgcgacctctggccctgtgggtgttttccggtgtctttaaaagccatggtccagcgcggcttcctgaccgacttgttcattggcgaaagccaacagcggtgagtcaggagtgagagcaggcggaccacggctctacagcccccgggaccgtattttcctcagaagaaaagtcccaacaaagggttttcagcaactgtttggagaacagattgggaaacaaggctgagagtggaagtagggaaaccatttaggaggctgtaattgcaggggccaggcaggataaggtggggcttagaccaggtggtggcagtggtgtttacagacgtggatggttgaggtgtgtgccaccctacagaggttgatttcaggaagacagttccaaattcaaaattcagcccaaaaattcattttctgagtaggggtacaggcacacagtaagttacacgagtctggagctcaggtttgggttggagatatacatgtgggcctgtttaacataaaaagagcatacaaagccatgggaatgaatgatctcatctccaggaaggtgtcggagtgagaggagaggaagagccaggaatcacctggaagaaattctgcacagagactggaaggaaagggaggcccagcaaggtacctggcgtgggagccgctgggcaggggagggaagaccaggaaattgggggcctggagactgaagcagacgagagcttcaaggagtaggaggcgagacggtcgcctgcaatgtcactgagctttgatgacccacaagcgactgaaacatgcagttagaaggaagaagttctcgcgtttgagggcagaggaaggcaactagagttaacaacaatgcgtggcatatttcttttttttttttttttgtactttaagttctagggtacatgtgcacaacgtgcaggtttgttacatttgtatacatgtgccatgttggtgtgctgcacccattaactggtcatttgcattaggtatatctcctaatgctatccctcccccctccccccgccccacgacagtccctggtgtgtgacgttccacaccctgtgtccaagtgttctcattgttcaattcccacctatgagtgagaacgtttggttttttgtccctgtgatagtttgctgagaatgatggtttccagcttcatccatgtccctacaaaggacatgaactcgtccttttttatggctgcatagtattccatggtgtatatgtgccacattttcttaatccagtctatcattgatgggcatttgggttggctccaagtctttgctattgtgaatagtgccacaataaacatacgtgtgcatgtgcctttatagtagcatgatttataatcctttgggtgtatacccagtaatgggatggctgggtcaaatggtatttctggttctagatccttgaggaatagccagtgtgtgggatatttcaaaataactacaagaaagggcttcagatgttcccaacacataggaatggtaaacactgggccgatggacgccccaagtaccctggcttgattattacaccttctatgtatgtaaccgagtatcacatggtcagataaatatgtatgaatattaggtatcaattttaaaaactaacgaaaagcagaagaaaaaagtgatcattggattggaagtaaccagcgtcctacagagagctggacgtgatgggtggcggcggagccagacgaagaggctggaggagcggacggagggtgtgggtgtgaggaggtgaggctgagcttgcacgggctgtgctgtggagaaaagcctggcacaggcaggggtgacaggtggtgtgcaagacagaagaaggtctatgactcagtagagtagatgaggcaagtcagcgtgttgaagaaatgacccactggaggagagattgatttttccggaaaatgaagggtcaacagaagcacagccgttgagtggtggagggcagaggtttccagaaaataggaggaggacctggctgtcgactgcaggaaggagcattctctccatcaatgcaggaagaagtgagatgggtgcagataccagaaagaccatagatttggtggtggcggattgaggtgtttacttttgcaaggagccgtgagggccagtgctccaagcaccattcttagaaaggcactggaggcagcctcttatctccataaccactcgtggaagctttcagtcaactcagggaccgcctggcattttccaaaggccaccaggatgcgtggctcaggcaagaaccacagagtctgtctcctggacgtgatcagcactgggtgggccaggagagctgaggctttcactggaattcagagagaagggagaacaccatcaggaattgaggactggagtggagatgcaggcaggggctggcccacggcagggacacaggagggggattctatgggtagagtgtgcatgggtttcatgctacatctagctcggagcatcaggccgccctgggaatgatgctgcctgtagccagaatctacaacacggatcacagctcatgcatgtgccccatggttccctggttaatgtcaaacacagccccccttaccggagcccaggctcctgtaggatctgatctttgtgggtggtagaggtgaccagccatcgcattggctcaagacaggggtttcctgaactcaggacaggagccgacagaagctggagcaccaccccccaccccacccccgaccaccccaagaccttcatgctctctacgctgaggctcggatgctgggcttccggtgtgtttctagaacgttccagcctcggggctttcactcttgtccccacctttgtctagaatactctgcccagctctccacgtggtttccaactcttgccatccaggcctcagttccaacgtggcctcctctaggaagcctgccaggaataccccctctgaacaacccacatcccgccctctcgccctggtgtactactgggaacaactttatctgggagtttgtttacttattcaatgtctttgtttaggaggcaagctctttgaatattcattccataaatgaatgaatgagtcagaagtaagtttatggctggtgttgaggccaggagaagggaattggggaagaaagatctaaacaaaccccaagcacacaaacacaagttgcatttgtcccctgtggcaccccacacctagaggcgcacgcctacaggtgtgactacataaactcatgccgggtggctgggctggagaggagggaaggcctttaagcgtgtgcatgtcctatttgttcctggaaacctgtctctaactgcaggctgcctgtttccccgtttaagcttcttcctggcttttaatgctattacatcttcgtttcagaaactggcttttttgtgattctgtccctggactgcattttccatccctccctccgtccctttcttattctgctacctcctgctggcaaacccatctctctgcccagctaatccctccatgctctgtggattcttggggtcaactccgtgtcatatttgcttttgatttcctcctctgctccccgaacgacttgggttctatgtagccatgatgcgggtcccagaccaaaaagtaactttgcttaggttttaaaaattctatcaattttttcccctcttttaaatagacttttaaagagcagttcacagcgaaattgagcagaacagagttttcttatcctcccccctgccccacacaggcacagcctcccccgccatcagcatcgcccaccagagggtccattagttacacttgatgaacctgcagtgacacgtcattatcgcccaaagtccatagttcacgtgagggtttactctcggtgctgtacattctatgagttttgacaaatttataatgacacgtacccaccattagagcatcatacagaagagttccactgccctaaaaatcctccgtgctctgaccatccctccctccctccccctcacccctggcaccctctgatctttttattgtctccaaagttttgccttttccagaatgtcatctagctggagtcattccgcatgtattctttcagactcacttttttcctttagtcatatgcatgtaagccatatccatggcttttcctgaatcagttcttcccatttttttttttaccccttattgactgtcctctcgtgtaaccaagacagccaccacagcaggagaaagagaggtgaaggcacaacctcgcagcttcagactctgagcctccaaagagtgctttgggaaccctgggaaactcgcccaacccccccccccacccaacacacacacacccacaaaccgtctctgcatgaggccagcttccctagattcttgtctccccccaccgcccaccccccaccattcccatcaagtcccataaaaatatcaaacaagaaagtaaaatctctccctgtttttcaaaagcaaaactttaacgaatggtctttgatccacaaatgtaattagcattagaattggagatggaacggatatttgtctaaaagcattaatttaaatcctggcccagtttttttccttatcagtgctctaattctaacagtgcctgtggcagaatcagaaatcagagggaaagaacaagtgggtcttcatgcagctagaatgcaggggaaaattacgtggaaaacattttcagcatccacacgcaagagttggagtgacccaaggaagggagttaggtttgcatattataaacccaaatttgccaccaagacataaatgatggaccattttcactgaccatggtttatcttcatgttttctttctcataatcaacaaggaaaacggtaaagtgctaagaacagaagcttccagccattgtcctctggccaccaattgatttgcctgtaagtttccttccctggaattttaggcgttgtcatatggtgcttataggcaattattttacagccaacgttgaagagttcaaaggagggttttggagatgaaagacctttatattatttaaagtggaagggacatttaaatctaaattattctcgtcatctgctgtattagggaacttgggtggccatcccaaagtaccatagaccatgtggcttaaacagaaatgtactctccctcagttctggaggctggaagtccaagctcaaagtgtcagcagggctggttcctgcagagacctctctacttggcttgcagatgctgcctcctccctgtatcctcacgtggttgttcccctgcacatgtctgtcctaatctcctcttgtaaagacatcactcaaatccgattagggctcaccctaaaggcctcattttaagttaatcacctgttttaaagccctatattcaagtacagtcacactctgaattactgagtattgagactaaggtattaatctcgggagagacaaattcagcccatagcacctgctctgcaaaccaccctgcaagatccaacctcttgccccaccagcaggagaaccaggtccttccctgatctagaagcccccttggtacgcccaaccccaggccttccagtggggaaatgcagtctccgcagccacagagaagccagaagcccccgaaaatcagccaccgagtggcgccactgctctctaccacctcggtaaccgagctccctgcaagttgagttatgcaaataacttccgcgtgtttgacactttgttctcccttgctcctgaaaacccgccgcaaagcttgccatgcgccccgcgtcatcctggcgtctgcctcctttggcaggggaattaatggttttttagaggttaataacttgttggtgtttccccattcccttgatggcgttgtcatcttccatcttttttcatttcctaaggaggaaaataacttctgcggaacaaaggctgggcaactgcgccaaaggcagccctcagaaccttatcaaagccacagcggagtgggaataattactcattctcagctgggggtgtcagtaacgccatctgagcacaaggatcactcattcctttcaacaaggaaaattaaaaagaacacgcagaagaaattctggggagaggccagggacacaaaggcagccaagacggtggcggccaccctccactcaagggctgctcctcagaggcagtggccgtcctagctctaaatggtgtttaaaaaaaaccctagcatgaggaagaagagaaacaaaaccttaatcttcttttttgaaatttgaaaaaacaaaaaaacatctgatgataaggaaatgggggtggtgagttgaaggactctcttttatttaataatttattaggctgctcttcagaaaagtcggctctgcttccatttttctatttaaaaatcagtgtaaactcataggagaggacagctaggagctccctcccgacgtcgggtggtccagcctccaggcagaagcaacccaactggagggtcagtgatggagacctcaaatcaagtcatggccaaagcaaataacgtgcctgtcaaatgccactgtgactgtaaccttctccctgagtagtttccctctccagaagagcatgtgatggggacaagacccctaaaattagagacgtgaaacgtattcggcagggaaggtggttaacaggagagcatctgtgcgcacgtttgtatgggagagtggcatgtacatgtttgtgtaggtgggtcagtatgtatacacatgtgtgcatctgtttgcatatgtatgagtttgtgggtgtgtgcatgagttttgtgtgtgcgtgtgtgtatgagtttgtgagtgtgtgcatgtgtgtgcatgagtttgagtgcatgcatgtgtgcatgggtttgtgtgtacatgtgtgtgcatgagtttgtgtgcgtgtgtgtgcatgagtttgtgagtgtgcgtgtgtgcatgagtttgtgagtgtgtgcatgtgtgtgcatgagtttgtgagtgtgtgcatgagtttgtgagtgtgtatgagtttgtgagtgtgcgtgtgtgcatgagtttgagtgtgtgcgtgtgtatgagtttgtgtgtgcaggagtttgtgtgtgcacatgtgtgcatgagtttgtgagtgtgtgtatgagtttgtgagtgtgtgcacgagtttgtgagtgtgcatgtgtgtgcatgagtttgtgtatgcatgagttgtgtgtgtacatgagtttgtgagtgtgtgcatgtgcgtgtatacgagtgagtgtatgcgtgtgtgtgcaggagtttgtgagaatgtgtgtgtgcatgtttgtgagtctacatgtgagtgtgtatgtgaatacatctgtgtacatgtgtatgagagaggtgtgtgtgtatgagcgagtgtgtgtatgagattgcacgtgtgtgcctatgtgtgcatgtgtgcatgttgaggaggaaggacaggaggctctccccacctccactgtcacgctgatccattcaacagattcctctgtgagctgactgtgccagagcctggctgaactgaaggccttggcagctgtgaaacatcctctggtcttcctcgaggctgggatagtctttcttcctttcacttggtaaacttggatcatgactacatgttgttcatggaagtgtgtcccatctgcccacgggattcccactctttgggggatcaaatatatatgattagtgggtggaccagatggcaggagcgctgagataagagccagggaaagagcggggaaatggctgggcaagcgcccaagtcagttcctacgaatgtccggaggcagcgtgagctggcgtcatacatgccttgggaagatacctgtaatctcacatgtacaagtgtaagtgtgtatctagtctctgcccttgagagaaagccaaacagctcaccaccaggataacgcgcgagggccagctgggttgcgggtggtctaagctccacgcagaaagggagaagggggtgcccctttcagaagggaccatgtcctcaatgagaatcttttgtctggatggcacccctgcatctgtgagtgcccaccttacacaatggccacgactctcagcttcttccttcaaagctcaacacgccctccatcacacagtgatctgatttgccataataaaaaatataaatacgtattcaataatacataaagaataacaaaaatgcattctttgtatagagacacacaggtagagggtagttgatcaggagtagacagaaggacctctttttctttaaacagtcaccctttgtacatgattgagacaagacctgagtggtggctacagtaatggaccagacaggcaggagaaaaggaatgggtgctccgacaacagcaggttttggcctttgtctgcttagtgggaggagctgggtgaggcttcgtggtccttcctgggatttgctttttgcctgtgggagggacttaaacagtaagggccaccctgcataggcagtcttgggtgctgtttcagacaggggctcccactgaggtcgtgaggacgacaaagctcgtgggattgcaggctcagggcctccaagggaggacgccttccttcctggaataaacaagtgtatggccttcttcccccacccctcccccagcacacacacacccactctccctggtgggagtctgcttagcttttccataataaaaatagtccatacatggtgtgtattctacaagactggtagaactgtattcaaaatgagttgagtaccaggggaaaacgcgctctccattgtcaaaaagaaatggttggtagagctttgatttttttttttcctttaaaaaaagcagtagctactttcaaagtcaggagaggcaattttttttttaacacaaagaaagagcaacagcagggtgttcccttcctctgtctgtgccctttaaaattccagcttcaggatatgctattaattttctcctttcttttctggatgagatttcgaaaaatacccatcctgctgtaaatctctgggcgaattattttaggatggtttgctctttgggatgtggaatgggcaggaattccttcacccagagctccctgaaccatcggcctcgcaccctgttcccaccccaagagtaactggtgaccacatggcccacgtcctgctggtcccccagcaaagcaaatgaaaacccatcaggtctgcctgcctccattgccacataatgcagggatgtgtctctgcggtgaccccagggccaacagttattgtgagcgggtcaaagcgctgaatatcaatagactctttcctgagccctgcaacccaccctctgcctggaatgtaagcttctgtcacacacgctcacctttgccccagccatcttcacggcttctcacttcaaaggatgttcttcacgtggaaaatgctttatgggaaaaaaatggtcatagctacacaattattttagaaactccgcattgtattttaacggagggcagatgccctggctaaagtctgcagggctttcaagattaagatctaaatcctgaggtttagaaacaggaacgtcagaagtacaatcatcccaactacgagcctattctttgctccttgaaatggattaaattaaaggacgagtctcattttgacaactcacctcaccattgtcaaacaaaggtaacacagtcccagtgctaatgaagcagttttttttttgaaagtggaattacactgatgattatttcataactcttggagccttcaaacaacagctactttgaaacgtcggctgtgccaggcaagaagtctgctgacctcgcagtacccgaattttgtttctgaattccacatcacagcgctgtccttggccaagtacaacatgaagatgctacatgttggcccagcaggaaggggcacagaagacaggagctctgagagccggccaaggtccagacgcagagaaagcagatggtgtggaatgagcgggcagattagccagcctgtgggctcgaccccactgccagcattgcttgaagctcaagcacatcatcaaagcatttgggaaaatgtcagtacaataggagagtgacctgagagcacaccttgcaacacaggaccccacgacacgaaggacttactcgcggtgacatgggtacccccactacttgaaggacccacttgccacctaaaaggaaaaaccagagggcggcctccgaagagaatatttggtcttgttctctcggcacaatgtgcatttctacaaaaatagcattgaaacgactctccgattgagagaagtggctcgttgtgaaacgttccccgtttgcactcaccgtttcatgtgaaagtgatcagtcattctccgttaatcagacagcatatgggaagtgcttaatttccattttcaaatgtccatatatgtagtggagggctttaaaagttgaaccttgtcacctgaataaaattgttctatcttttggagaagggtccttataaatacatcccaggagtaaaactgcacaaaacatgactttggcaattacatccatcttctttcctgactattgttataatgcttactttggtttgcttggaacagaaagaaatggaactgattttgaggacagtctgagcaaagaataccacaactgccaggctggtgtctcaactggtcatccctgtgccttccatcagcttgcttttcctggcctgcaaacctgtggagactggctctgtgcatttcacactctaactcccaaaaagagagaagcaggttggctccctgcattctcccagcgtagcaaaacccgactgggcaacgtcaatcccactgctggctgctggccagtctcagtcttggtgctgatcccggatccaaacaagcctgggcaggacattgaaggacagaattgatctctgttcctttacaaggcttctcttaactcctaatctccctctgggtttgcctcagtccttctggtatggaaggtaccttgcatggaaggccccaggcaactggacgacagtgtggaacatgcctgggagaaaaggaccacagggacgagggcactcgcctcccttccatgccagctccttgaaagccagtgttaccaaaacacgaggggctgcgtccaggtcctgctgctcaccacacagaaagccaatcactgagatgatgagtattgccagggaagaaggctttaattgggtgctgcagccaaggagatgggagatcagtctcaagtccatcttcctgaccaactaatattaggggtttatgtagcagggaagaaatgaatcagtgtgtaagaaaacaggaacccaggaggggcaaggaagcaatcatgatgaatgaggggtcccgcatctcattttctggatacaatgatctggggagtttcagttctttgatatgttttttgagggcctgaaggtctttcctgaggaagaagctcagatacagtgaatgtaaggttcaagcttgaagaccagaagggtcactttctatgtttaaccgtgggactactgggtcgcccatgtgtcctgtattcccttcttcaccatttcttcctctctgctttctgttctacctggcttcagtccccaataaaattgcttaagataatcaaggacctcctatttccaaatccaagggacatctcagtctcctacattcacggagcatttcccacaatccccacaccctctggcaaaccctcctggcacctgcaatgctgctgttctcacactgcaacatctcctctcaactctaaaccttagagctcccaggtcttttcctgtctcctctctcttcccagtctataccatccccaaatggcaatggcatggttattcactctcataattgtcccataaaaatagagacaaaaataaaactgaaagctcatgacaaaaacctacaacaaaactgatgacaaggcatcccccaggaacctcaaaacacaaatgggaaatacacatgggaggagggagcaaactacccgaagtcagcatacctgtgtggaaacatctcctgtcaggagcaagcagagagcagtggcacctgccaggcctcagtgtctcagcagaaccagcaggtgtttactggtaaggctggagcactggccaagtgagaacagaagctgaagctgggagagactttgctccaagagctggggagtcaaggggcccaagcaagttcagaagggaaaaggatactgggccctacagactcccaaactcaccagacagaacttcccaccaggacaaacctttgcactgggaatctaaactggggagaggacacaaagacaggtaaaagcatattgtaaaacaagagataagaaatctcagaaataggccaccatgtctttaagcataacatgaaaaaatagaagagggaggttgtattagtctgttttcacactgccataaagaactgccctagactgggtaatttatgaaggaaagaggtttaattggctcacagttccgcatggctggggaggccccaggaaacttagaatcatggtgtaaggtgaaggcgaagcaaggtactttcttcacaaggtgacaagaaggataaatgttgagcaaaggggaaagagcccctaatgaaaccattagctctcgtgagaacccactcactaccacaggaacagcatgaaggaatctgcccccatgattcaatcaccttcacctggtctctaccttgacataagaatgatggggactatggggattataattcaagatgagattttggtggggacacaaagcctaactatatgagaggtctgtaatgtggacctcagaagatgagcttggaaacatgcctccttatccaattctagaaaaaccaactccatgtgagataaacgacagaagcaactgagatataaacccatacacataatcacataaaataagctagaagcagaaaaacatacctacagagagggagagcacaccagaaaaacatatgcatcgatcagaagaaaatgttgctctttttttttttttaaaaagtgcaagatgaaaaagaaaaatataactcagaattagaaaaagtcagaaatgagatgatataattcaggaaagaattataaataaaagacttttctttcagtaatgaaaagtaaactaaaagaaaaacaagagtgaataaacacaacagaatcttttaatagttacagaagttgaaaaggaggacattttgaaaactaaaaagaaatgaataagtgtgaaaaagattttagagaagtgacaaatttagaagataaggcaatgcagatcccgtaaacctaaaatctaagtatctaaagaagaaaatccaagcaagggaaaagcataaacactaacattcaataaaaactttcctgagataaaaaaaaactgatctctgtattaatagggtatatcacatacctaagtaatttgcccccaaacaactaacaatgagaaatggtcaataaaagtacttattttcaaaagaaggataaaatattttaagaataaaatcaaaattatgatgtcacttaaaaaagaaaattaaattgtcataaaattttcaatgccagcatttctaattcaaaaaaaaagaaaatgttgccagggattttatacccagcgcaactgacttttgagaatcaaggttgccgtcacctgtgagaactcaggcagtattgctttcaagagtccttcttgagaatctatcatagaatgagcttagacaacaaaaatgaccagagagctgtggacataagaactaatagtgtgctctaaacatgaagttatttgtagataagtctaattcagtgccatagtaaggaaagtttggtgtggaatcactgtgtgccctgacaagggaaatagaggaagactacctgcaaaaggaaagctggtggggaaacatctgcacacgttttgttttgttttgatttcttactattttcagtggaagtagtattggtattgttattctgagacagctatgtgtgtggtggtggaatgcagcaaatgaataattatatgaagctgctttatctaggattctatcaagctctgtggtcttgagaaccaggattgctagcatggaaaaccacccaaactagtataaaacaggaaatatcaagttgaaaaacttgtagggcccaagtgaaactggaaggaacagtatgaacctgggagatttttttttgttacagctttagatatggaaacatatattgtttagctctgtcccctgaaaaggcctagaattcacaagagacaaacagatatgggcaatgccagcctccatactgtgatcttgaaatctgttccccaactaaaatgaacaaacaaagacaaataaacaaaatgggactttactgagaaatggctgatcctagatctgagtggaaagatacaggagatctatctatctatctatctatctatgatatataatagatataggatgagcctggagcctcctgtcatgccatataactatgttatcaaagatttacagagtgaagaagagactctctagagccaacggaaagaggatcccattgtgcaaagttgagaaaatcagatcaagaataatgctacagtttggatatttgtcccctccaaatctcctgttgaaaggtaattcccaatgttggaggtcaggcctggaaggaggtgtttggttcatggggaaagatagctcatgaatgtcttggtgccatccccttggtgatgatgagcaagttctcactccattagttcacaaaagatccgtttgtttaaaagaacctggtggctgggcacagtggctcatgcctgtaatcctagccctgtgagatgccaaggcagaaggatcactggagctcaggagttcatgtccagcctgggcaatatagtgagaccgccatctctacaaaaaatataattagctgggaatggtggcacatgcctgtagtcccagttatttgggtggccaaggtggaagaatcatctgagcccaggagttgaaggctgcactgagccgtgatcatgccactgtactccagcctgggcaacagaggctctgtctcaaacaaaaatataaaagatcctggcacctcccctccccttgctctttctgtctcaccctgtgacacacctgctgtcctttcaccttccaccatgattgaatctccctgcggccctcactagaagcagatgccagcaccatgcttcctgtatagcctgcagaaccatgagccaaataaacttctctctctcttttttttttttaataaattacagtctcaggcattcctttatatcaatgcaagaacagactgccacaaacagcaacagcaatgagtgaaaacacatggaacatgttaaacccacaagctcatgatgttgctgcaaaaatggaattgatggcctttgaatgttaaactcactcattatttcaaaaattggtagcaaaagagaaataactgtactatatgaactgtccgatatgaactgtatcactacaaaatcaaataaaacattaaagaaatggcctttttatgaaattattccagctagtaaggaacatatggtagaattacagtgtcatcatttcactacttctaggaagatcttggttctaagcactgaggacccatgactgctaacatcataaaaagggagacaatggatcaccatgtgcttcctggtgggtaaacaccacaccacctaagaaactgcccccctaaatctgattgaatatatcagtccaactcccagtttacaggaaagatgaggaacagaggaacaggttaaactacaccatggggatgctttcagtagaatcctaaccacgggacctcagcatgtcaaacagcctggtatcttcaacaaataaattatgcataaaagaaaaaagagacaaaagcaatgtcaattaaaagagacttacgagacatgctaaagtggacggaaccaaactacagtgcttagaatgcacacttgagtgatgaaactctaaaggaaaaccagggattgattatgaagaaataagagtggcggcgacttccaaagtggagtgcagggtggtgcctggaacagcatctgggagtggggagcggcgaggggctgacaatgtcctaattcttgacttggatggcagctatgaaagttttggttatattatttcactaggcagtacactttcttaatgcaattttctgtatctgtactatactatatactgtcctatatataataaagagtatcaaaatatatattactatgaaaaaaattccatacaagtgaacacatttacatttattccacaaactttagagctgtgctttttaaaaaagcccgtgactccctactgcgtatcattagatgatgcccttggaatgaatgtaaaaatagacagctttgcaagtgaggatgataaaaaggaaatctaagtaatgtagaatgaatagagctctaaattttgaagcgaggaaaggtaaggggtgtgtatgtgtgtgtgtgcgtgcgtatgcatgcatgcatatgtgtgtgggatgtgtgtgcatgtaagcatgtgcatatatgtgcacgtgtggggtgtgtgttcatatgtgaattcatatgtgaacatgtgtgaatgcatatgtgaacatgcatgtctgccagtaagagtgcacatgtgtgtgtatgcatgtgtataataattccagctaaagcccacacagcaggaggggacaattaaccactgtgctacatatatttccacagtctcaagactatttatttatttaaggtgctttgtcttgatcacatgagcatatgtgatgagcccggtttcctggtgcacagggaaagaactgttaatatgaaacacaagtgtaaaatttacacagcttcatgtaccaaaagaagaaccctttatttaaatcaatatataaacagctttgggaatagtagtataactggaaacacaatctgtagatgtaaataaatgaggctgaataaatgctgtgaatgttaactggggcatttccagtaatatctatgggaccttaggcaagttgttccctcatcttggctgtaaaatgggaagatatgagtaccaaccttaaaaggttttttgtttgtttgtttttttggggatagcatctttttctgttgcccaggctggagtgcagtggtgtgatctcagctcactgcaacctccacctcccaggctcaagcaatcctcccacctcagcctcccaagtagctgggactacaggtgtgccccaccatgcctggctaatttttaaatttttatttttgtagagacagggtctcattatgttgcccaagcttatctcaaactcctgggctcaagtcgtcctcttgccttgaaaggttattttgaggattaaataagatgatgcctttggaaatcactggagagtctgatgcatgtttccaaaacaaaagaaaagctggagggtgaagaaattgccactgggagtagtgtaggggttgctgccatagttcaggcagaggaagacccagctctgagagctcaaagagatgggacaggacaaccggttatggaagggtaggaagggcaggtggaaggaagtcattgacatggagaatgacatccggaccagagccaggtgtgtgtgagggcgccacagtgagtttaattttagatatgtttcatcgcagctgcttgaaggtgagtaggcagtgtgtcagggagcccttgggaaatgaggcaccagctcaggggacaggtctgggggagcaccagagttagagctcagagtgtggtaggagccatgggagaggaggtctgtcagggaaggaggggctgacccagaaggggactcagggcaacaacatctgggtcaggagaaagcagagaagggaggagtcctccatgcacagaaatccaggaaggaggaatttctggaggagagtgggcaacagtgtgacacgctcctaggacatcaaacaggataggaggggcagttagcccagccatttgaccatggacggtccaaggtgactttttagacataagttccattagagaacgttggggatttgagacacagactggttgcaggtttggggggcggggtgggggaaagggcgcttgggccacctggtaggagggtagtcatagcttgagaaaccttggagggaagggcagtgaagggggtggggggcattcggctcctacagagaagtcctggctgcaagaattaagaggaaggaatgaataccaagcgtccagtagaggtgactctttgggaaggaagaaggattttgttccaaagaagagatggggatcactgtggattttgtttataatcagagagtgtggatgttgggggcattttggcttatgttctttattttttcttgtggaggagagagcagaaatcttggatttaatgggtgggaaatttgtacaaatccggagcagccacccagaaacatatagagaagttttgccgtgtgaattcatcttcaggataagccatgtgtgttcttgcttagaagatgacgatggatattatggccctgggggcctttcacctccagatttgggaaaatgccttttaagaactctttggagaaaacaggcttaaagaagatgggctggcaccatgagggcttctcaccctaggggcagtcggtgctttatagacataactacaaattccacctctgaaaatatgccagcactgaactcagggagaggaaaaggcatttgttgacagagctgattgttagacactttaatttggaaaatattttggagtagggatttcctttcaggtcccctaagaggtaacagaaacagatctgaaacatctcccctatgttctggaacaaggctaaaatgctttcatcattaattggattgtggttgggttaacaaagaatgcgttgcagcttctctctctctctctctctctctgtgtgtgtgtgtgtgtgtgtgtgtgtgtgcatgtgtgtgtggtgtgtgtgtgcatgcacacatgtacttctttctctcttttctctggataaagcatatggcccgactttattattcattaaacatcttgccttctccattaactttgctcataaaacgtttttaagattctgacatgagaaggacacacacatttctgcacggcctccccacctgcactggttttgtggtctggggatcccggcttcctttctgttaagcctatttgggatgctcttccttcttttaaccctgtgcgtctttgcaactagaaaagggtgcagcattccaacctgaattcagctcagctgcagatttcagtgtctaacagctcctgggaggacacgaaacagactcagtatttctacaaaaaggagagagggtgagaaattggaccaacgagaaagagaaagggccaccgagctgcatggaggaggaaagtgagagaagcaaccggcaatttcgcagtcagaaagctccctggccttgacccttcaccactgaaaggcgagcgggttttatgccggagacactcactgccttcctggaaaatctaaatagggcaggtgatggaggtggtggaaacacagtccagatggagatgggccctttcagttctgagcatcaagcagaaatgcccatgcagacgggtgacagccacctgtgaaaatgcctcgctgattaaaatcagtctctggaggaaccccaaaggacaaggatccattttgcaggtctcattcgtagcaaaacggaactgttaggaactcaggattctcctcttctgtgcctctggtctggcctgatttcatgtttcctctgcactaaacctttctctccatacagatcatgttctgtagcggacacagggagtggctagaaaggagaagtgaaaaatccaggagctcttgtataaaaacatgggatcacacgagggaatttagatggtttggcttctttttctcaaagaggagagaaagcagcttgtcaccattcaaattcagtctgtttggaggagttgttaagacttccggagattacctggcctcatcgcacctgcgtcattgggacgctctcagatccatatttccaaaggagtccccaccagtagaatcagtggattctgacttctctcctagattccagaaggagcctgatttcctagtgaagggggtttgtggtttcagccgggccttccagtgaacctgggcattaacccactgcagacatggtgggcaccgtggtgtgggagaaagaccacctcacaatccttgacgccctcccctcctcctggatgaggagacagaaggtcagcatcagatgatacacaggggccttgggatggatctcctgggagaggagaatgcccagcacttattcccagaagacacaccatgcctgatgtctactttcaccaactcctggtaaccatggatgataggacagcatttattttattaattaaaccataaacaaactccacccttcccatgagccgcagatggatggcgctgcctctggagcagtctcccagggtatctggagaaccgagtcatttctcccatttctttcttgacactccaagaatcctccaacacttccattagtgcctggatgctaatctctctggcctactcaaggactccctcccaccattctcctctctctctcacccatctttcccttttttctccatctttcccatcagccttcagatgtgttcttaggcaatcttaaaaaaataaaaataatgggacctaattaaagagcttctgcacagcaaaagaaactaccaacagagtaaacaggcaacttacagaatgggagagaatatttgcaaactatgcgtccgattaaggtctaatatccagaacccataggaacaaacaacaagcaaaaacaaccccattaaaaggtgggtaaaggacatgaacagacacttttttccattacaattaaaatatgttattctttgatatactgttaagaggatgaaaagacaagaaacagactgagataaaatatttgcaaaatacatatctgatcaaggacttgtatccaaaaatagacaaagaacttttaaaactcaacaatagaaaagtaaaccaccctattaaaaaatgggcaaaagatgtggacagatacctcaccaaagagaatatacaaatggggaataaacattttaaaaagtcttatcatcagacatcattagggaattgcaaaataaaacaacgagataccactgtccgtctattagaatgcttaaaagtccccaaacctggcaatattaaatactggggaggattcagaggaacgcgaaccctcattcattactggtaagaatgcaacataagtcagcaacttagaagacactttggcaggttttttttttgttgttgtcttttgctttttttaagcatagtcttatcatacaatcaagtgattgtgctcctaaatattgacccattgagtttaaaacttaagtccatacaaattcctggacataaatgtttatagaagctttataatcacccaaaactggaagtaattcatacaccttttaatatgtgaatgggaaatgaactatgacaaattcacacaatggaatattgttcagcaatcaaaagaagtgagttatcaagacatgaaaagatatgaaagaaacttaaaggtacatagctaagtaaaaaatcccagtctcaaaaggccatatacttatatgctgtattattcccattacattacattgctgggaaatggtgaatttatagagatagaaaaaagatcagtggttgccaggggtttgggggttggatggcaggtggtggcgaggaatagatgaagcacagggatttttatggcaatgaaactgctctctgtatgatattgtaatatgggatgcatgacatcatgcatttgccaaaacacaaatgctatgcaacacagagagtgaaccttaaagtaagaaaaattttaaaaagttattgaagaggtcaggtgatcctagtaaagactagtagaccatgaccagaaaatctaactgtattataaatatatgaaacaacctcactgaaaagggtgtagaaaaggtgctaacctgtgtaactttagaaataaatggaatttgtaagactaaaggcaaaactaactacagataagcactttattcttgttgacagaattgtttcctattgaaggtacaggctaacaattctgataccactatacacatatactttgaattgaacaatgaagtaaatggcctatggtgggagccaggcttcttattgttggaattggaggttacagacaagcaaaggggaaaggctagagtgatctatgtggtaaaagagcttccaatgtccaaatatggaacaatctgagcaagaaaatagtgttggattaaaacccaaagtataaaacaaatatccatatttgtttataaatataaaataaatatttgagaaaaactagtaaatagaggagaagagacaaatgtgtgcagaattgcacatcaattatgtagacactccaccagtgaggagaggaagcataactccctattccctaagtgtgggatgatcatattaacatccgtccaaagacagtagggacagaaggaacacatttgacaatggagaaacctgacaaacgctactttagacagatgatgaatgtcaacatcagcaggcatttatcatgttgatattatacacccttgatataatgtaatggaaatggcactctacctctgtgatcttcctcctcacaacccataactctagtctcagcatgaggaaaacttcagacaaattccagtagagggacattctgcaatataccagaccaatacttctcaaaactgtcaatgtcatcaaacgtaaggaaagtctgagaaactgttgaacagacacttttcaaaagaaacatacttgtggccaataagcatacgaaaaaaatgctccacatcattaatcattagagaaatgcaaatgaaaaccacaatgagataccatctaactccagtcagaatggctattactaagaagtcaaaaaataacagatgctcatgaggttacagagaaaagggaacacttagccactgctggtgggaatgcaagttagtttagccactgtggaaagcagtgtggcgatttcttaaagaacttaataccgaattaccatttgacccagtaatccccttagtgggtatatccccaagtagtataaattgttctaccataaagacacatacacacatatgttcatcacagcactattcacaatagcaaagacatggaatcaacctacatgccaccaatgatagactggataaagaaaatgcagtacaactgctcagatgatgagtgccctaaaatctgagaaatcaccactaaagaatctattcttgtaactgaaaaccacctatacccccaaacaattgaaataataaaaaagaaacagcctaaaaaataagaaaaagtggaaagaaaagaaaacgtggtacatatacaccatggaatactatgcagccataaaaataacaagatcatgtcctttgcagcaacgtggatggagctggaggctgttatcctaagcaaactaacacaggaacagaaaaccaaatactgcatgttctcactcgtaagtgggagctaaacattgaatacctacggacgtaaagaagaaaccagcagacaccgggtgaagggagggaagagggtgaggatggaaaaacgacctatcaggtactatgcttataacttgggtgatgaaataatctgtacaccaaatccccgtgacacacaatttacctatataacaaacctgcacatgtacccctgaacctaaaacaaaagtaataaaaataaaaataaatctcacaccttcttggaccttgctctcccgtccagctgctgcaccacttccacttccctgctcaggaaagctcctgggaagcactgcccacgccggctgcctcctacttcctgtccttattcctccagtcaaagccctccctctgcatgcccattggacctccgccaggagctgtcagggagccatggggactggcaagtctggggtttaggctgaggttcaggctgatgatatccacttgggagtcgttgccagagaggtggtcattaaagccgtgagaagagatggaccccccgattgggggtggaggtggacatgagagggctggcctgggctctgggtgctccagggtcctctggtccaggggaagaggagggcccagtaggccctgggagagagcagcttatagggcagaaggaaaagcaaagggtggcttcctgaagccaaggggaaatcacgtctaaggacaaggaaattcttcccagggccacagagggctgaacgctccagcagggagaagactgaggaccagcattgggttctgcaggcagaggcccatggggaccttgatggcagcaaagccggtgggcatggggtcggggcaggagctgcagacagcccagggagacccatttcagactttgtgagagcgtgagctggtggcgttttaatcaccatgacatttgcagtcatttattacaacagcagcaggaaacaaacagtgctcatgatgtccacatgtcatgagtggagggtacaactcaccgactcctctgcagctggttaaaaattatagataaggagattataaagggagatagatagatagatgaatgataggtagagagatgaatagatagatagacaataggtagatgatagatgaatagatagatgataggaagatagatgatagacaggtagatagataacaggttgacagacgatcgatgaggagatagatagatagatacagatagattatagataggtagatatatggatagataggtagatgataggtagatgaatagatagatgatagatacatacatagatacatggatggatagatagagctggatagataggtagaagatagatgaaggtaggtagatagatgatagatgaataaatagacatagataacttatagacagataggtgatacatgatagatggacagatagatgatagatgacaggtaggtaggtagagctggatagatgataggtgatagatagatagacagatattaatatagatagagatgatgatagaggggatagtgatggagatgcaggtgtggtgtagaccaagttgtagatatgaacacacatgcagcctccaggctggatggagatgatggtagaggtgacaacgatggagacataggtgtgggtgtgtagactgggttgtagatatgaacacacgtgcagcctccgggctggatggagatgatgatagaggtaatagtgatggagatgtaggtgtgggtgtggtgtagaccaggttgtggatatggacatacagcctcctacctggatatagatgacgatagaagtgacagcgatggaaatgcaggtgtggtgtagaccgagttgtagatatggacacacatgcagcctccaggccggcatcattgcttctgctcttggtagctgccgcagctgcctgtccacacagcagccctggtggtcctgtaacagccccatcatttcctgtcactcctctgctcctcacttccagtaactccccacctgacttagagcagaggccgtggcaccggcagggtccacacagcctcctgtgatccgggcctcagcccctcctgctttcctcttggctaattctgctctagtttccacagatccttccagggccaggttggcctacctcggggcctcagcaggtgctgtctcctcagctgggatgctcctccctccaacctttgcccagctggtcccctttcctccttaaaccctgctctcatgtcaccttccccaggaggcctcttctgcaatcgctgtccagaatttcagcctgtgaccccagctccctgtcttcattgcttttatgtctccagaaccctgtcctcatctagcacatgagagacgctaactgggatcacactgaacacctgtgtccatgcctgcaagggtgggtcagggaggcaggggtctgtgtgtctcattctgcgttggcatctcagtgccttgagcagcacctggcacacagtaggggcacaggagtcacttgttgaatgaatgaataacattataatttatcagctgggtttattataaacacagtatggtcatgacaatagattagaaggttctttttaggataaaagaagaaagagatgatatactcaatggactttggcgagcttagcactacagcgtgctgaaaacccaaataaagaagcgtccttattcctttacatacagtcctcttttaatgtatcatcaagaattgtgttatttggggacacagaaaaattcaaacactttgatcatgatccattcattgacttttcaagaagaaccttagaagggattttgactgtgtttgatgtacctgattagaaagcaaagcctcccctacctaaacttccattgtaaaagcccaaatctcacagaagtgcatcctgcagacttcaatgggttcgtccaaggagcaggttttgttcatttggaagaaaatagtatttgcaggattttgagagcacataagttcagcactactgggttcaaatatgcgcaacagacccacccactccgatgtgtgctcccttccatctcagaaagggacaggagtcctgccacttccagctcccactccacttgacagtcacccgtttccaatctcaggagtctaggatggtctcacttcgatctttcataagaagggagagtattgcccactcataagaagggagactgttgcccatttggatgggagcatgcattttccatggtgcagtgcagatgggcatggccgcagagcaccagctcccatcctctctcccctctctatgctgtttaccgttccagggctgagggccctggttacaattccttgacacccactggcagagtgaggtgcttcataagtacacactaagtattgctcagtgatcccaataactgccccaaacagcaaatgcagggtgaaagcgagcacaagggattctccataaataataataataacagcctttattatctcccaggtgcctccttggtgacaggccctctacatgctgtccccattacatcttcccgacaacacgaggtagaggtggctcctgattatagaccaggaatctcaggctcggaagaacccgggagctacccaaagccctcagcagttgagtgcaagagctgcaagtgtgaacctggactctgtctcccagggtcacggtcacaacccatatatgaacataccactaacctttgaaggtcttctgtgtatgattcaaactgagcctcagaaagacaccatgcggtggctgtttaatgtctcgtgtttcctcatgcttctgtaacaaggtagcacaaatgcagtgacttaaaacaacagaaatttgtttctcatatttatggagaccagaagtccaagattgaggtgccactggagttggtttctctggagactctgagagacagtctgtcccacacctctctctagtgcctggaatttccagcaatcctcactgctccttggccggtagacacctcacttccatctgtctccctcttcacatgatgctggcctctgtgtctctttgtgtccaaattcttttcttcttctaaggaccccgatcactggattagggcccaccgctcatctttacgaatcacatctggaaagaccctctttccaaacaaggtccattctgtgtttcctggtgagcatgaattttcaacccagcacaattattatacctccaattatccccatttcatagatcaggagaattagaggagctggacttttacaaagttgctttgcccaactgacatatggactgaagccaaggctttctaacccatggtctggtcttctgctgcttgtcttaaaaacagcgacagtccaaggggttcgcattctgcaagagcatgctgggcagagatggattttactcaccagaaactgaagtgacttacttgcagccatgatccggaagagaagcttcatgatgtggttttatgaggatcttgtatctccctcttacccagaagtaaacaccttcacttgaccttctgcggctccatccactgtcacacacgtaaacaccccgtccagtaatacactccaacccaaatgcagacaggaagatgttcctaaataatggtattcctcgggatgctctcatttcacaagaaagtcgtcagatggcctaattcccaatttcacataataattccacaggggtgatttctggcatatctcttatctctacagaagaaagcaagcagggtccctctatcagggcccacagatgtgtgctttgaggagctggaaaaaatgtaagctggagtccctcggctttcccagcggcctttaagtcctttcaggaggagcctgccgctccctggcagggatttgcggtctttgcctttgtgaacaactttactgctcacttcaggatggcattgcaacatcttctttcttcgtgctcagaatccctcaagattgaattttgttttaagatcccatcagtgttgagaaatgttggtaaatacaacaacattcatagcaaactttgatggaatatctgctgtttatcacaaactcatctgggaactttacacatattgtttaagttaattttcaggcagcccctatgagtcaattactattattattcccaatctacaaataagtaaaataaagttcagagaatataaggaacatgaaaaggtcatacagctaaaaggtacaagagtcatgaaggtaaggttttttgcaatgcatggtcacatgtaaaagaaactgtcatatgaagttaaagtataaaaatttaattccactagtaaaataccatgacaggatgacttagtgatctccaaaatcatcacagttgaaaaacgtcttgctctgtattcactacctggataactgtgaagactttttctgtgcattttttaaaaataaaaacctattgcctggatttaacttttctgcatcattcttttgtcctaaatgtctgccaactgcattgctaccacaatgttattaagatgcttagattcaaattgagatagttccaaggactttattaattagcccatctaggaatttggatgaatgttctatgcaggttcttcctgcacagaatccctctagatttaattttgttttaagattaccctacatgtacatgtaaaggtgatttgccaaatcaccattcaacaatattaccgtcataattgtttccgacaataatcatcaagggatgctgaaactagtgggtgaaagttcgatgagaaacaggatacttgcagagtctcaaagtgtttccctgcaagatactcataactcacaaagggaaaaatagtcactttgcattagagaaatctcatggtccccacctggggacaagggcgatatttttcatgtaaccaacatttaccacccgccaaagaggacacaaagcagaattaaatattatcctcgaccccagatcatttagaataaccatcaatcatcgttacatttctcctggtgtaaaggatgtttgaggttaagccaacttttttcacttcttgaaagattaaaagggtaggtatgaagggtgggggctgatgggtgcaggacgaggttgcataatgaaggtgtacagctttactcccaggaggcacaagttgaaacctggagagaaacccagtgaggtcatgttaatgccaagcccttttcctgtgaagagctgggcaaacaagactcccccatcaagccgagaacttccccaataagaggacttacacagtcatgaagggtgccacattttcctcaccgatgacatgtaaagatgttaataacaggaactatatcttatttatttatcggtcttgcactgcccataatatttggtatcctggagaaactcaacggatgctttttgaacgtgctaattaataaagtccttggaactaccttaatttgaatctaagcttcctagtaacaattcccattgtggtagtaatgcagtggccagacatttaacatgatgaaatgcagtggaaaaattaagtccaagtgataggtctttattttttttaaatgcacagaaggaggcttcatagtataccacgtagtgaatatagagcaagatgtttttcagctgtgatgattttagagatcactaactaaatcatcctgtcatggtgttatactagtgaaactaaatttttatattttaggtttacataacaacccaatttctaattgagctttttttcttaccttctgtcttcaaattacattctcatttttatatcgtagtaggttgtagcatctatgaaacactgattcgtttattgaataaatatttactgaatactcactctgtccctggcatctattggacactatgggaaatgttagtaaacaagacaaatctgctcacagaaagctaaaattcaaaaggcagaaacaaacattgaagaaagatttacaaatgtgggcattaggccaggcagtaggtacaggaaatgccaaggtggtaaaaagtggtccctgccctccaagagactcacgggttccttaggggtaaagaaactagtagtgatgatggtagtgatgatggtgatgatgatggtgatgatggtgagcatgatggtgatgatggtgaagatggtgatgatgatggtgatggtgatgtgatgatggtggtgatgatggtgatggtggtgatggtgacggtggtgatgatgatggtgatggtgatgtgatgatgatggtgatgatggtgatggtggtgatggtggtgatggtgacggtggtgatgatagtgatgtgatgatgatggtgatggtggtgatgatgtgatgatggtgatggtgatgatgatagtgatgatggtgatggtggtgatgatggtgatgatggtgatggtggtgatgatgatggtgatggtgatgatggtaataatgatggtggtagtgatggtgatgatggtaatgataatggcagaaggaagtggagggggaggaacaagagaaaaagaaggaggaggaggagggggaaagaaaactgccacacctttcagagcagaattaacatgagcttaaatatcagaaaaatctgttttccagccctcgtttttctccttaccaagagggatatctttacacaaattagttaatgtccctgctccttaattttcttgtctctaaaattgagattctaatacctatttttcaaggccatcgataaggaaacagtagagagattaattatctaaatattttaaaaccaacaaagtgctctcaaaaaggatgtttgatcaaaaaaacatgttaacacgtgcctccctttcttgctccaaatccccagaaactacaggaaaatataatatatatttaaaaatatctaaatatctgtagaaaacaataacgatgccatcagtagaagagaaaacttccagaaacacctgaaaatgagcagttgggattgggtgaatcagatcaaagtctgggctggtgtccagtgctccaccaggagctactggctatgaagatggtgaaggagaccgcaccccagagagcccacaggtggtagagacggaactgaatgtgtgcccagactcttgtttggtggggtgaagctattgattaatattagacattaataaaaatttaaaattgaatatgatggttaaaaatttaaattacctctagaaaaatataactagtatgtataactactaaagcagttgtttataaaaagttaaatggaataaatgagacttgcttagctcaacttttaaaaaacaaaacgtggaaaagaaacaacataaaataaacagaaatacaagcatgtaaggacatcatgagataataaacactattcacccaattcccctataaaaggaaagacaccttcaacttgggtacaaatagaaactcagctacatgctgtttacaaaagggatatcaaggatgaagtaagtttaaaagggaagggatataaaaatgcaatattaatttagaccaatgaattcaaagtaaaaagccaaagaagaatattcagattaccagaggtataatcattgaaaaaatatgacaatcgcaaagtcttatgcccaaaagttatgggctaatcttatatataattataaatagacaaaatattagcatactgagtctagtaacacattaaaaggataatatatcatgtcaaggttgaacttatttatcccagaagtctttagaatgatcataaagaaagggatggaaaactataaaagaatagaacaccttaaaaatgtgtggatttgcaaaagaagcatgtagaaattctaagattaaaaaaatagtgttggaaataaaacagtcaacggatgtgaagtaggaggcggggcatagctctggaggcagggtccgcactccagaccagatcaaagactggctgaaaaacaggaaggaggtgaaagcagcccttcataagacacgcccaccagtgcaatgtcagtttaccattgccatgggaacacccataagacacgcctaccagtgttatgtcagtttaccattgccatggcaacacccagaagttactgccccttttgcaagacaacgacccagaagttcccaccctttttctagaaatttctgaataagctcacccttgtctgggatggaattaaaagtagatataaatatggctgcagaactgccctgggctgctgctctcaggcactgcctgtgggccctgctctgctgtggtgtggtggtcacggggctgctaccctgcacctccataaagctgcttcctcctaccaccagctcgctcctaagcacagccaaaatccttcccgggctaagcccagtgtggggttcgcctgccctgcttcagacggattgaagatcagatcagatacagcggaagaaagaactactggactggaaggtaaagctgatggccttttcccccatgaaccacgtagagatgaaggaatgggaaaggaagaggagaaccgtgggctctgccaaccattcccctgtgggagcgtgcttggtctaacctcactcttccttttccattttgctgtggccacctctgccacctcagaggttcctaggtgccattcccactgcctgggcctctcatatcctgcctcttcccaggaataattttcatttcataggtgtcagctcaagtcccatttaatgcattcaacaaatatctatcgtgcctcgtgttctcactttgactcagcagaccctgtggatagagagtgagacagacaagtccctgtcctcatggggcacacactcaaggcttgggggcatggggagcagatcatcaataggatgacacagaaagaagcatattttaattttgataagcggtacgaaggaaataaaacaagttttcttcagggaggccttccttggccatctggtctaacctggccccctattctctaacacgttggtcaatttgtcagacccattgagcttaatccatgagaatgtcagctctctaagagcagagccctcatctgccttgcttatggccatgtccccagtgctgtggacacaatagctgttggacaaataaaagagattgtaaataaataagtgacttttagtggctctcagaggcaggtgctagcctcccatggctaattttaagcctaggaatgtctttgctctcatccatcccctccccctttgccagcagtgtgctagtaaaggtttaacaattaactcttcaggaaaacaaaatgaccagaatacaataaatacaataaacacacttgatttgtcatgtttgccaatttccatggtgtaaatactcccatcgtgggcaacttcaagttaccaacatgactcaccagacggagatgggaagagatgcctgcagcccccggcgagcgtttcctccacgcagtgagcctcaggagcacaggtcatcacggagtgcattgaagctgagttctcttctacctttatttccaatacaattgctttaaatgtacatttatgtaatttaatttttaataattctgtgtttacaactggctcacaaaattcctggaaaaaaaaaaaaagcctgtatgaacagactccagtgcacaactccctgatgctgagaatgaccagaaatgtaagtggattgaaggaaagccaggtcgttaactcccaaatggcttcccacaaagcgagaagtttcttcctgcactggcacaaggaggccaaagaccaaaagacatgtctgagggcaaaggatgggggtcatatgttatttgactgcactaatggcactcagttggcaaaaacctccttttgtgagtgaggcccacattcccacagcgtctgagataaatgggctccacactccagaatcccagctaattcagctagtaggaatgcaaacactgatccaaattgaggccccagaacagtctcttacatcttcctcgccccaggggggatgaatgaggaagattacttgtggattataattgcttaaaataggttgtgatgtaaaaatctaatcccttctactcttcagtagtaaagtcctacagacagagaaattatgcttaatgccagtgtattgaaggtaaaaagaaaattccgttctccctctgggggaagaggaaggacatctttttagagctgtcagaattcacaagccataataaattattctttttcattactgatttattaagcaggctgcttggtgtaatggcagaaaatttctgtttaattttcatagtattagacgactgtgattcccgatctgaaatcaacttgagttattaaaagaagggaatgtatttaatgtcgtgcatcagggtctgtcttcattaaattcttccaactacagggtttaagcatttatgcaacatggctgttgtttgcttggaaacgagacaacagccctttcttgggacagtctgtgtcaggtgtgctcagcccaatactcttccattttagtgattggcaggaaagtcagccataaaatgctaaaaatgggtctgaaaatcccaagctaaagaatcatagaacccaaataattctctaccatacattttcactggaattaagagtttttaaaatacaactgaccaaaatgtgagaatcattgatgtagctagaactggggtaagcatggtatgtgtcagaaactttcaatcacatacatgaaattataattacgtgagcaatatttgtgcccacgaaggagcaaaacaacggtgcctggctgccttttgcttatccctctgctgctgggagggtcttacactgagttacaggatttcacagatcttagaataaacaagcactcaccaagttcttactacgggatgagtaagactcattttcagccctagaggaggttttaaaatattctggaagacaattatctatcgaagatccacatgaaatacgggatgtacaagtcaggtctgagaaggtgcagagaggcatatactccaccccacctggggggtctcatcagctccaccccacctgggggttctcaccaggagctgagccttcccgggttttatggaattcatctgcaatagaaattttgaataaatgcagcctcttactgccttgcataatatcattagaattttcttgaattagcagaaccagtgagtaaccgggtactaccccattctaggtaacataatctctaggttgttctgttgagtttcacttagtaatcaatctctgagtttgcagaagctggccaggtacaaacgaaatgtgcaactctatccaactgaatgagcttgggacttctggccatgttctaaatatctccttggtgtcttcatatgggcatccacttttcttggatgtagctggccaaatagttgagaccatttctggagtcttcaatggggctctgctactgaattgttcttttcacatggtgctttgaatactagggccaccatgaaggcaaatgccatttgttccccatgaatagagggaggtggcccggatcaccacccagcaacgtgcccggcacaaggagggcactcatcagtcaccagggggcaggtaagtccaacttaccatgactgcttccacggctctggcattcccatagaaggggctgggccatccgtcgcaaatacattccgataaagatgaatgtttagaagaaaataaaacaggggtaaagggatagaggtaacatcagcacaaggaggcagggtgaggaggatgctgtagatggtgtgtggatgctgtgggtctcagagggtgcactttcctgaggctgggatgaccacagaagcccatcctgtgaggaggtgaggatggcattgatgctgaagccctcacggggcccagggaagacagaggactgtgtggagcccaggagagctgggcaggaaccaggtcacacaggactttccagcccccaggagggagttggcattttcctctaagagaatcctgggtccacagatggttttaagcaagagagtagcacaatgtttattttagaggggtcccactggctgcagagtaagaaagaagatgctgactccaaatgacctccaggcaaggtgtgaggtggtgtgtgcttgggtggaagagggcatgaatagcaagggctgtccttgaaatatgtttggagactgaaccaacaggtcttgctaattgactgaatatgggtggggagggtagtgcgagttggtatccggaacgacacctatgttttttggcacctgcggttgctggatggagttagcgttcagcagcaagagaaagacggggaggagaacaagcctggaaaatggagtggctgaggtgggagaggaaggctcttgctgactgaacaactttgtgttggtgctctcctgcctccccgccagcaggattcactgggcctgtgacatgtgaccacctcctgatcagtccacagcccgcctcccaaaatggtgccaaaaacaccgcactgcatcttcaaggaaaaacataaataattccctgccaaggcattccagcctgactcaaaggaggtggggtttgtttgaagaaaatccagctctcctgggctgccacccacctgttcatccaccagggacctcctccttgaagacacctggatgttttggacttggagtcattgacccagtttgcggatggtaacgaaggggcaggagttgtattcacaaaacccactgatccagaaaaccacgatcgggaaggattttcaatttcaatggcaggggtggtgggggtggtgggggtggatattaaaggggaaaaaaaggagcagaaacaaaaataacaaggccattaatctttcattaagttaaagggatgaaaaggaatcgcttaaagtatcattctctcctcgcaccacaagcatgttgccccctgccaacttcaaaggctccgaagagaagttggttaatatagttggcacagtatcaggctgtggtttacttttgcttaagtaggatcttttttttccttttaaacaaagacagcataagggtcggacgctcattgatgggaggtgcaacctgtaacagatgcctttgtgttgggcgcagaggcctttcgcggcggctctgccaatccgcggtggttgtggactatttgtcacagactccaacaaccatcacaggaaaaaaaaatctgccagaaagagggtagagaatagaatcattgttctgttcattctccgccttccgcctctgtagagtcaggcctgttctgtgactcggcatcagggctcctggtggccttcctcaaaatgcagtttgcaggaaagcaagccaagtgtcccacttttcctgcagagtgagtgagcggacaatccctcacctgtttgcgaatggggggataaagagttctgcgctctgggaggctgtatttttctttaaggcagttctgtttatactgaaaacagaactaattggcagtgagtggcagggctttgtggctaggccttggctctgtgttgctgcggctgcaggggcagggcaagctgtccctcctggcaagtgccgaggtctgtgtttgttgggagggtgtggtgacctgcggaggaggccagagctggaagcccagcagaggtttctgaaggccattatcaatgtcctgccatattgaaaggccgtttttccatgtccattccttggtttgtttttttttttttgtacttcattattttcattttcttaagagacagggtctcactgtgtagtccaggatggaatgcagtggtttgaccatagcttactgcagccttcaactcctgggctcaagtggttcttcggtaccaccatacccaactacttttttttttttttgtagagatggggcctcactatgttacccaggttggccttgaactcttgacctcaagtgatcctcttgcttcagcctcccaatgtgctggaagggattacagtcatgagccaccatgcccagctttggtttacttttaatgaggaaggcagagattggggaaaaaagacacgtttgccttttaggaaacacgccataaatgtgatttcctaaagtaagtgggtgcttggccttgcctattggtgccataacaagtcagggttaagtacttcagatccagagatagggtgaccagaggtcccagtgtgtccggaattggtgggttcttggtctcactgacttcaagaatgaagccgcggaccctcgcggtgagtgttacagctcttaaggtggcgcgtctggagtctgtcccttctgatgttcagatgttttcggagtttcttccttctggtgggttcgtggtctcgctggctcaggagtgaagctgcagacctttgcggtgagtgttacagctcttaaggcagcgcgtctggagttgttcgttcctcccggtgggctcatggtttcgctgggctctggagtgaagctgcagatcttcgcggtgagtgttacacctcataaaagcagcgtggacccaaagagtgggcagtagcaagatttattgcaaagagcgaaagaacaaagcttccacactgtggaaggggacccaagcgggttgccactgctggctcgggcagcctgcttttattctcctatctggccccacccacatcctgctgattggtagagccgagcggcctgttttaacagggcactgattggttcgtttacaatccctgagctagatacaaaggttctccacgtccccatcagattagttagatacagtttccacacacaggttctccaaggccccaccagggcagctagatacagtgtcgattggtgcactcataaactttgagctaaacacagggtgctgattggcgtatttacaatccctgagctagacataaaggttctccacgtcctcaccagagcagctagatacagagtgtcgattggtgcactcacaaaccttgagctaaacacagggtgctgattggtgtgtttacaatccctgagctagatataatgactctccacgtccccaccagactcaggagcccagctggcttcacctagtggatcccgcactggggttgcaggtggagctgcctgccagtcctgcgccgtgcgctctcattcctcagcccttgggtggtcggcgggactgggcgccgtggagcagggggtggcactcgtcggggaggctcgggctgcacaggagcccatggagggggtgggaggctcaggcatggcgggctgcaggtcccgagccctgccgcgtgggaaggcagctaaggcccggcgagaaatcgagctcagcgctggtgggatggcactgctgggggacccagtacaccctccacagccgctggcccgggtgctaagtccctcattgcccggggccagcagggctggccggctgctccgggtgcggggcccgccaagcccacgcccacccggaactccagctggcccgcaagcaccgcacgcagccccggttcccgctcgcgcctctccctccacacctccctgcaagctgagggagtgggctccggccttggccagcccagaaaggggctcccacagtgcagtgggtggctgaagggctcctcaaatgccgccaaagtgggagcccaggcaggggaggtgcggagagcaagcgagggctctgaggactgccagcacgctgtcacctctcaccagcatccccagatggctccagaatcactgagttaacagcctctgaaaccctcgactttcactgctttgcaagtatcgtcattcaacctactgaataaattaaatcaggttgggtcctggctccatcgtcatccctggtgagttctgggcaggctgctcacagtctgagaacctctgcttccacttggcccatggtgagaataacattcttcctgggttattgtggggactaattgagagagagtacaagaccccatctgcatgtcacaaacacctgctgcctccgtaaaacacaatggggaacagtggcagggaatgttagcttgtccaaagcattgagtttagaaagaagaatgttatggtttttagaaaacatcatgtatgtaggctgaaataaatgtttctaatagcttacctctgtggagagaaccacaaaacaaaaataagttaggaggagggagtggtggtgcaaggcaaacctcgtctgctgagggcctgccacggggtttgggggtgcagctctggggtgccttcttccagcacctgggaactctaaagcatgtggtagtttctttgcagggcttctgtgaatgtgcaaaatagagaacagggccagcacatagtacacactcagttaaagtgaactgttgacatcattgccgcatttagtaagaaaatctatgaatacagatatatagagatagatgtaaatatagatgtagatatatagatacagatatagataatagaatatgtttcaaagcaggccactagaagaggggccagttgctttccaaagctgggggagactgaggcaggcactcagacagcaccgaaccttcaaggatcttatggataagccattctgtgctactagtgaaatagtcatgatatataactatttttttgagacagggtcttgctctattgcccaggctggagtgcagtggcacagtggtagttcactgagacagggtcttgctctgttgcccaggctggagtgcagtggcacagtggtagttcactgagacagggtcttgctctgttgcccaggctggagtgcagaggcgcagtggtagttcactgagacagggtcttgctctgttgcccaggctggagtgcagtggcgcaatggtagttcactggagcctcaatctccatgctcaagcgatcctcctctctcagcctccttgagtagctgggactacaggtgtgcactaccacatctggctaattttctttttatttttgtggagatggggtctcactacgttgcccaggttggtctcaaactcctgaggtcaagcaatccccctgtttcggcctcccagaatgttgggattataggcgtaagccactacaccagccataaccaactttcttaacttccagttaacttctttccatctcagtttggaaaatgaaaatatttcctggctcaaactgtatgtcaaagaaatcacaaaaataaatccctaattatccatttccctacattataatttgactactatacctagcatctgaaccatacccatgtccagagccagggcagacttggtgagttgagatcataaacaactgaaacccaacatgactgaaaaaacaagattcctttcttgctgaggttccaggctcctcatggatctccgggggagttctgccccgtgttgccctcggggagggggggatgtaggttaacagaactgctgacacgtggccaggctccatgccagagggaaaggaagtgtgacaggacctgaccacggtgtgagcctggtcagaaccggacccaggaccccacctcgcagcaaaggggaagcacagttgtgccccacatcgggcactcactggacatgtccaattgtcaagacctggattaccaccaatatgcgagctactccccaatccatccaaatttccttctccaggctggaccacttccctgaactccagacccaaattttcttctccaggctggaccacttccctgaactccagacccacgtattcaactatttctttaacacctgtgtttggaaatctaagaaaaatctaacatattgaaacccaaacttttggtctttctcccaaacatgcttctcctacaatgcccccaattcagttggtggttaattctatcctcctagttagttgcttggactaaaactcttagactcatctgtcttgctcaaaacccacatccaaacaatcagcaaatcctataagctccaccttcaaaagacccagaatgtgaccttcccctgctgctgcttactgccctggtgcaagccaccgtctctcctcccagatgttcacaattgcatcctaacccgcttctctattgccatctttgcaacctttagtccaattctcaacatggcaacatgagatgtttttttaaagataaatcaagacacacctctgctcaaaccttccaaaggcttcccagggccaccagagtagaggattttcagttgacaatggccttcaaggttcccagtgccctgatctcccactaccttcttgagggcgtctgcttcccttctctccatcacctgctcctccaggccactctgttcctccaccctccaggcaccgccatccagaggctctacaagcagctccctctgcctggcccctgctcctccagctacctgtgtgttctgtccctcactgccttccagtggtcagtaaacatttgatgaatgaatgaatagctgtatattcactagtagttgacgcctgggccatgtgacctgtaattttataagtaaggattacaaacactaaaatctttggaaaagcagtagatattggccagtagtgccctggaaggggacaaacgattgttcctcctgagaggcacatttgtcagagtggggctgagtgggcttcacccaaagcatggagtgcagggcagccaaggggatttatcctcagttatccccaggttcgacacgtgcacccagctagaaactctatttcggagctctccctttagccctggccaggaatggcaagagctggtgcagctggtggcccagggatagaagacaaggacccaccccagatcgcccctctgtcccgcagggagagatagaaataagtgtttttcttgtctcttgtttggggcagcctctattttatgctctctcttggagcagttcagcctgtatcctaactgcatcaatgctgtgttcagggcggggggagcgttcgccttttcatgctcacggttgagtcaagaatgggactctacaagagggaggcagttggataggaaagtgtaaacacttgcattgagagagattgtattaagcacacatatttttggagcagtagagagatcatttgtcttttttatattagcagatgaaaagaggcaatacggtaaagtattttttgtttttgttattgtttgttttggttttgctttttttgagatggagtctcactctgtcgtccaggctggaagtgcaatggcatgatcttggctcactgaaacttttgccacccgagttctcctgcctcagcctcccgagtagctgggattacaggcttgcaccaccacgcctggctaatttttttttttttttttttttttttagtagagattgggtttcaccatgttaggctggtctcgaactcctgacctcaggtgatccacccaccttggcctctcaaagtgctgggattacaagcatgagccaccacacctggccagtaaagtttcttttaaaaggcagccttgtaagagttttagcacaagcttttcttggcctccttttcttgaccggcgtgaagttttgcatcagaagctcctttggaaggcagagcaaaggaaatgtatgctcttatcggtggatttatctacttttaaatttctcccatggcccattttactcactttcgatgttttctttttcttcttacaaatgtttaggtctgcaaagtcattcaaaattcagtgtatctttatttcctggtctggtcactgtattctttaatattatcttccctgggatcaagaaagtcactttgctttgaaacggtctccttggggagctgacttacgcatgcagaactgttctcacacctgcctggtttggaaaggcaccaggatacagaagggagactgcattaaagtcacacaggagggtgggggtagctcagaaatcacagactcaaaggaaaatgatccaatatttcaaacaaaatcatgtctcatgtatttctgctccattacaatagggtaagttagatctagtcttacagggactgctatcttagatgtggaactctctaagtgcttaaaacgtcttctatgttattacatatacaaaggagctctttaatacagcaactgtctgtgacacggaagtcatatctcgattttctttgtcgactaaaaccactctaacctagaaagctacaccactactgaagaatttaaccagcattccccacaggtgaatgggcactaggtatgattcaattttaaaaggaaactgttcattgactaaattaccgaaatagtctacctgtcttctgttagtaccgtatttttatgactttttaatacatgcaaaatgtttcttgagtaaaaggctgtgcagtatttcctttaaaatggaaagatcctttgtaatttataaataggttcatctccccattgttaagctatgaataaattccattgattcatggctttagaaaataaactcttcgggatgtaattactttttcaacaacttctcaacaaattcactgccatgaagtcttattatgtgctccataaaaacaaatctaaaatgcaaagctaatgaaccaaaacatcatgcaaatctgagatgaagtttatgaaacatagggaagatgtatgaaggactagcttcatgcctaaactctgaatatcgtgacttctatatatgtagccatgaagtcatgtacaacagctaatggtaagcaaaagttgattggctggaaaacacagcatagaatctcaattttcatatttatccaacaaacacttactgagaacctactgcgtgctagccataagactgtctctgttctcatgaaattagcaattgcagtggacatacaaatgaataaacaggcataacaagaaggtccaacattaaattctttttattgggcgaaagaatagggtatgatgggaatgtgtaaaagagcatgttatagggaagttggaaagtttaacatagaaatgacatttaaactggtacctgaggagtaaacatgacttagccaagcaaaaagtaaaagtcactttaactattccggacaaaggaaaccatatgtgcaaaagctggtgtgcacgtgagaagaacaaatttcagggaccgaaaaaaatgtcagtatgaagtgattggagtgaagagtctgtgcatctggtagcaaagataaccttggagagagaagcagagaacaggcaataaagaagtgaagagatttgtagctggagcaatggcgataaggaaggaaaacgtgcaccagcttgagaggcctttgggtctgataatagaataaacagaaccagatgcttgggtcagtagaggggctgggggaagagtagagatgattcacagattttaggatggaccaggataaggaacaaagaggagggaggcggcagggaaggaaagagctcccttttggacttgctgagttatccagagatgtctgagagaagatgtacagttctcagctggatacatgactttggagctcagagtcgtatgagtccatgagttgagagtcatcctcaatgactggtgtctggggctgtggaaggagaccacatcgtcccgtttgctatagtaagaaccaaagaggaccctttggcacctgttgtttaaaggttaacagaagaacactcaaagaacactgagatggggagagtgtcaaataagtcaacaagataaaaatggtggaactgtgaagatagacaatgttagcagataggtgaaagaaatgagtcagcaaaataaactaggaatgagtagccagagaggtgagaagaaaaccaagagtgtgtgatgccaaacaaaaactcaaaaacagagcaccttaaaaagaagaatggttccgatacgacagcgtgaccaggaagaacagggactaaagattgtccattgggttcagtgatgggagaggatggttggggaggaagccagaggttcactaacagaggcgggttgagtgaagactggtaagagagggagccgaggcgggaatctacacagcgtcttcaaggagtgaactgcgaaggcagaaaagcgattatgcgatggctgaagggaaatcacttggcgggagtgctttgttttaagatgggagggactattttaaaggtccttcaactgatacctgcaagattccacagggcaaagatattgtaaacatacatttaacactcactgcactttagattatatatttacagagccacacaatgaatttacatctctcaaaatggaaattgatcttttttttaaattcagattcagtgactgcaaaaccctatgcagaaatatctgagtaatgaagatgttagcaaacccagcatggtccctgggcgtggctgctgtgggtttgtttgtttttacatttacactgttagaccatgcattgaacactccctattagaaccacagaaacccactggaaagagcctttaaagctaatcttatctgatttgttcttacatctcctttatgtatccccatcaagaggtcattcaacctgtgcttgaaaagctctgcggaccaggtattgacacatttcagaagtggcttgctctgtcctaaagcacttctgatttctagaaagctctcccttatgtggaattgaaattggcttccctataccttcttctgcttaggggtgatgaatgtaacttttcaggtcaaacttcctgggttcaaacccctgctctgccactaacacatcacgtgacatgggcgagtctcctatctctgttgtctccatgtatccatctgtacagtggggatgacgatcagaggcgacgtcacaaggcccctgccaggagtaacctgggtgctacatgcaaagcacctgggactcagcactcggtgagcattagccattatcacacccatcctgttcaactccatgggtccatgaagggaaaacaaacacaccagggacatctaatagtctcgacatgttctaacccttcaaacatttcaagaaaattctcatgtggctgcatttttctcttctaaatatcctaagttccttcacagcgtctcatctgacatgaatttaaattccttcgccatcttgtttacactcctttgaacatggttttatttatatccccttaaatcccatttatttatacccctctccttagcagtgtggtgcccggaacaggactgaatactccaggatggtatgtcctgagagacagagagagggcttattgcttcctgttttccttatgttgaagtttcgctagagctgcctaagacaccgttgctttttcgttgttacagtcccagcccacggctgaagcatgtggaatacacgacagtccctgaaacaacactgcctattcgcagtagagtgacgattctgtggaaaaactccctgtatcacctcccagctcatcccaccaacctctgtgtgccttattttccccgtgatgaaatgatatcatgataaccacgcctgtctcacagagggagtgaggatgaagaaggtttaatgtatgtcagtgctgggcagtgtgcccagcagagagtaggcctgatgcctgatactaatgttacctagcagtattattattattattattattattattattattattattattgagatggagtcttgctgtgcccctcaggctggagtacaatggtgagaacgcggctcgctgcaacctccgcctcctgggttcaagctattctcccacctcagccttctgagtagctgggattacaggtgcccaccaccacacccggctaatttttgtatttttagtagagatggggttttgccatgtcggcaggctggcctcaaactcctgacctcaggtgatccacccgcctccgcctcccaaagtgctggaattacaggaataagccactgcgcccagcctattattctaacaatattattttatcctaagtgcagaatattacgcagttctgctgcaactcttgttttgaagatacacgtttgttccaatgcagttgagatagtagggaacgatttgagctcagccccaaagtcgtatttgctcatgggcaatttcatctgtgataaacactagccgaatacagaaaattgcatgggctgaacagagcagcaaagaaatgtacaaaacccacacatgtccacgcctcaaacatctaccaacgatttcagttcactgagattttaggaactactccatccacgcctgccgacactccgttcttccaattgcagataatgccatttccaccgcttcacaataacccgcggactatagtccttccagtacccactcccgtgagcaatcttcggggttccctctgggtgaagagccatattcatggtggtatttatgttatttcttaaccactgaacacgtgtaaaaccacgctggaatttgtattagctttccgtctttttctcaaatgtgtcactgacgtgcttttgagcgctgtgccccaatcccgcttttcttaccagccctgtgatttgcgttgcatgattttgcatagcaccgacattctcaggtgcgcacatgtcgtgttaaagcagaactgactgcaattctctgttaagttttatggactctcagaatattttgattctgattctgttattcctaacatctgacatttctaatcctcatgttacccgtgattttgatgagactctaatactgcatatccgtaaatcattgaggtgaaaggctatattctgaaagatggccttacaaaaatgaaaaaggcacttcctgtgtgataaagtgttttcagtatgataatgaattttaagtcatgttattgacttaattaggtatttttcaatttagctttaggaagaagacacttttttttctggttattgaaatcttcttttaagaagacaccttaaggaatactacactgtcctataaaagagcaagatcatgtcttttgcggcaacatggatgcagctggcggccattatcctaagataattaatgcaggagcagaaaactaaatgccatatgttctcacctatcagtgggagctaaacattgggcactcggggacataaagatggaatcagtaggtgctggagactaccggggaggggagggggcgagggttgaaaaaactacctgttgggagctgtgctcactgcctcggtgaagggatcaactgtaccccaaacctcaggatcacgcaatagacccatgtaacaaacatgcacatggacccctgaattttaagtaaaagttgcaattatttttaaaaagttgatgacaatggactcattcattcattcattcattcattcatttttctgttcatttaaatgaagatttattgagcacctattaaaaggaaagaggaagggatgtagcactttggaccttggatggcgcgtgtagaatttcctacttgtctctgcttcagagatgaatccacgtggccctgggaaatgaaccttcttaccaagatcgccctccgctggtgacagagccaagtctccgggctcctagttcacagctcttcctacaacaccaggctggctctccgcgtctgatccagagccaggcccgcccatgaccgcaggctggtgttcactctaggcagcttttaagacggggagggatagcaggaacagttatgacttttttttggatacataatatgtgcacatactgatggggtacctgtggtagtttgcgacatgcacggaatgtgtaatgatcacgtcagggttttaggctgcacatccccttgagcacttatcatttctagtgctgtgagtgttaaaagtcctctcttctaggtatcctgaaatatacaatacattgctgccaactatggttaccctattgtactatcaaacatgagaacttattccttctaactgttgggtaattgtacccataccaattcctaatgagtactgtacccattagtaatggatactataactaatctcatatgcatccaatacccatccaatatcgaatgggtgttatacccattacccaacctctcttcatctccccaccgcccccgaacacacacacactccccactctggtatctatcattctattctctacctccatggatccatttcttttagctcccacacatgagagagaataagtgatatttgtctttctgtgcctggcttatttcacttacatcgtgacctccagtttggtggcagctttttgaaagcttccaggcactctgtgatgcccctgatggggcggccaggacctgctttctacctgggacaggacactggcctcaccctcactggggcatgggggcagctgccccatgagaagggttctttttgctcattagagcaaatgttggcattataaacacaaacccgtgccatgaggcaaaccctgctccttcaaggaagtcttgaggcttaaaagtcttaagtgactttgcagggcttttgaaggctgagaaagctttcattttctggaaggaatgggagaatagttctttattggtgttgctgatgataataaaatcggaaacacctaagtcactgtatataagcatactctttcatttcactattacagaataattctgatgagttctgtactgggccatcaggttcaattagttcattcatctgtaggatgcctcggcatagtatcttgacttacccattcatgcacttggttgacttattaatttagctctctacttattgacctcagtgggaactcctggcttgaattatgtgttcatttgtttgggtgtttgcttgggatgggtaatatccacacaggccacaggatttagaaggtacaaaagagtataacgagaaaataagttgccttttctcccctgttcttctcctttacctaggagaggcaatgacttttgatgctatcagaaagcacgttggttttcaggatggcttccgtgttcacaatcacgtgtgtgtcacacacatggtaatatgctatatacacattgttctagtcattctcagctggggacagttttgactcccggtgccatttcgccatgtctggagacatttttggttgttacactggaggtggggggccacaggtagctggtaggtggaggccagggaggctgctcaccgtcccgcagtgcacaggacggcccccaccacacagaaccgtctgacccaaaatgacattagtcctgaggttaagaatatctcgcttttatttatttatctttaactccttaagttgtttggactatgattcctcaagcaacttggcaggatgagaagaaagttttaaagttgcaggcgaaccggagctctattttatttctcgatatcctagcacctgccagagaacacggttcttagaagtctctccggcagtatgctttaaatgcataggcaatttgttaattatgggtgaagggcatttaacataagacgaaaggtacagtaagctgttctgtcttcaaatctgaacctcccaattgttctatagtgtagattagaattcgagtaccgtagagaaatacagctctacctgtttggatttttttttttttttttttttttttcgggacccaaaggaaacaatgtaggttaggatgaaaaacttccattttggaggcaaatgttggagaaattagctgcataaaagggtccccaggtccttcacctgtcctctgtgaaaaacaagttattaaaacaagcagaaagcttgcctgggcttttaaacggtgaggccagtcagttaccctgaataaaaggcgttataatacacataactgagagggatagaaggtgtttcaacttcatcaaaaggcttgaaaaggatgacactctttgcatctgtgctttcaggaagtttttcagggctgatatttattttaaatcagaatggcttacaaagcaaaccccctttataaaacgtgtcacatgtagcaatcctggagatgacctctacaattctaggctggacagagagattactcttaagagaaaaaactagatccctttaatcagctttaaaaaaaacattgtgaacagtcacttctcttatttaaaagtttaactttactttcatcaatttataatcagagttcctctggtatgtttgattcctgacaaacaaggataaaagttgtgtgcccccattgctaatgagatgataaaacagcagggatcaagtttttaattactacaggcgatgcactggagaggtaccgatgatattttctattgcatgtctaagttgtaacttcaggcttatgacagtcctgctgagttcgactgcctttgatgatcactcatttttgtctcctgagaacatacaaaaatttctgagctagaatcctggggggctggcaattattggcataacctggcacaggttcccctcttcaaccatcattgctcagtgaggatccagtttcttaatgcctgcccttacaccgaaagggaaattggacatccaaaatgtctatgaactttcatactcaaataatacccattctcacactcccagcatgggctttccgttaataataaaatatttaattgaattgggagatttctagtacaggctgtttcatttcttttcaaagtcatgatagaaattttttagttaaaaccttatttatctgcacatttgtaggtgcatattatatttatcgctctaaactatttaaacatttctaatagtattccctttgttactgcagacagttgataatagaaatgtttaaaggtgccattatttatcaaataaggtcagatgttctcaccctgtttgaaatggaaactaggagtggattccattaactctcttgttcacacaacacacacacatgcacacacgcacacacacacacacatctcagtggttggccagagcattcaacaaataagatttgctccaatccctgtttttagctatgaaaatatgagcagagagttcatgtgatatgtagacaattaccgggccaatctgaatacaaccacccaactcatcaaccaactaactaactagccacaatctttgagcactcaagtaatttcaaaattatgaagtaagaattgagtgtcagaattacaagcattggctgagtttactaagtagtttacatttctaagattttagatcataagcaaaaaaaaaaaaaaaaaaaatgcattctcagctactccattgggaaaaacccataaatgaaaagagatttacaaatagcaaaggtaaatgaactctttttttgtctgtctccttctcagaatctaaattacaatgcccttggggaatttcttctttctttctttcttttttttttagacagagtctcactctgtcatccacgcagtggcacagtctcggcccactgcaacctccgcctcccaggttcaagagattctcctgcctcagcctcccgagtagctgggactacaggcgcctgccaccacgcccaactaatttttgtatttttagtagagacggggtttcaccatgttggccaggctggtctcgaactcctgacctcaggtgatccaccctcggcctccaaaagtgctgggattacaggcataagccactacgtctggccaggaatttctatttttatggtcttttaaaaaaatcacatatgtaaaatataaagaccagatacttgcagcttattttcttcttgacaaaggaaagttaaaaatgttttaattatgcaatttgtgtataatatagaattcacattgcttgtgttaggatagaacagcccagaaccttggtggctggacacagtcgatgtgtactttttgttcatggaagtgctgcgaaggtggctggttgggcagccctcctggacagctgtcctcaaggactggctcccagagtccagtggctccttatcttcttgaatggcagtgctcccttgactctccacatcttggtggtggcagggcacagccaatttggaagatctcctggaagctttgtcagcctcacctggaagtgtctgtgtctgtttgctcacattccattggctagaagggcaacaaggcaccactaagatgcagtaaagcccagaaagaaaatgaattggtttgctaaacaagtgtgaacaaaagttctctgaaaaggaatttggaggaaagagactttattccagtgaacagtttgcaaactggggaaatggagtctttcctataaaatgaaggtgtgttgcaaagaaaaaaaggaaggctcaggttttaaagcgaaatgtcctgcccaggttcccaatcagatctgtttatgcaaatgaagaattgaaacttgcttagttctgattggttgatgcatttgagccctgattggttgatacagttgagccctgatcggccaaggcaggtgaactctggttggttggttcatctgagctctgaaagtcccaaagataaaaaaaaaatgtagggtaactcagaagataaaaatgagtgatcatgaaaggccatgaaactcagcaggactgtcatcagccctgtcacactagaacacgtgtgtggcctctagccagcaaatggacgctgggcttagtcttaaagttgggctccgtcagccactcaggattcatccaaaggctaagttcatatttgttcacacagcttaggtattttcctgcattaattataataatactctacccatataaaatgctttatacttgttgagggttttattaatattgtctcatttcatcctcagagtttggaaactagacagacactattatttacagataagaaaactgaggttcaaaaatattaattgccttgccagaggtcaaagagtcgttaagagctagaacgaaatgctagtattcttatttctgttttcctttgatttgtgttatatcacatgcttgccgtgatttatgaagcatactctcctttagaaacagttattataaagcaatctgttacagataaacagtctcaaaacattttcatcttctgcataatgtaacttcatataaattgaccataaaatcctagtaatctaagctacagaaagctttcttgtttttaatgatcactcgttgacataatttgaagtcttttcaaaatttcataaagtatgaacacagaataaataagtaaccacggttatcaaagtgatagatcttgaaatttgtttacagatcttatactattgaagattatatccatcttaattagagcatgactaacattttcataattctagtgattgccatatagttaaacccttatattccttccatgatgctggtcagaccagaaaaaaggcatacatgttaaaaataatggcctaacattattgtgaaaatatattcatacagttgaataatatagtagatacatgaaaaagctcttttaaaaaaattctttcaagaacacgtagatcagagacctttaatggtcaaattgctcaactatgagaattttttagcaaagcgatttatccaacagtttagatttgggcaggtaggcaggttagagcaggtcgttgctgagtgagttcaaaactagggctgaccatgaatgggccagggtgtgagtgctttcacctggtgactccaatattgtagatattgactgatgcctgcagaatccagccaccgtacccagaatcccatctacattatggtgaatccatgcaacagaaatgcaaagtgttagtgtaggcccgcttccctttcttctaataaagattcatggagacaaagtgtcggggagagcctcatttaaattcagacgtggctgattctgaaggctgtgttgagatttttgaaatctgcaataaattgtgatttttgttcttcttcctgctccactcccttttcccctccttcccctcctccttcctctcctcctccccctcttcctcctcctccccttacccctcctcctcttttctcctcctccttcttcttgttcttcgtcttcctctccttctcctcctccttcttcttcgtcttcctctccttctccttcttcttcttccttctcctcctcctccccttctctttctcctcccccttccccttcccattccccttcctcctcctcctcctcctctcctctttcttctttcttttcttcttcctttcttctttcttccttctttcctccttctttcctcctcctcctcctcctccttcttcttctaaattaataggctttattttttagggcagttttgggttcccagcaaaattgagcagaaagtacagatgggtcccatgtaccctctgtatccacagaggcaccatcaacattctacaccagagcggtccatttgttacaatcatttcccctacactgacacatcagtatcacccacagtccatagttcacattagggttcactcttggtgttgcacatcctatgggttttcacaagtgtataatgatgtgtatctgccattctattatcatacagagtactttcactgccctaaaagctttctgtgttccgcccatccatctttccctcccctgcaacctctggcagccactgaatgttttactatctccataattttaccttctccagagtgtcacatagtcggaatcatacagcacgtagccttttcagattgacttcttttacttagtaatatgaatgtaagtttcttccacatattttcataacatgatagctcatttcttcttagcacaaaatcatgttccatcttttcaatgtagcacagtttatccattcacctactgaaggatgtcttggtggctttggctttcgagttttggcagttatgaataaagctgctataaacatctgtgtgcacctaagtctttagtttatttgggtaaataccaaggagcatgacggtcttcccaggtgaaaatacatgcaatgaatgagagctccatatccttgcaagcacgttgcgttgtgaatgttttggatttgcaccattttataataatacatgtgtactatctcgttgttgtagtttgcagttccctaatgacatatgatgtggagcatcttttcaggtgcttatttaccatctgcctatcttctttggtgagatatctattcatgacttttttttccattttaaaattgggttattcattttttattgttgaattttaagagttatttgtatattttagataacattctttatcaaatgtttcttctgcaaatgttttctcctagtctgtggcatatcttctcattctcttgacactgtttttgcaaggcagaaatttaatttaatttattatgttttttgagatggggtcttactctgtcgcccaggctggagggcaggagtgggatcccagctcactgcaacctccgcttcctgggttcaagtgatctcctgcctcagcctctcaagtagctaggattacaggtgcctgccaccacacccagctaatttttgtatttttagtagagatgggttttcaccatgttggacaggctggtctcaaactcctgacctcaaatgatccgccctcctcagcctcccaacatactgagattacaggcatgagccactgcagctggcctagaaatttaattttagtaaattcagcttatcaattatctctttcatggattgcacctttggcgttatatatgaaagtcatcagcaaacccatggccatctaggtttcctcttcctttttcttccgggtgttttacagttttgcattttatgtttataaatgtctgtgatctgtgttgaattaagggtgtaaggtttgtggctggcttcattttttacagtggatgacccattgtttcagcaccatctgttgaaaagatgatcttgttccattgcactgcttttgctccattgtcaaagatcagtcaactataattacgtgggctgatttctgcactctctattctattccattgatctgtttgtctgttctttcaccaatgctgcacagctttgattactgtagctttgtagtaagtcttcaggttgggtagcgtcagtcctctcactttgtttttctccttcagtattgattgggttgatcgttctgggtctttggcaactccatataaaatttagaatcagtctgttgatagccacaagataacttgctgggattttgactggtattgcattaaatatatagatcaagtctagaataactgacatctttacaacattgagccctcctgtccatgaacatccatttatttatttcttatttgatattttatgatacaatttccaacagtggagacaaatcgttctgtatctctgctacagaatggctgtagggttctgtggttagatgtgtacagtggtgccagaccgctggggtcaagttctccccatccttcttgggcaggttatgcctttctataaaatggggtgataatggtaccttgctcatggtgtggattaaataggggatatgcacacagcaggtgcatagcaactgtgctttatcattattcaacttgctgaacttcatgaatagatcatgagtcactttggtgacatagtcaaagcaccaaagccaactagccattggtccttggaaatctgagagaagacacatcctttatagcgtttactttatggccatttcaacagaaaggagcatcctcaccccctctagataaaaaccatcatttctaagcatcccatttcttctaagaagttggcaattaccaaagtcaacccacaacatcagaaagcaagaaagagatgaaacccttcccatggaggaagctgacctgcacgtgtcttaccaagttctcctgagcccccactgtgggtccagctcagccctagccactgggttccagaggtcaaaaacacatgttttttgagcttgcattcaggtaaggaattgcaaatacacctgctttttctctgagaattggagatcttgagcacacacactgcctaaaacacaatcaaagtgtgcctcacatacatagatttggatgaaggatgacatcatacacagttcatgctgagtccgatgaccggtcccttctgccctttcgtgcattttacccacacagggcttgctttggacaggagtaaatgtaggtccatgtttctgaacttgctgaatttgaagcataggatagaatccagtccttgattgatgtttttatttcttcgaccgtctgtttccaccctgactggccctgaggacactgaatcaccctctccatgacacttttcacacctccccagaggggaggaggctgtaacgtggggctcgtgcatgaaaccatctctaaaccatgaccccatcagtttaaaactattaaaatttatcaattttcatgaaatgtaagctacaaaattgaatatattgatgaacttcttaatatgtaaaagctcactatacctggctgcttcataaattccttctactacctccaaggcagtaagagaaacagcttagagactggaagtcctttgcccaaatacagcccaggaatccagcccccaaatccagcctcttggtcatccactctctggtgctgccttgcacgtggtttgccactttaacttcctcctagccgctcgccaggcatcccaggataacgctgtggcctgggttccgtgagcacctctcccacccaaaacactggaggggcctcttctcattttcggtagactgcaagtgttagccgtcgggaccagcttctgtctggaagttcgtcaaattgcagttaagtccaagtatgccacatagcagataagggaatgtacaagacactcggtgtcgtgatggacagtgatggctgtgatgatgtcgtacgctcagctgatccttctccctgctgagaagagttcagctggatgcagggagccttacgttacatatcaggaaaaactttcaaaaaaagagatgtgtttcaactgtgagagttaaaatactaaagactcgacccaaggacattgagtaacattctttcctgaaaattttaagagtcactggataatggtgaagaaagcctggactggaatgtcagaggtgcctgaactcaagtccggtcaccagctgggtcaacacaggatagctacttaatcactcctcatatcagcccccacctctataaaatgtggacattaatattatcatgaaggtttatggtgaggaaccaagagaatgtagctaaaaatcccagaacatcataattgcttaataaatggcaactataatgattcactcttaataccaagagaaatgcctagctctcttttgctacttcattgtagatgaactgaataaccattttggttaactatgaattaaacaggaatgatcaaacatatacacatacaaaccatgattaggaaggagctggactcaggtgactcttggtaattgccttgggaatgttagatgctggtttgcaagtccccaaacagaacaatctcccatagctaaatacactggggcattaggaagatggagtgagattcacaatggcaaagacatggaatcaacctaaatgcccatcaacagtagactggatagagaaaacgcagtgcatatacaccatggaatactatgctgccataaaaaagaatgaggtcatgtcctttgcaggaacattaatggagctggaggccattaacctaagcaaactcatgcaggaacagaaaaccaaataccacatgttctcatttataagtgggagctaaatgatgaaaactcatggacacaaagaggggaacaatagacaccagggcctacctgagggtgaagggtaggagtagggagaggaacagaaaaaataactactgggtagggtactatgcttagtctctgggtgatgaaataatccgtacaataccctgtgacatcagtttacctctataacaaacccgtacactaatctccagaaagaggcctagcaacctgaacctaaaataaaagttaagcaaaaagatggagtgagatccacctgcgccaccaagaaatgatccatagaacaaatcattacataagaaaataaaaatcacagacgattgctctctatggacacatttacacaaatccaagtaaatggagaggaaaaggcgcagggggggatatggataaacagcagggtgttgaccaccagccgcttgggaagaagacctgctgtggggatggaagggagagagcagggaggcctccagggtttataccctgtatattgttcacgttttttacaatgagcattaattcctctgtcacctatgcaatattttttacatgttcaaaacaattcctaaaaattataatttcagagtgtggcatgataaaaaatgtagtgagggataaaacactacaaatcagattcagtgtatattgcttgggtgatgggtacaccaagatctcacaaatcactaaagaacttacttgtataaccaaataccacctgttccccaataacctatagaaataaaagttttttaatgcagagcaaaattagggtgaaggtttatgtggtagagtgtgccactattggaggaattttttaaatggtatatacagacagacagacatatcttcttcttcttttttattttttttaagacagagtcttactctgtcacccaggctggagtgcagtggtatgatctcggctcgctgcaacctccacctcccgggttcaagcgattctcctgcctcagcctctcaggtagctgggattacaggcatgtgccaccatacctggctaatttttgtatttttaggagagacacggtttcaccatgttggccaggctggtctcaaactcctgacctcaaatgatccgcctgcctcagcctcccaaagtggtgggattacaggcgtgagccaccatgcccagcccagacatatcttcttatatggacgaaaataatctccagaagtaggcctagccactgatgagaatggcagtccataagctgttactgttctggggtgaaattgttacgttttaaatttgctatcttgtcaatgtagtatctatttaaggataattacttacatgttaaaataaaaaatagaaaaatttagatgcccagagaataaattaatgcttgtaaaaccaaaataaacacagacctgaagcatcccaggtaaggttatgttccctttgaccattgctgtttctttagctcagttttaggtgaagtgtggatgaagaggtgaagaaaggaggtgattcaaagaaagtctccacaaacccgagattgtaaaatgtctcattatgaggtctggtggaaatggatttgaaaagcctaatttccaagttaaaagaggaaaagaggctgggcggggtggctcatgcctgtaatcccagcactttgggaggctgaggcaggtggatcacctgaggtcaggagttccaggccagcctggccaacatggtgaaacccggtctctactaaaaacacagaaattaggtgggcatggtggcacgcacctgtcgtcctagcctcctgggagtctgagacagaattgcttgaacctggaaggtggaggttgcagtgagcagagattgtgccactgcactccagctccagcctgggcgacagagcaacactccatctcaaaaaaaaaaaaaaaaaaaaagaaaagaaataattctaaaagtattcaagcaataaaagtcagctgatatttattatctactatagccaaggcatggagttggggttttatttgcctactttcagtgagaaagatgagctaaatcgtttttatggaaaataaaaaggaaacatttaaagtaacaacaaccaaaagtatccaccaatagtctctgcatcacttgggaagccgctagggagtgtgggacacacgctcagctaaacggcaacagagaatcaagcaactgctggctttagtgccctgctactcctaaatatgcttcaatgtttgcctctttcactggttaaaagcactgttgttggtctgacggtctttggtttctcttctcagggaatctcagaccgagcactttcatttccttctcaccatgcaggaaatgagtagacgtgacactcctgttttggtaagaattgacacacagctaccctcatctggtgaacggacgaattggggctaaagctgaatggctgacatgtcaacaacctgaaataaaaacaaaccagccttgtttaagagtgaatttgctttgtgcaaattgtcaaaaagaaaacacggaaaaaccgtctcctgcaaagaggaagaaaagggttacgttgttgacaaaatctgggtttccttgcaaataatggtctgttgcttgtatgccatcgtcacattttggatggcagattgtttaagaaattaaaaaaataaataaataaattatctagttagcaaaaggtctggagcacagaggctggtcatttaccccagggccaggaagatgaaagcacgttcacccgccatttgcggctgccctagcgcgttagtaccatctccccgtgcccacagatatccacacacagcaactctcaggggacaaatgcgaagccatgtgattttccccctgctatgttaaaaatgcattcctattttttcaagcatgcttcgattaaagagggcacatctgttttaagtccccttttatgaaaattactgagcttcctcggcgtgcttatcttttaatttcgaaattctttgtagcaatcacttgggataataaccagccatatttctggcccctttaaaaaataaaggggagggtggggaggaaaaaagaaagaacgaacaagccattttagagctttgaactccctgttctaatcctcccgctttgggcctgggtggaaagggtcccccttcgtttgcgtttagaatggctgagccccgcgcgcactgcctcagcctggcctgccagcccccgagcctgggcccagcttgacgctgcagcgctattcatcgactccccggcagggggagccgctgcgcaccgccaccgccaggcagcaaagcgctcagcttccttttaaggcctcttcatccccccacccccaaacacttttcacagagtttctcacccctttcttccctctggaggggctccttgaacggacaccaccctggatggctttttcctaggcagacctcccacccccggcgtttttgtttcgaatagcacctaacgggcggggttgcatttaccatctgtgtttcgaatagcacctaacgggcggggttgcatttaccatctgtctttctgctgttttaaacccttgtttaaggctcaggctgttcagagacgtaatccggggcttgagcaaagagtgaaaagttgagattccttctctggacttcctgcaccgattttttccttgtttcctccaagcgttgatgagatgagagatgggctgtaaggtggggaatggaacacacgcttaagtgtctggaaaccgtgtgattcttggggatggccacatagctggagaaccgtggagtcgtcgtgcctcctgggccacacccgccacctggcttcagttggctgatcagcagcaagaggcagagcttaacagttctgttttcctccccgtgaaataaggataacgacaatttcagctgagtctttataatcatctgaagaaagggatccctagatgtccaagacgatttactgtgtgctatgtttagaggctaaagataaaataagaagaaacgtgaggtaactggtctcttctcgtcgacgcacttaggaagcccaaatactttcatcctgaaagcgtgcaatcccctgccacattcatgtctgcaacactgacttggaaattccctgaataaataagcgcatacggcaggagatgctaatccaatttagaaaagttctgcggagcttgatttttccctcccactggacaatgccggggtctttccatctttatcttggcaaatggggtcaggagaagagtgaaaggtaaaagtattagttctgctttagttcacagcgctgacgatcagtattcaaatgggactggtggtgacatgtggctttcagtcacagcacacgctctccctcaccgtggaagattggtcgttgaatgtatttactatttaaaaaatgacctgaatcaacaaaatcttgctcaccatccatacgtacttattgtgtatctactgcctacaggaagcctccaggccaggcactcaagagcaacgcccatcaatagaaagatgtttcctggagttaagatcctaatcaagttggggagacgaggtctataagaagaaaagaatattaatcgttaaatgtcaaagagttgcagcagcatttattcagaaattaaacagcaaaattattcttcatgctaggaatataattcctaagacaagcaaagtctctgccatagtgaaggctacctgggaggagatggaggacagaaagcaaacacgcaaacaaataaaaatgtaatttcaggccgggcgcgggggctctcatctgtaatcgcagcactctgggaggccgaggcgggcagatcacttgaggtcaggagtttgagaccagcctggccaacatggtgaaaccctgtctctacttaaagatacaaaaattagctgagtgcggtggcaggtgcctgtggtcccagctactcaggaggctgaggcagaagaatgacttgaacctgggaggcggaggttgcagtgagccgagatcacaccactgcacttcagcctgggtgacagagggagacaccatctcaaaaaaaaaaaaaaaacccagaaaaaaagtgtaatttcagacagtgacatgagctatggagcaaacagagcaatgaggtgggaggggcgggtgggggtgatatggcagcacctctgggaagatggcactgaagccccagggaggatggctgaggctgggaataggctggaagagggctgagggtgaggctggagagaggcagggctacatcatccagcgtggagtttcccatgtctgacgggcatgggagtcaaaatgcagattctggttccaaaagtgcgtgcacgggttgggggatgagattctgcatttggaacaaggtgacggggctgccacactttcaaccatgcctagagtagcaagggccagagatttggtttttgacctcagcctcgctagagtcacctagagaacttttaccaatctcagatgctggggccccttcctggtggttctaatgaacatcaaaggttgagaactactgatttagcatcttggccatggtaaatgataagggtcttattgtctcacccattgggaggggctaagagccaccaatcggccttcagaggaggctttccagggtagaccagggcttgagccagacttcggtgcacatcaagctcaaagagatagaggttcaaagagatccattagagatggataaaaggcataagccaggtttctcaacattttgcaccattctaacattttgcatcataattctttgctgtgggggggctcctgtgtgctgtgggggcactcctgtattctgtggcatgctatgagcaaacctggtctctacccatgagatgcccgtggaaccctcccaagatgtaacagccagtaatatctccggatattgccagttgtccctgggaaaagaaatggaccccagtggagaaccactgacataaacaaagatgaaaaaccagaaaagtcaaagatccatgcattatctgaatgacattcactccacatctgtggtttaccatcctggactccggcgggctttggagacaggtctccctctctgaaggcagagaaaacacaggcttggggtgccaacaaatgcatacatttatttgaaaagaaaaaatttgacattgaaaaaaggcacctgatatagtttggctgtgtccccacccaaatctcattctgaattgtagctcccacaattcccacatatcatgggaggaacccagcaggaggtaattgagtcatgggggcgggtctttcccatgctgttcttgtgacagtgaacaagtctcacgagatctgatggttttgaaaactggagtttccccgcacaagctctctcttttggttttgaacactggagtttccccgcacaagctctctctttgcctgccaccgtccacgtaagacatgacttgcccctccttgccttccgccatgattgtgaggcctccccagccacgtggaactataagtccattaaatatttttctttggtaaattgcccagtctcaagtatgtccttatcagcagcatgaaaacagatgagtacagcacccaagtagacaccactgggagaatcagaattctgttagtcttcctcattttaagttttaatatttcctttatttaaaagactgggctgctaatacaagcaacaatgtgtatgaacctagcaggcagtcctggagaagactcaaaggagcacagagtattcgattccacctatgtgacattggagaacaggcaaaacgaactcagggtctcggggtcggatttgtgattcccctgcggggtgggctcaggggagacttctggatgctggaaatgtcctatatctcagtgttcctttctggtaccagggactggttttgtggaagaaactttttttacaggctgaggtggaggtggggggatggctttgggatgaaaattgcacctcagatcatcaggcattagattctcacaaggacccactggagtccaggatggtaaaccataaacatggagtgaatgtcaggcagataatgcatggatctttgacttttctggtttttcatattgctgatgtcagtggttctcaactggggtccatttatcttggggacaatttctcttggggacaattggcaatgcctggagatattactggttgttacaacttgggagggttccactggcatctagtaggtagagaccagggttgctgatagcatgccacagtacacaggactgccccacagcaaagaattatggagcgtgcagttcacaatagggttcgcactcctgtgagaatctagtgccactgccgatctgacagcaggtggagctcaggcagtaatgcttgtttgcccaccactcacctcctgctgtgcagcctggttcctaacaggccacggaccagtaccagtccatgcccaggggttggaaacccctgctctctctggaactgggtggtacttctgtgaatgcatacagacgcagggattcgttcagctgaacgcttacgatttgtacagttggccaggtgcagtggctcatgcctgtaatcccggcactttgggaggccaaggcaggtggatcacttgaggtcaggagttcgagaccagcctggccagcatggtgaaaccccgtctctactaaaaataccaaaaaaaattagccaggtgtggtggtgggcacctgtaatcccagctactcaggaggctgaggcaggagaattgcttgaacccgggaggaggaggttgcagtgagccaagatcgcaccactgcactccagcctctttatttttttacatctaaaaaaaaaaaaagatttgtacacttgatgtatgttccatgtatataaaagaggcccctttttacagagcatagaggttctaaagcgatgtctgcctaggacccagggcatacctggtttctttctggctggatgataagatctatattgcagtattgtaagctgggtacgaatcttggtggaggagcctaatgaggaaaaggccactgtcaagacagggaggagcatccaatccttgaagggtctgctcttctgctgctgggagagtacagtgccctcttccggcagccagggtgtgtgtcctccatatgctcttcagacaggcccaatggagatgtatcatcgtgtcccctcccagagacagagccgccgacagctccaattaggctcctggcagcaaaagaccaagaaggattgatggatgactggacggatggggagatgagaggctgggaggaagcaggccaagcggaatgccaggtgcacagtctcagtgtgggcattacgagttctctctacagttctttccatttttctgtatggttgaaagtttttataatataatgtagggagggaaatcagccttcttttctgtttctgctgagctaaaacaccatgagggcttactaatagagcacattttactggaagctctgttaccatttgtaaccatcaccacgcgttacatccttgttcacaatgaggttatcgttgaggaatgtcgtctaagagaaaatactcagatgcttttctggaggtaaatgtttttaaatgttgggatgatttgtcaagaaaagacttttcgtatctaccctcggataatatgtagaatt

(The sequence listing continues in the following parts.)

What is claimed is:

1. An isolated nucleic acid comprising a nucleotide sequence which is at least 98% identical to the nucleotide sequence set forth in SEQ ID NO: 31.

2. The isolated nucleic acid of claim 1 comprising the nucleotide sequence of SEQ ID NO: 31.

3. A vector comprising the nucleic acid according to claim 1.

4. A vector comprising the nucleic acid according to claim 2.

5. A host cell comprising the vector according to claim 3, wherein the host cell is selected from the group consisting of a bacterial cell, a yeast cell, an insect cell, a mammalian cell, and a plant cell.

6. A host cell comprising the vector according to claim 4, wherein the host cell is selected from the group consisting of a bacterial cell, a yeast cell, an insect cell, a mammalian cell, and a plant cell.

7. A composition comprising the nucleic acid according to claim 1, and a physiologically acceptable carrier, excipient, or diluent.

8. A composition comprising the vector according to claim 2, and a physiologically acceptable carrier, excipient, or diluent.

9. The nucleic acid according to claim 1, which contains at least one single nucleotide polymorphism set forth in Table 10.

10. The nucleic acid according to claim 1, which contains at least one single nucleotide polymorphism selected from the group consisting of SNP Y +1 and SNP H 1.

11. An isolated single-stranded nucleic acid which is the complement of the nucleic acid of claim 1.

12. The nucleic acid of claim 1 which is single-stranded.

13. A kit for detecting a 12q23-qter nucleotide sequence comprising:
    a) the isolated nucleic acid according to claim 1; and
    b) at least one component to detect hybridization of the isolated nucleic acid to a 12q23-qter nucleotide sequence.

14. A kit for detecting a 12q23-qter nucleotide sequence comprising:
    a) the isolated nucleic acid according to claim 2; and
    b) at least one component to detect hybridization of the isolated nucleic acid to a 12q23-qter nucleotide sequence.

15. The nucleic acid of claim 1 which is double stranded DNA.

16. The nucleic acid of claim 2 which is single stranded DNA.

17. The nucleic acid of claim 2 which is double stranded DNA.

18. The nucleic acid of claim 1 which is cDNA.

19. The nucleic acid of claim 2 which is cDNA.

* * * * *